United States Patent 11,098,302 (IDENTIFICATION OF POLYNUCLEOTIDES ASSOCIATED WITH A SAMPLE) - sequence listing, part 59

SEQ ID NO: 202772 - DNA, 790 bp, Homo sapiens
  misc_feature: GYAE6OF02H4FWQ.21.46.E02.1.454.CMB.1.raw
  modified_base (512)..(512): a, c, t, g, unknown or other
  misc_feature (512)..(512): n is a, c, g, or t
  modified_base (556)..(556): a, c, t, g, unknown or other
  misc_feature (556)..(556): n is a, c, g, or t
  modified_base (563)..(563): a, c, t, g, unknown or other
  misc_feature (563)..(563): n is a, c, g, or t
tcagtcgtcgctcgcacgaccggtgctcgatttagactcatctacagggaaagggggtgggtccaggaggcagaactctgggtgtctcaccatggcctggactccctctacttcctccccctcctacactctctgcacgaggctacgtggacggcctctatgagctagacacctacgcccacccgttcggtcgtacacggttcccgtaccccgaagggaccgaacggaacccggaccgtaagggtacctaccctaccgttcggtacctccggtagacgtaaggtacgttacgggtaacctacggaaaccgtaaaaagtaaatcgtacgttacctttaggttaaccggtaaccaaacgtaacggaaccggaccgacgggaccctaccccgggtcccgtttggttagttaacgtagtaaacttaacgttaaaacggaaaaacgtccgtaacggtggtaaaccggccccgggtacctaacgaagggtacctaccgtcccggtaggacgttccgtnttcgtcggtacggtcctaccgacggtcctaacggacgggtaacnccggtanacggttacccttagggttactacgttcaacggtagtaccgtcgacggtacggtacggaaggtaccggtacgaggtcttaacgattaccgtagtacctaagaacgtagtaagcgtaaggctaagttacctaggtcggttagggtacgtcggacgggaacgtcaacggtgtacccgtcggtaactccggacgtaccggtaccgtaccggccctaccccgtcttacccgg

SEQ ID NO: 202773 - DNA, 734 bp, Homo sapiens
  misc_feature: GYAE6OF02H71WE.21.46.E02.1.454.CMB.1.raw
  modified_base (224)..(224): a, c, t, g, unknown or other
  misc_feature (224)..(224): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacacgcccaccctcggtgtcagtcgccccaggacagacggccaggatcacctgctcgtgcagngtcggactcgaccgaaaagtaactagtcgtactttagttacgggtaaaccaaacgaaggaacgaccgacggccgaacgggtcccccttggttaggttaagtagtaattaattaaagtaaaacgaacgaaccgttaggacggtacgtccccgtagaagacgacgttccccgtaggacgtacgtacttcgtcgttacggcctccacgtctacggacggactacgactaccggttacgtacggttaccgtaacgttaacgtacgaaggttacggtaaacggtaccgtaccggggaacgaaccgggaacgggaacggaacgggtacgttacggaaacctttacgttaacggttcaaaccggtaaaacgtaggttaaacgacgaagggttaacgaacgttacgtacgtagggtttcgggtacggttcggacgggtaaggaaccggtaaggtccgtacgggtacctaccggtaagtcgaaccgtaccggaccgggtacctcccggtaccctaccgg

SEQ ID NO: 202774 - DNA, 769 bp, Homo sapiens
  misc_feature: GYAE6OF02JGOKI.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgacgcctctatgagctgacacacgcccacccgtggtgtcagtccgtccccaagggacacggaccggccgaggtactccaccgtgcctcgtcgctaagacgtcggacctgaaccaaaagtaattagtcgtactttaacgttacggaaccaaacgagaaacgccgaacggcccgtacggtccccttaggtacgtttaggtagaacttaataacgtaaaacggtacctaacggtacggaacgggtaacccgtccccgtaagaacgaaccgtacccgttacccgtaggacggtaccgttactttaccgtccgttacggaccttaccgacgtacccgtaggtaacgggtacaaccgtcgtaccggtaccgtacggttagtaaccgttacgtaacggttagtaaccggtacgtaccggaaggacgtagggaacgacgtggtacctagtaccgttataaccgtacgaacgttaacgaagtaagtacgtaaaggttaacgtaacgttgttaaccggttggttcggggttaggtccgggacgaacgggtaccgaagggttcccgtacggtacccggttacgttaccggaccggtaccggaaacccgtcggtaaccccggttcccgtcccgtaccgg

SEQ ID NO: 202775 - DNA, 637 bp, Homo sapiens
  misc_feature: GYAE6OF02HTJJC.21.46.E02.1.454.CMB.1.raw
  modified_base (387)..(387): a, c, t, g, unknown or other
  misc_feature (387)..(387): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatccacctgctctgcagataggactgaccaaaagtaatatgtactttagttacggtaaccaaagagaacgccgaggccgacggtccccgttgtgttagtgtattaataagtaaaacgactacgtgaacggacggcccctagacgtacgactcccgtagacgcgtattctctcggctacgancgtacgacggactacgacgacgtctacgttgactatacgagtagactcgagacgagaggacgagtcgtagtacttattacgtgaactaactagtaacgagtagtaaggtaacgttactacggttaggtttacggggttgtccgggggacggtaacgggtaaccgtaacggcgttaccggaacccggtttaccggtacgggaccgtaaccggacccggtaacggtcccgttaccccggtccccgtcccggg

SEQ ID NO: 202776 - DNA, 854 bp, Homo sapiens
  misc_feature: GYAE6OF02FYBYX.21.46.E02.1.454.CMB.1.raw
tcagtcgtcgctcgcacgaccggtgctcgatttagactcatctacaggggaaagggggtgggtccaggaggcagaactctgggtgtctcaccatggcctggatccctctacttcctcccccctcctcactcgtctgcacgacggcctcgtgacggccctcctatgagctgaccacagaccccacccgttcggtataccagtccgtacccccgaggacgacggaccggcccaaggtactccaccgtggccgtctacgacgagtacgtcgggtactacggaaccaaaaagtaaagttatcggttacttttaacgttacggtaaaccctaaagaaacggaaccggttacccggacggacccggtaccggtccccgttaggttcgttaaggtacgtaattaagtaaacgtaaacgtaccgtaacgtacgggaaccggtaccggacccctaggaacgtacgtacctacccgagggtaccgacttaccgttccttacggtccggacccttacggacgtacccgtacgggaacgaccggaacgtccggtaacgtaccgtttaggttaccgtacgttaacgtccgtaaggtcggtaaaccgtacggaacgtaccggaagggtaaccgggtaacgtacgggttacgtacggttaaaccgttaagttaaccggttacgtaaaacgtaaaccgttaggtaaacgtaaccggaagggttaacggaaccggtttaacgtcggttaaaccgggtttggggttacggtccggggacggaacgggtaccgtaacgggtacccgttacggtaacccgtcggtaaccggtacggaccggtaccgacccggtcccgtccccggtaccgtccgg

SEQ ID NO: 202777 - DNA, 813 bp, Homo sapiens
  misc_feature: GYAE6OF02HU5XH.21.46.E02.1.454.CMB.1.raw
tcagtcgtcgctcgcacgaccggtgctcgatttagactcatctacaggggaaaggggtgggtccaggaggcagaactctgggtgtctcgaccagtggcctggatcccgtcctacttcctcccctctcactcgtctcgcacaggctctgacgcctctatgagctgacacacgccacctcggtctcgacgtccgtccccaggtaccaggtaccggccgaggtactcctaccgttggacctcgtcggacagtacgtgggtaactcggtaacctaaaacggtaaagttcgtaggtacgtttaacggttaccggtaaaccgtaaacgaacgtaaaccggttaccgacggtaccccggtaacggtcccccgttaaggttaacggtttaacggtaaggtaattaacgttaaacgttaaacgtaaccgtacgttaggaaccgtaccggtacctaccgagtacgtccgtaccgtacggtaaccgtcgttaccgtttcgtccgtcgggttaccctccgtaacggttcgaaccgggtaggtaaccgacggtacggttaccgtacgttacggtttacgaacgttctaaccggagttacgtaacgtccgtaacggacgacggaacgggtcgtaacgggtaccgtattaaccgttaacgtttacgtaacgtaacgtaaacgtaagtaacgttaagtaacggttaagtaacggttaacttacgtaaggttcggtacggtccgttacggggacgtacgaacggtcgtaacgggccgttaccggtagtaccgtaaccggaccgtaccggacgtcccccggtctacccggg

SEQ ID NO: 202778 - DNA, 751 bp, Homo sapiens
  misc_feature: GYAE6OF02J0R2U.21.46.E02.1.454.CMB.1.raw
  modified_base (85)..(85): a, c, t, g, unknown or other
  misc_feature (85)..(85): n is a, c, g, or t
  modified_base (270)..(270): a, c, t, g, unknown or other
  misc_feature (270)..(270): n is a, c, g, or t
tcagtcgtcgctcgcacgaccggtgctcgatttagactcatctacaggggaaagggggtgggtccaggaggcagaactctgggtntctcaccatggcctggactccctctacttctcccctcctcactctctgcacgagctctgaggcctcctatgagctagacacacggccaccctcggtgtcctagtcgttccccgaggacacggacggccacggactaccacgtcgcttacgcgacagtagtacggacacggaacctaaaagaattntactacctttaggtttacggaaaccaaacggaacgaacgccccgtagggacccgtaaccggtccctggttaacgttagtacgaagttaactaaacgtaaaacgactacgaggaacgcggtacccctagaaggttaccgaccttcgtagacggtacgttactttaccgtcgtacggaccttacgaaccgttcgaccggtaagggacaacacccggttaggaacctttacggttaaccgtactaacgtccgtaagttaaccgacgtcggacgacgtaacggacgacggacgttacgtagacttaacgtactaggtaaccaaaggtacgtaacggaataccgggtaacgttaacgttacggttacgttaacgggttcgggtaacggttggggaaccggtacggtaaccgtaggtaccggttacgaacccggtttacgaaccggtcgtaccgaaccgggtacctcgggccccgttacccgtacgg

SEQ ID NO: 202779 - DNA, 775 bp, Homo sapiens
  misc_feature: GYAE6OF02FLT29.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgaccacagcccacccgtcggtgtcagtcgtccccgagacgacggaccggccagggtactaccaccgtcgtccgtactcgcacgagtcggactcgaaccaaagtaaactagtcgtacgtttagttacggtaacccaacgacgaacgaccgaacggaccgacggtccccgtagttcgttagtagtaataagtaactaaagacagttagacgtacggtccctacgaagacgtaccgtacccgtaggacgtacgttacgttacgttcgttcggtccgttaccgacgcgtaccggaacgggaccgacgtacgtaccgtacgtaaccgttccgtaacttacgtacggtaacgtacggtaacggtaccggtaggacggtaagggacggaccggaacggtcgtacgttaacgttacttaacgtacgtaacgtaaacgtaacgtaacgtaacgtaaaggttaacgttaacgttaacgttacggttaaggtttacgggggttacgtaaccggggtacgggtaaccgggtacgtaaccggtacggttaaccggttacccgttaccgggtaacgtaccggaccggtacccgaacggtttaccccgtacccggttaccccgttacccgg

SEQ ID NO: 202780 - DNA, 254 bp, Homo sapiens
  misc_feature: GYAE6OF02IYHIZ.21.46.E02.1.454.CMB.1.raw
  modified_base (243)..(254): a, c, t, g, unknown or other
  misc_feature (243)..(254): n is a, c, g, or t
tcagtcgtcgctcgcacgaccggtgctcgatttagactcatctacagggaaaggactggagtggttattattcctgggccagggaaccctggtaaccggtctcctcagcctccaccaagggcccatcggtcttcccctggccgccctcgctcccaggagcacctccgagagcacagcggccctgggctgcctggtcaaggactacttccgagcgacactgagcgggctggcaaggcgcatagnnnnnnnnnnnn

SEQ ID NO: 202781 - DNA, 682 bp, Homo sapiens
  misc_feature: GYAE6OF02GVWUM.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctctcactctctgcacaggctctgaggcctctatggagctgacacagccacccgtggtgtcagtcgtacccaggacacgacggaccaggactaccacctgctcgtgacagtagtcgactacgaaccaaaagaatcgtagtacttagttacgtaaccaacagaacgccgaccggaccgaacggtccccgtaggttggttacggtagtaactaataaagtaaaacgaacgtacgtaggaacggtaccgcccttagaacgaggaccctacgtacggacgtaccgttacgttcctacggtcggtaccctaccgacgtaccgtacggaacggtaacgacgtacgacgtaccgttcgtacgactacgtatacgtagacgacgacgtagaagggacgaacggacgacgtacgtacgttaattacggtaacgtaccaaagtaggaacgtaacgtacgtaagtaccgttaagtcgttacgggtcgggttacggtcgggacgggtacggacgtaacggcgtacggtacctaccggtacgacgaccgaccggacgtaccgtccggtaccccgtcg

SEQ ID NO: 202782 - DNA, 849 bp, Homo sapiens
  misc_feature: GYAE6OF02IXDES.21.46.E02.1.454.CMB.1.raw
  modified_base (136)..(136): a, c, t, g, unknown or other
  misc_feature (136)..(136): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacnggctctggacggcctctatgagctgacacacgcccacccgtcggtgtcagtccgtccccgaaggacacggaccggccaaggatccaccgtgacctgtcgacgagagtcggaacctcgaaccaaaagtaaattactcgtactttagtaccggtaaccaactaaggacgtaccgacggcccgtaacggtccccgttaggttacggttagtacgtaattaagttaagaaaacgtactaacggtaggaacggtacccgacccgtacgaacggaacgtacccgtacccggaggtaaccggtacgttaccgtttcctacggtccggtaccctccgtaacggtccggtaaccgggtaacggggaaccgtaacggtaccgtaaccggtaccgtttaccgggtttactaaccgtacgttacggtaaacggttacgggtaacgtacccgggaaacggtacggtaacgggaacgggtaaccgggtacgttacggtaacgttaaccgtttagtttaacgtaaccggtaaacggtaacgttaacggtaacggtaacggtaaggttaacggtacggttaaccttacgggttagggtttccggggtcgggtttaccgggggacgggtaacgggtaacccgaagggtcccggtaccggttaccggtaccgttaacggacccgtaccgggaaccgttacccggtcccgtacccgggtcccccgttaccgg

SEQ ID NO: 202783 - DNA, 717 bp, Homo sapiens
  misc_feature: GYAE6OF02FF3JW.21.46.E02.1.454.CMB.1.raw
  modified_base (228)..(228): a, c, t, g, unknown or other
  misc_feature (228)..(228): n is a, c, g, or t
  modified_base (470)..(470): a, c, t, g, unknown or other
  misc_feature (470)..(470): n is a, c, g, or t
tcagtcgtcgctcgcacgaccggtgctcgatttagactcatctacagggaaaggggtgggtccaggaggcagaactctgggtgtctcaccatggcctggatccctctacttctccccgtctcacgtctctgcacaggctcgtgaggcctcctatgacgctagcacagcccaccctcggtctcagtcgtccccgaggaccagaccgcgacggataccacctgccgttcncggcagcgtcggactacgaacctaaaagtaagttcttacggtactttaacgttaccggaaccaacgtacggaacgccgaacggacccgcggtaccccttgggttaccggttaatgtaacttaacgttaacgtaaaacggaccttacgaggtaccgaccggtcccttagaagtaccggacttcctaggacgtctacgtttcacggcgtcctcggactacgtcgaacggactcgacgtcgtacncggtttacactcgagtacgacgtacgcgagacgtacggacggacgtcggtactacgttacttacgtacgtaacgttaaccaacggtagtaacaacggtaacgttaacgtaacgggtttaccaaggtttcggtacggggtttcgggaccgggttacggaaccgggtacctaggtccttaaacccgggtaccgtccgtaacggtcctaaccgggacccttacggacccgttccgtaccccgggttaacc

SEQ ID NO: 202784 - DNA, 866 bp, Homo sapiens
  misc_feature: GYAE6OF02IF1TX.21.46.E02.1.454.CMB.1.raw
tcagtcgtcgctcgcacgaccggtgctcgatttagactcatctacagggaaagggggtggtccaggaggcagaactctgggtgtctcaccatggcctggactccctctacttcctcccctctcactctctgcacgaggctctaggacggcctacctatgagctcgacacgacgccctacccgtcggtgtccgacgtccgtcccgaaggacacggtaccggcgaaggctccgacctcggctcgtcgacgtagtagtacggactacgaaacgtaaaagtaactcgtacgttactttacgttaacggtaacgaacgaggaaccgtaccggaccggtaccgtaaccggtcccgttaggttaggtacgtagtaagttaactaaagtaaaacggtactacgtaacggtaacggtccggtacccctaggaacgtaacggtacctaccccggtagacgggttacttaccgttcccgtacgtaccggtacctaaccggtcgtaccggtaacggaccgggtaccaacggtaccgtactacggtcgtactaccgtacggtacgtagggtacgaacgggttaccgaacggtacggaaccgggtaagggaccggtaacgtaccggttaacttaaccgttacgttacgtaaacgaacgttaaacggacgtaaggtaaccggtaagggttaaccggtacgttaccgttaacgggttagggttacccgggttaggggaaccccgggggtaggtaacccgggtaacggaaacccggtttaccgggtacccgggtttaccggaaccgggtttaaccggtacccgggttaacccggaacccgggttaacccggtcccccgttacccggttaccccgttacccggg

SEQ ID NO: 202785 - DNA, 743 bp, Homo sapiens
  misc_feature: GYAE6OF02FZMFN.21.46.E02.1.454.CMB.1.raw
  modified_base (242)..(242): a, c, t, g, unknown or other
  misc_feature (242)..(242): n is a, c, g, or t
  modified_base (266)..(266): a, c, t, g, unknown or other
  misc_feature (266)..(266): n is a, c, g, or t
  modified_base (317)..(317): a, c, t, g, unknown or other
  misc_feature (317)..(317): n is a, c, g, or t
  modified_base (334)..(334): a, c, t, g, unknown or other
  misc_feature (334)..(334): n is a, c, g, or t
  modified_base (681)..(681): a, c, t, g, unknown or other
  misc_feature (681)..(681): n is a, c, g, or t
tcagtcgtcgctcgcacgaccggtgctcgatttagactcatctacagggaaagggggtgggtccaggaggcagaactctgggtgtctcatcatggcctggatccctctacttctccccctctcactctctgcacaggctctgaggcctcctatgagctagaccacacggccaacccctggtgtcagtcgtcccaggcagacggcaggatcactgctctgcagatggactgacaaagtaaatnatcttagttcgaaccaacgagacncgaggccagccccgttgtacgttgtaggactataaagtaaacggtacaacnggaggaacgtcccctanaaggacgaacttcccggtagacgtcggtatttcctagtcggctcgacgtctaaggcgggactacggactcgtacgtagtcgtactacgtagcgtaggacgttacgaacggacgtacggaacggacggacggtacgtacgtaaccgttagtttaacgtaccttaaacgtaaaccgtaaggtaaaccgtaaaccggttaacgggtaaacgggttaaacgggtttaacccgtacgtttaaaccgggtttagggggtttaccgggttaccgggggttccggggaaaggggtaaaccccggtaacgggttacccggttaacggttacccccggttaaagggttaccccgggngttaaaacccccgggggttaccggaaaccgggttcccggttaccccgttacccccccggggg

SEQ ID NO: 202786 - DNA, 694 bp, Homo sapiens
  misc_feature: GYAE6OF02GVIN2.21.46.E02.1.454.CMB.1.raw
  modified_base (220)..(220): a, c, t, g, unknown or other
  misc_feature (220)..(220): n is a, c, g, or t
  modified_base (234)..(234): a, c, t, g, unknown or other
  misc_feature (234)..(234): n is a, c, g, or t
  modified_base (273)..(273): a, c, t, g, unknown or other
  misc_feature (273)..(273): n is a, c, g, or t
  modified_base (328)..(328): a, c, t, g, unknown or other
  misc_feature (328)..(328): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacgagctctgacgcctactatgagctgacacagcccaccgtcggtgtcagtcgtacccaggacaggacgcaggactcacctgctcgngacagtctaggacngaaccgtaaagaaactgacgtatttattacgacaacganaacgaccgtacgaccacgggtaccttaggttagtaagtagtataataagtaaaanacgtactagacggacgtaccagtaagtacgaaccttcgagtagacgtactttccgagttacgcacgttacgacggcgaacggtacacggcgtaagtccggttaaggttaactacttagtaaccgaaggtaagtaaccgtaccgttaagacgtaaggacggacggagggtactaaggtaacttacgttaacgacgtaaacggtaaacgttaacgtaagtacgtaacggtaaggttaacggtacgtaaggttacgttaccggggttagttccgggagggttaaccgggggtaactaacggtacgtaaccgtaaccggttaccggtacgttacgaccgtacgtaccgacgtaccccggtaccgtaccgg

SEQ ID NO: 202787 - DNA, 770 bp, Homo sapiens
  misc_feature: GYAE6OF02H7AX0.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttcctccccctcctcactctctgcagaggctctggacgcctctatgagctgacacacgccaccccgttggtcgtcgacggttccgtccccaaggacacggaccgcgaaggactccgaccgttgccttacgtcgcgtagtactcgggactcgaacgtaaaaagtaattacgtcgttactttaagttaccggtaaaccaaaacgaggaaaccgaccggaccgggtaccgccccggttccccgttgttacggtttacggacgttaaagttaaattaaagtaaaaccggaacctaacggttaggaccggtaccggtacccctagaacgtaccggtacccttcggacggtacgtacttctttaccgtgttccgtacctccgtacgtcgtacggtacgggacaagtccgtaacggtttccgtaacggttacgtacgttacgtcggtaacgttacggtaacggtaccgaggacgtagggaacgggacgtacggtcgttaacttacgttaattaccgtagtaaaccgaagtacgtaaggtacgtaagtacgggtaacgttacgttcggtaacggtttaggggttcgggtcgacggggtaccgacggactcggtacggtaccgtacgtcgtacgaccggtaccgacggtccgtccccggtaccgtcccg

SEQ ID NO: 202788 - DNA, 825 bp, Homo sapiens
  misc_feature: GYAE6OF02G09I3.21.46.E02.1.454.CMB.1.raw
  modified_base (304)..(304): a, c, t, g, unknown or other
  misc_feature (304)..(304): n is a, c, g, or t
tcagtcgtcgctcgcacgaccggtgctcgatttagactcatctacagggaaagggggtgggtccaggaggcagaactctgggtgtcgtcaccatggcctggatccctctacttctcccctcctcactctctgcacaggcctctgaggcctcctatcgagctgacacacgcccacccgtggtcgtcagtcgtccccgaaggaccacggaacggccaagggactccgaccctgccttctacgccgagtacgtcggactacgaacctaaaaaggtaactagtacgtactttacgtacggtaaccaanaagaacggaccaggaccgaacggtcccctaggttaccggttagtaccgtaagtaagttaacgtaaaagtaccgtacgttagggaacggtaacggtccctacgtaaggaactaccgtcccgtaggaacggcgtacttccgttacgtcgggtccctactacggtcctacggacgggaacacggacgtaacgtcgtaacgttacggtaactacgtacgtaacggtacgaacggtaccgtagggacgtaacgggaacggtacggaacgggtacgtaccggtaaactttcggttaaccttcgggtaaacctaacgggtttaacgttaacggaacgttaacgggtacgggtaacgttacccgttagggtaaacggttttcggggttaccggttaccggggtaccggggaacggttaacccgggtaaccggttacgggttaaccccgggtaacggtttaccgtaccgggtaaccgtaccgggtaccggtaaccccggttccgggtacccctaccccgggttaccccgg

SEQ ID NO: 202789 - DNA, 538 bp, Homo sapiens
  misc_feature: GYAE6OF02FHOFJ.21.46.E02.1.454.CMB.1.raw
  modified_base (177)..(177): a, c, t, g, unknown or other
  misc_feature (177)..(177): n is a, c, g, or t
  modified_base (355)..(355): a, c, t, g, unknown or other
  misc_feature (355)..(355): n is a, c, g, or t
  modified_base (494)..(494): a, c, t, g, unknown or other
  misc_feature (494)..(494): n is a, c, g, or t
  modified_base (498)..(498): a, c, t, g, unknown or other
  misc_feature (498)..(498): n is a, c, g, or t
  modified_base (500)..(538): a, c, t, g, unknown or other
  misc_feature (500)..(538): n is a, c, g, or t
tcagtcgtcgctcgcacgaccggtgctcgatttagactcatctacagggaaaggggctggtctgggtctcacggattaaaactgacgggactaccacaaactacgcggactccgtgaagggccggttcaccatctccagagacaacgccaagagcacgctctatctgcaaatgaacngtctgagagtcgaggacatggcttgtatattactgtgcaggagaaagggctgggagttggttattacttcgtggggccaaggggaccccttgggtaaccgtcctcctcacgccctccaccgacgggccccagttccggttcccttccccccgtggcccgtcccctgcctccgaggacnccaccgtccgagacgacacgacggccggtccgtcgggcctcggtccgttcgggtaccgaacggtacccttaccgttcccggaaggccggaaccgtacgtgggacggccgggtcgtgggacgaacgggtcgactagtagnacgncnnnnnnnnnnnnnnnnnnnnnnnnnnnnnnnnnnnnnnn

SEQ ID NO: 202790 - DNA, 756 bp, Homo sapiens
  misc_feature: GYAE6OF02JT0FB.21.46.E02.1.454.CMB.1.raw
  modified_base (592)..(592): a, c, t, g, unknown or other
  misc_feature (592)..(592): n is a, c, g, or t
  modified_base (611)..(611): a, c, t, g, unknown or other
  misc_feature (611)..(611): n is a, c, g, or t
  modified_base (694)..(694): a, c, t, g, unknown or other
  misc_feature (694)..(694): n is a, c, g, or t
tcagtcgtcgctcgcacgaccggtgctcgatttagactcatctacagggaaagggggtgggtccaggaggcagaactctgggtgtctcaccatggcctggatccctctacttcctccccctcctcactctctgcacaggctctgacggcctcctatgacgctcgacacgacgcccaccccgttcgggtcgtacacggtccgtccccgaggacacggaccggccaggactccaccgtgccttcctgaccagtagtacggacctacgaaccaaaagtaacttagttcgttactttagttaccggtaaaccaacgaacggtaaccggaccgaccggacccggaccggttccccttaggttaacggtttaagtaagtaactttaaacgtaaagttaaaaccgaactacggtacgggtaaccgtaccggaccctaagaacggtactaccgtaccgtaggaaccgtcgttactttccgtcggtcggtaccttccggactaccggtaccggacggaccgtaacgccggtaaccgtaccgtacgttacgtaactacgtaaccggtagtacggtaccgacgtaaggcgaagggacggacgngtctaacgttacttacgtnaccgtaatagtagaacgtagtacggtagtacgtttagcgtttacgggtaggtcgaccgggtacgaacgtccgaaggttacccncgggttaaccgtcggtaacgtccaccggtaccgtaccggccgttaccccgtcccggtaccgg

SEQ ID NO: 202791 - DNA, 748 bp, Homo sapiens
  misc_feature: GYAE6OF02JW4S0.21.46.E02.1.454.CMB.1.raw
  modified_base (385)..(385): a, c, t, g, unknown or other
  misc_feature (385)..(385): n is a, c, g, or t
  modified_base (614)..(614): a, c, t, g, unknown or other
  misc_feature (614)..(614): n is a, c, g, or t
tcagtcgtcgctcgcacgaccggtgctcgatttagactcatctacaggggaaagggggtgggtccaggaggcagaactctgggtgtctcaccatcggcctggatccctctacttctcccctcctcactctctgcacaggtctctgacggcctctatggacgtctcgactacgacgccctaccgtcgggtacgtctaggtcgtccccgaaggacgacggtacggacgtaacggacttaccgtaccgttcggccttcggtacgccggtaagtaacgtacggggtacctacggaaaccgtaaaaggtaaacgtagtcggttaccttacggttaccggtaaccgaacgacggtacgacgtaccggccgtacggtccgttagtaccggtntacgtaatactaataacggcacgtacgacgtcgaccagacgtacgtctacgtagtacgtcgttactacgtcgtacggtccgcgtacgtcgtacggacggtacgacgtcgtaacgtcgtaacgttacgtacctgtaacgaggtacgtaacggtcgtacgggaacgtaggacggtacggtcggtacgtacttacgtaacgttaagtaaccgtaaccggaagtaacgggtanaacgggtacggttagaccgtacgtacggtggttccggtaggggtaccggacggtacggacgtagtaccggaccggaaccggttacgcgtaccgggtaaccgacggttacccggtacggtccgttaacggtaccg

SEQ ID NO: 202792 - DNA, 725 bp, Homo sapiens
  misc_feature: GYAE6OF02F9LS7.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacacgccaccctcggtgtcagtcgtccccgaggacagacggccaggatcacctgctctgcagactggactgaccaaaagaatagtgtactttagttaggtaaccaaacgagaacgccgacggccacggtcccctggttacgttagtagtaactataagtaaagaccacgtagaggacggcccgtacaagtacgtacgtacccgtaggacgcgtactttaccgtcgtacggtccctaccgtacgcgtacgaacgggtacacgtcgacgttaccgaacgtttcgaacttgtacgaggtacgtaacggtacccgaagggtaccgaacgggtacgggaacggacgggtcgtaagaactttaacgtttaccgtagttaaaccaaacggagttaacgaaccgtaggtaacggtaacgttaaccgttacgaggtttacggggtacgttacggggaccgggaacgggtaaccggaacggttacggtaaccggtaccccggttaccggtaacgggtacccgtaccggtaccccggaacgggtaccccgttcccggtacccccgttacccggg

SEQ ID NO: 202793 - DNA, 1052 bp, Homo sapiens
  misc_feature: GYAE6OF02GU2HJ.21.46.E02.1.454.CMB.1.raw
  modified_base (164)..(164): a, c, t, g, unknown or other
  misc_feature (164)..(164): n is a, c, g, or t
  modified_base (581)..(581): a, c, t, g, unknown or other
  misc_feature (581)..(581): n is a, c, g, or t
tcagtcgtcgctcgcacgaccggtgctcgatttagactcatctacagggaaagggggtgggtccaggaggcagaactctgggtgtctcaccagtggcctggatccctctacttcctccccctcctcactctctgctacgaggctcgtgacggcctcctatgganctagacacacgaccctacccgtcgggtcgtcgacgtccgtaccccgaaggaacgtacggaaccggaccgaacgggtacttacccaccttcgtccgtacgtgaccgagacggtacgtaccgaggtaaacccaaaagtaagtgtaccgttatttaacggttaccggtaaaccaacggaacggtaaccgtacccggaaccgggacccgtaacccggggtccccgtttaagggttggtttaaaacgtacgggttaaattaaacgttaaacggttaaaaacgtaccgtaacggttaacgggaaccggtaacccggtacccccgtaaaggtaaccgggtaaacgttaccccgtttaaccccgggtagggaaaccgttcggttaacccgtttcccgtcggtttacccggttaccgtaaacccgnggtacccggaacgggaacgggtaaacccggtcgtaaaccggtccgttacgggttaaccgtttacggtaaactttaccggggttaaacggtacggttaaccgggtaaccggttaaccgggaacgggtaacccggtaacggggaaacgggtacccgggtaaacggttacccggttaaacccggtttaaacttaaccggttaaccggtaacttttaaaaccggggaaacccgtttaaaaggggttaaacccgggaagtttaaaacggggttaccgggtaaaaccgttttccggttaaggttacggggtttaacggggttaaccggggtaaccggggtaacccgggtaacgggtaacccgttaacgggtaaccccggttacccggttaacccgggtaacccggtttaacgaccccgggtaacggtaccccgggtaaccctaccgggtacccccccggtttaccggttaaccccgg

SEQ ID NO: 202794 - DNA, 727 bp, Homo sapiens
  misc_feature: GYAE6OF02GBRK9.21.46.E02.1.454.CMB.1.raw
  modified_base (699)..(699): a, c, t, g, unknown or other
  misc_feature (699)..(699): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgacgcctcctatgacgctgacacagcccacccgtggtagtcgagtcgtaccccaggacgacgacggccaggactcactgctcgtgacgtagagtggactacgaaccgtaaaataacgttaatcgttacgttagttacggtaaccaacgtaacggaacgacccgaacggaccgtaacccggtcccccgttaggttacgtttaacggtacgtaattaagtaacgttaaaaacggtaccgtaacggtacgggaacggtaccgggtaccccgtacgtaacggaacgtaccttaccccggtgtaccggtacgttaaccgtttccgtccgttacgggtccctaaccgtcggtacccgtacggaacgggtaccgagtaccgaggtaccgtacggttacgtaacctacgtacgtaggtacgaacgtccgaaggtacgaaggtacgacggtaagtcgaacttacgtaattacgtactaactaaacggagtacgaagtaggtaacgtaggtacagttaggtggtacggtcggaggacgtacgaagtccgtagacccgttgacggacncggaccacggccctaccgccgttaccgg

SEQ ID NO: 202795 - DNA, 684 bp, Homo sapiens
  misc_feature: GYAE6OF02G0A6R.21.46.E02.1.454.CMB.1.raw
  modified_base (244)..(244): a, c, t, g, unknown or other
  misc_feature (244)..(244): n is a, c, g, or t
  modified_base (322)..(322): a, c, t, g, unknown or other
  misc_feature (322)..(322): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggactcacctgctctgcagatggactgaccaaaagaaatntgactttagtcggtaccaacaagaacgcaggccacggccctgtgtagtgaatatataaaagccatgaagcggccctanaagagtacctacccgtgacgcgtatttccgcgtaggcctacgacgcgttaccgaaggggaactacgacgaagtaccgtaacggttggaaccttactacgtaagtacgtaacgttaccgaagggacgtaaggaacggacggaacggacttacggtaacttaacgtttaacgtacggttaaccaaaacgtaacgtaaggtaacgtaaacggtaaggtaacgggttaacttaacgttagttaggggttcggttacggggaccgggaacgggtaacccggtaaggtaccgtaacgggtaacccggttaccggtaacggttaccgtaacggacccgtaacggcccgttccggacccccggttaccgg

SEQ ID NO: 202796 - DNA, 825 bp, Homo sapiens
  misc_feature: GYAE6OF02JCHWY.21.46.E02.1.454.CMB.1.raw
tcagtcgtcgctcgcacgaccggtgctcgatttagactcatctacaggggaaagggggtgggtccaggaggcagaactctgggtgtctcaccatggcctggatccctctacttcctccccctcctcactctctcgcacaggctctgacggcctcctatgacgctcgacactacgcccacccgtcggtcgtcagtcgtccccgaggaccagaccggccacggactcctacctcgtccttcgtcgaccgaaggtacgtacggaaccgtcggaaccgaaagaaacgttgtcggtactttaagttacgggtaacctaaacgtaacggtaaccggaccgtaaccggacccgaacccgggttccccgttaggttacggtttaacggtaccgtaagttaacttaaacgttaaaacgactaacgtaggaccggtaacggtcccttaacgacggaacgtaccgtacccgtaggaaccggtccgttactttccgtaccgttcggtccctaccgaccgtaccgtacggaaccgggtacgacggtacctaacggttaccctaacggtttcggaaacctttcggtacgtaacgggttcgtaaaccggtcgacggacgtaacgggacgtacggacggtactagtactttaacttaccgtacgtaacgaactaggttacgaaacgtacgtaacggttaacgacttacggttacggttaacgggtcgggttacgggcggaacgggtaccgtaacggtcggtaaaccgttacccggtacggtaaccggttacgaacccggtacccggtaacggccccgttacccgggttccccgttaccggg

SEQ ID NO: 202797 - DNA, 737 bp, Homo sapiens
  misc_feature: GYAE6OF02JF6XN.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgaccacagccacccgtcggtgtcagtcgtccccaggacagacggccaggatcacctgctctgcagatggactgaccaaaagaaatctgtacttattcggtaaccaagacgaacgaccaggccaccggtccctagtgttaacgtgaacttaataataaacgactacgtggaacggacggcccttacgaaggtaacgtacgtcccttagggacgaaccgttctttacttccggttcggtaccttaccgaacggtccgtacggaagggaccgtacggtccaacggttacctacggttagtaacccgttaatccgtaaggttaacggtaaccgtccggaaagggactaacgggacgaaaccgggtcggtactacgggttaaccttaagtttaccgcggttaaaccaaacgtacggttaacgaaccgttaagggtaacccgggtaagttaccttagtacgggttttacggggttcgttaccgggacgggtaacgggaccgtaacggtacgtaccggtacccggttagttaccgtaaccggaccggttaccggaacgtaccccggttccgacccccgttacggg

SEQ ID NO: 202798 - DNA, 816 bp, Homo sapiens
  misc_feature: GYAE6OF02G0845.21.46.E02.1.454.CMB.1.raw
  modified_base (719)..(719): a, c, t, g, unknown or other
  misc_feature (719)..(719): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacgaggctctggacggcctcctagtgagctagacacacgcccacccgtggtgtaccagtccgtccccgaggaccgacggaccggaccgtaagggactaccgacccgtgccgttccgagaccgtaaggtacgttcgggaaccgttacgaacccgtaaaaaaggtaaattcggttacgtaacttttaggttaaccggtaaccaacgtaacgaacgaccgtacggccgtaccggtccctggttacggttagtacggtaattaacgtaaagtaacgtacgtacgaaggtaaccggaccggtccctagaacggtaccgtaaaccgttctaacgggtacgtaccgttatttccgtaccggtcgtacccttacggacggtaccgttcggaaacgggttaccacggttacgtaacggttcgtaaccgtttacgacgttaacgtgtaaacggttcggaaacgtaccggaaacgggacgtaacggggtaaacgccgggtaaggttaccgtaaacggtacttaagttaccgtaacgtaacgaaacgtaggaacgtacgtaagggaaccgttaagtaccgtagggttcgtttaagggnggttaccggggacggtaacggtacccgaagggttccgtaacgttaccggccggttagaccggtacgcggccccggtacgttcccgttacccgtacgg

SEQ ID NO: 202799 - DNA, 837 bp, Homo sapiens
  misc_feature: GYAE6OF02IMVQM.21.46.E02.1.454.CMB.1.raw
  modified_base (134)..(134): a, c, t, g, unknown or other
  misc_feature (134)..(134): n is a, c, g, or t
  modified_base (240)..(240): a, c, t, g, unknown or other
  misc_feature (240)..(240): n is a, c, g, or t
tcagtcgtcgctcgcacgaccggtgctcgatttagactcatctacagggaaagggggtgggtccaggaggcagaactctgggtgtctcaccatgggccctggacttccctcttacttctcccctctcactctcngcacaggctctgacggtcctcctagtgacgcagaccacacgtcccgaccgtggtcgtacacggtacgtacccgagcgaggacggaccttacggactaccgccggtntccgttcgcgacgataggttacgaccgacgaaacgaaagttacgtacgtctaacggttacgtaaggtaccaaggacccgtaagggaccacgggacctacggtaccgttaggtacgttacgtaaattacgaaattaacgacgtacgacgtacggtacgtaccgcgtaaagtcgtaacccgtccgtcggtaaccgtcgtaacctttcgaccgttaacccgtccggtaccgtaacgtaccggttaccggaaaggtccgtaaacggtaccgttaggtaccccgtttaggaccgttaaacgttccgaacggttacgtaaccgggaacggtacggaccggaactaacggggaaccgtaagggttaccggtaacgttacgttaaaccgttacgttaacgtaaccgtaacggttaacggtaacgtaacggtaacggtaacgttacgggtaacggttccgtagggttcgggttacggtaaccggggtacgtaacgggtaccggtaaccgttagggaacccggtttaaccggtacgggtaaccgtacgggtacccgtaaaccgggttccgtaccgacccccgttcggtaccccgtacgtttacccgg

SEQ ID NO: 202800 - DNA, 604 bp, Homo sapiens
  misc_feature: GYAE6OF02JPHK9.21.46.E02.1.454.CMB.1.raw
  modified_base (242)..(242): a, c, t, g, unknown or other
  misc_feature (242)..(242): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacacgccaccctcggtgtcagtcgtccccaggacagacggccaggatcacctgctctgcagatggactgaccaaagaatncgtcttattgtaaccaacagaacgccaggtaccgacggccccgttgttgttagtcgatataagtaacgacactgacgacgtcctacagacactccgtagacgcgtattctcgtggcctacagcgtcgacgggacacggactagtaccgtacgttacgactacgtacgtaggttacgtaaacggtaccgacgggtacaacggggtacggaccggacggtaccgtagtaaccttagtacgttacgaacgtaaacgagttacgacgtaagttacggagttacctacgtagttcggtcggttggacggacggacgtacggctaggaccgtacgtagacgcgaccgtacgcgtaccgtcccgtacgg

SEQ ID NO: 202801 - DNA, 842 bp, Homo sapiens
  misc_feature: GYAE6OF02ICYW2.21.46.E02.1.454.CMB.1.raw
  modified_base (233)..(233): a, c, t, g, unknown or other
  misc_feature (233)..(233): n is a, c, g, or t
tcagtcgtcgctcgcacgaccggtgctcgatttagactcatctacaggggaaagggggtgggtccgaggaggcagaactcgtgggtgtctcaccatggcctggactccctctacttcctccccctctcactctctgcacgaggctctgacggtcctctatgagctagacacacgcccacccgttggtcgtccgtaggtccgaccccgaaggacaacggacggaccgaaggacnccgtacctcgtcctcgtcggacgaaggtacgtcggaactacggaaaaccgtaaaaagtaatgtcgttaacgttagttaacggtaacaaacgaacgaacgaccgacggaccgaccggtccgttcgttaggtagtagtaataaagtaaaccccccccccgtaaagtaacgtaacgtacggtaacggaccgtaccgtaacgaaggtaacgtaccgtaccggtacggtacgtacgtaccgttccgttaccgtacggtacgtaccgtacgtacggacggaacggaaccgacggtaacgtaccgtacggtaacgttaacgtaacgtaacgtaaccggtaacgggtaacggtacgggtaccggaacggaacgggaacgggaacggtacggtacgttacgtaacgttaacgtaacgtaaacgtaacgaaacgtaacgtaacggtaacgtaacggtaacggtaacgttaacgtacggttagggttacgggttaacgggttacgggtaacgggtacggtaacggtacggtaaccggtaaccggtaccggtaaccggtaaccggtaccggaaccggtaccggaccgttacccggtacccgtacccggttaccgttacccg

SEQ ID NO: 202802 - DNA, 813 bp, Homo sapiens
  misc_feature: GYAE6OF02JZNXY.21.46.E02.1.454.CMB.1.raw
  modified_base (450)..(450): a, c, t, g, unknown or other
  misc_feature (450)..(450): n is a, c, g, or t
tcagtcgtcgctcgcacgaccggtgctcgatttagactcatctacagggaaagggggtgggtccaggaggcagaactctgggtgtctcaccatggcccggatccctctacttcctccccctcctcactctctgcacaggctctgacggcctctatagagctgacacacgaccacccgtcggtgtcagtccgtacccgaggacgacggacggccgaaggcttaccacctcgctccgtgcgagagtggactagaacctaaaagaacgttatcgtacttttacgttacggtaaccaaacaaggacgaccggacggaccgacggtcccgtagttcggttaggtacgtaaattaagaacgtaaagaccgtagacggacggtaaccgtccacgaacggtactaccgttccgaggtaacgtacgttacttccggttacgttccggtccgttaacccngggtaaccgttaccgggaaaccgggtacgtaacgttaccgtaccggttaacgtttaccgggttaactaccggttacggttaaacgttacggggttaacgtaaccgggtaccggaacgggtaccgaaggggttaaccgggacggtacggtaccgttaggttaaccgttaacgttaccgttaacggtaacggtaaacgttaacggtaacgggttaaccggttaaggtaacggttaaaccgttacgttaacgggtttacgggttacgggttacgggtacggggtacgggacgaacggtacggtaccgtacggtaccgtacgtaccggtacgacgacgggtacctcccggaccgttcccgcgtaccg

SEQ ID NO: 202803 - DNA, 912 bp, Homo sapiens
  misc_feature: GYAE6OF02F9RUL.21.46.E02.1.454.CMB.1.raw
  modified_base (107)..(107): a, c, t, g, unknown or other
  misc_feature (107)..(107): n is a, c, g, or t
  modified_base (183)..(183): a, c, t, g, unknown or other
  misc_feature (183)..(183): n is a, c, g, or t
tcagtcgtcgctcgcacgaccggtgctcgatttagactcatctacagggaaagggggtgggtccaggaggcagaactctgggtgtctcaccatggcctggatccctntacttctccccctcctcactctctgcacaggctctgaggcctcctatgacgctagacacacgccctaccctgggtntcagtcgtccccaggacagaccggccaggactcacctgctctgacagagtggactcgaaccaaaagtaaatgtgtactttagttacggtaacccaagacgaaacgccgaacggacccgaccggtcccccttaggtggtttaacgtaggtaataacgttaagtaaacgtaaccaacgttaggaacggtaccgggcccttacgaacggaacgtacgttaccccgtagacggtaccgttaatttccgttacgtcgggtaccttacccgacgtaccgttacggaacgggggaacctaacggggtacctaaacggttaccgtaacggtttaccgtaaacgtttaaccgtaccggtaaggtaaccggtaaacggtaacccggaacggggtaacgtaacggggaaacgggtaccgggaaaggggtaccttagggtttaaaccttacggttttaaccgtaccgtttaaaacggaaaaccgtttacgggtaaaacgtacggttaaaacgggttaacggtaacgggtttaaacccgttacgggttaaacggggttttcggggttaaccggggtttacccgggggacggggtaaaccgggtaaccccgggttaaacgggtacccggttaacccgggtaaaccccgggtttaccgttaaccggggttaaccggtacccgggtaaccccggttaaccgggtacccccgtttacccccgggtaccccggttttaacccccggg

SEQ ID NO: 202804 - DNA, 853 bp, Homo sapiens
  misc_feature: GYAE6OF02HVDLL.21.46.E02.1.454.CMB.1.raw
tcagtcgtcgctcgcacgaccggtgctcgatttagactcatctacagggaaagggggtgggtccaggaggcagaactctgggtgtctcaccatgacctggatccctctacttcctcccccctcctcactctctgcacaggctctggacggcctcctatgagctagacacagcccaccctcggtgtcagtccgtcccaggacagacggccaggactcactgctcgtgacagagtgactacgaaccaaaagtaaatacgtgtactttacgttacgtaaccaaacgtaacggaaccgaccgacggacccgaccggtaccccgtggttagttacgtagtaataagtaagtaaacgactacggtacggaacggtaccggaacccgttacgaacggtacgtaccgtacccgtaggagtaccgttacttccgtacttcggcctccgtaacgcctacggacgggtaacgcgtaccgtagtaccgtaccggttacgtacttacgtacgtaaggttaacgaccggtcggaacggtacgaacgggtaacgggtaaccggtaagggtaccgttacggaaaaccttttaggttaaaccgttacggtaaaaaccgttaaggtaacggtaaccggaaacgttaaacgggtaacgggttaaccgtttaacgttacgggtttaagggttaccggggggtttaacccggggtcggggttaaaccggggtaaccgggaacccggtaaagggtttaccccggttcccgggttaaaacccggttttccggggaacggttaaccgggtaaccccgggtaaccggttaaaccgggtcccccgttttaaccccccggggtaacccccgggtttccgg

SEQ ID NO: 202805 - DNA, 819 bp, Homo sapiens
  misc_feature: GYAE6OF02IJQIY.21.46.E02.1.454.CMB.1.raw
tcagtcgtcgctcgcacgaccggtgctcgatttagactcatctacagggaaagggggtgggtccaggaggcagaactcgtgggtgtctcaccatggcctggatccctctacttcctcccctcctcactctctgcacaggctctgacggcctctagtgagctgacacacgccctacctcggtgtcagtctcccgagacaggaccgcaggactccacctgtctctcgacgagagtcggactcgaaccgaaaagtaactagttacgtactttagttacggtaaaccaagaacggtaacgccgaccggccgtaccggtacccgttggttaggttagtacgaacgtttaaataacgtaaaacgaccgtaagtacgaacgggtaccgtacccgtacgaaggtaccgtacgttacccaggtaacggtacgtttaccttacgttccggtaaccgttccggtaccgtaacggtccgtaaccggtacgggtacccgaagtacccggtacggttaccgttacggttaacgtacgtaacggttcgaacggtacgtaacggtcgtacggactacgggaacgggtcggtcgtaccggtaagttaacccgttagttaaccgtaccggtaaacgaactaaggggtacaaacggttaacggtaacggtaccggtagttaccgggttaagggtttacgggttaccgggggtaaccggccggggttaaaccggtacgtaacccgggttaacccggtcggttaaccccggttaacggaccggtttaacggacccggtacccgtacgggttcccgttaccccgggccccgtttaccgggg

SEQ ID NO: 202806 - DNA, 694 bp, Homo sapiens
  misc_feature: GYAE6OF02F4OK7.21.46.E02.1.454.CMB.1.raw
  modified_base (218)..(218): a, c, t, g, unknown or other
  misc_feature (218)..(218): n is a, c, g, or t
  modified_base (248)..(248): a, c, t, g, unknown or other
  misc_feature (248)..(248): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagccaccctcggtgtcagtcgtccccaaggacagacggccaggatcacctgctcngcagactggactgaccaaagaaatgtcgtnttaagtcggtaaccaacaaggagaccgacgccgacggtccctgttgttacgtgaatagtaactaaagacaacgtaggaaggccggtccctagacgaagtactcccgtagacgtcgtacttctccgtgcctcgacgtacgtcgaagggactcgacgacgtaccgcgttagacttacgtactaaggtacgtaacgtcggaagtacgacggaggaacgggacgtacgtaggtacttaacgttagtacgtaacgtaaacaggttaacgaacgtaagggtaacgtaacgggttaacttaggttaccggtttaggggttacgggtttaccggggacgggtaaccgggtaaccgtaaacgggttccggtaacccgggtaacccggttaaccgttaacggaccgtaaccggtacccggaaccgggtcccgttacccggtaccccccgttccggg

SEQ ID NO: 202807 - DNA, 743 bp, Homo sapiens
  misc_feature: GYAE6OF02G10LV.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctctcactctctgccacgaggctcgtggacggccctctatggacgctagacacctacgccctacccgttcggtagtccgtaggttcggtaccccgaagggaaccacgggtaccggaccctaagggactaccgacctggtccttccgtaggacctaaggacgtacggacctacgaaaccgtaaaaagtaattcgttcggtacttttacgttacggaacccaaagaggaaccgaccgacggacccgacggttcccttggtacgtttaggataaactagtaacgaaacgcctaggtagacggacgtcctagagacgtcctcgagagtactacttcgtgcgtactccgatcccgtagacggtacacgacgtaccggttcgtaacgttacgtaaccgtacgtacgtacggttaacggtaccgtaacggaacggtacgaacgggtaacggacgtacgtacgtaaccgttacgttaactaacgtacgtaacgtaaacgtagtaacgaacgttaaggtacgtacggttaactcggttacggttagggttccggtacggacggggactaccggacggtacgtccgaacgtccggtacgaccgtacggaccgtacgtccgtcccgtccgttaccg

SEQ ID NO: 202808 - DNA, 764 bp, Homo sapiens
  misc_feature: GYAE6OF02JCRA8.21.46.E02.1.454.CMB.1.raw
  modified_base (169)..(169): a, c, t, g, unknown or other
  misc_feature (169)..(169): n is a, c, g, or t
  modified_base (661)..(661): a, c, t, g, unknown or other
  misc_feature (661)..(661): n is a, c, g, or t
tcagtcgtcgctcgcacgaccggtgctcgattttagactcatctacagggaaagggggtgggtccaggaggcagaactctgggtgtctcaccatggcctggatccctctacttctccccctcctcactctctgcacaggctctgacggccttcctatcgagctgacacngcccaccctcggtgtacaggtctcccaggacacggacggccgaggctccacctgcctcgtcgacgtagacgtcggtacctacgaacccgaaaaaggtaaacttattcggtacctttaacgttacggtaacccaaacgtaacgaacgcccgtaacggacccaccgggcccccttaggtacggttacggtagtaacttaagttaaacgtaaacgaccgtacgttaaggaacggtaccggtacccctacgaacggtacgttacctcccgtagtacgacggttaccttccggtcgtacggtccgtaccgtacggtacgtaccggaacgggtacaacggtacgtacgttacgacgtttacgactacgtacgtaggtaacgtacgtaccgaggacgtaagggacggacggtacgtccgtagaaccgtttactacgtacaactaaacgtggtaactaacgaacggttaggtaacggtttactacgtacgggtttacggngggtttaccgggaccggtaacggaccgtaggtacctcgggttaacccgtcgtaacggtcccgacggtaccgtaccggtccgttaccccgtcccggttacccgg

SEQ ID NO: 202809 - DNA, 786 bp, Homo sapiens
  misc_feature: GYAE6OF02GAN3R.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacaggacggccaggatcacctgctctgcagatggactgaaccaaaagtaatatgtacttacgttacggtaaccaaacgagaacgccgaacggacccgacggccccttggttcgttaagtacggtaataagttaaacgtaaaacgaactacgtaggaacggaccggtacccgttacgaaggaacgtaccgttaccccgtaggaacgtaccgttacgtttacccgtcggttaccgggtccttaacccggagttaccgtaccggaacgggtaaccgacggtacgtaacggttaccgtaaccggttacgtaacctaacgttaccgtaaggtaccgtaaacggtccggtaaacgggacggaacgggaaggaaccgggtacgggtactaacggttactttaacgtttacgtaacggtaacctaaaacggttaggtaacgaacgtaaggttaacggtaggttaacctagttacggttacggggttcgggttacgggacgggtaacggaccggtaacgggtaccgttacgggtaacccgttacggtaacggtaccgaaccggtacccggtaaccgtccgttaccccggcccgttacccgg

SEQ ID NO: 202810 - DNA, 719 bp, Homo sapiens
  misc_feature: GYAE6OF02HNPYR.21.46.E02.1.454.CMB.1.raw
  modified_base (134)..(134): a, c, t, g, unknown or other
  misc_feature (134)..(134): n is a, c, g, or t
  modified_base (156)..(156): a, c, t, g, unknown or other
  misc_feature (156)..(156): n is a, c, g, or t
tcagtcgtcgctcgcacgaccggtgctcgatttagactcatctacagggaaagggggtgggtccaggaggcagaactctgggtgtctcaccatggcctggatccctctacttctccccctctcactctctgcanaggctctgacggcctctatganctgacacagcccacccgtggtatcagtcgtacccgaggacaggaccggcaggactccacctgtcctcgtgacgagtagtcggactacgaaccgaaaaagtaaatcttagtacgtttaagttacggtaacctaaacaggaaacgccgtaacggaccgacggcccctaggtagttagtagtaatactaataaacgactacgtagacggacgacctacgacgagtactccgtagtacgacggtaacttcgtcgtcggtacctaccgtacgtctacggaacgggtactacgcgtacgtacgtacgttagtaacctagtacgagttacggaactacgaaggtctaaggacggaggtagtcgtacgtacttaagtacgtagtaaaccaagtacggtaacgacgtaagtaacggtacgtaacttaggtaacgttaggggttacgggtaccgggacgggtaccggtaaaccgtaaggtacccggtaacggtaaccccggttaccgtaacgggttaccaacgggtaaccccgttaagggtaaccccttccccgggtaccccggttaaccggg

SEQ ID NO: 202811 - DNA, 660 bp, Homo sapiens
  misc_feature: GYAE6OF02FRY1F.21.46.E02.1.454.CMB.1.raw
  modified_base (413)..(413): a, c, t, g, unknown or other
  misc_feature (413)..(413): n is a, c, g, or t
  modified_base (470)..(470): a, c, t, g, unknown or other
  misc_feature (470)..(470): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgcagagtgactgaccaaagaaatagtgctttaattggtaaccctaacagaacgccgaaggccaggccccctggtcggttagtgatataataaagacactgaggaggtccctacaagagacgtcccctaggagccgtaatttccgtacgtcgggcctccgacgtctcgagggacagcagttccgacgttcgacttancgtagtagaacgtccgaggacgaggacggacggaggtacctagtaacttattacgtntaacgaaacgtagtaacgaacgtaaggtaggaacggttacctacgttaggttacgggttacgggtttaccgggacgggaacgggtaacccgtaacgggtaccgttacggggaaccccgttaccggttaacgggtaccgtaaccggtaccccggaaacgggtccgttaccccggacccccggtttacccgg

SEQ ID NO: 202812 - DNA, 775 bp, Homo sapiens
  misc_feature: GYAE6OF02GMDMX.21.46.E02.1.454.CMB.1.raw
  modified_base (317)..(317): a, c, t, g, unknown or other
  misc_feature (317)..(317): n is a, c, g, or t
tcagtcgtcgctcgcacgaccggtgctcgatttagactcatctacaggggaaagggggtgggtccaggaggcagaactcgtgggtgtctcaccatcggcctggatccctctacttcctcccctcctcactctctgcacaggctctgacggcctctatgagctgaccacacgcccacccgtcggtgtcagtccgtacccagggaccaggaccgacaaggtctccacctgctcgtgacaagtacgtacggacgtacgaacctaaaaggtaaacttagtacgttacgtttaagttaccggtaaaccaaagaacggaaacnccgtaacggacccgaacggtccccttaggttacgttaggataaacttaagtaaacgtaaacgtaccgaagttaggaacgaaccggtcctaacgagaacgtaccttaccggtaagacggtaccgttacttacgtcgtacggtcctaccgtacgtccgtaggacggtaacgacgtacggtaacgttccgtaacggtacgtaacttactacgaggtaacgtaaccggtaccgaacggtaagacgggaacggacggtaaggcttaacgggaattaaccgtttaagtacgtaaacgaaacgtcggtaaagtaccgtaacgtaaggtaaccgtacgttacgtaacgggtttacggggtaggtaccggggacgggttaaggaaccgtaaggttacccgtacggtacccgttacgtacgggtaccaccggtaaccgtacccgggtctaccccgggtcccgtaccgg

SEQ ID NO: 202813 - DNA, 648 bp, Homo sapiens
  misc_feature: GYAE6OF02FVJM8.21.46.E02.1.454.CMB.1.raw
  modified_base (244)..(244): a, c, t, g, unknown or other
  misc_feature (244)..(244): n is a, c, g, or t
  modified_base (265)..(265): a, c, t, g, unknown or other
  misc_feature (265)..(265): n is a, c, g, or t
  modified_base (272)..(272): a, c, t, g, unknown or other
  misc_feature (272)..(272): n is a, c, g, or t
  modified_base (333)..(333): a, c, t, g, unknown or other
  misc_feature (333)..(333): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggactcacctgctctgcagatggactgaccaaaagaatntgtctttattcggtaaccaanaaggaanccaggtcccacggccccctgtcgttagtgaattataagtaaagacactgaggacgccctanagagactccctgagcgtattcctcgtcggcctccgagtctacgacgggacagccgtagtctacgttcgtactatacgaagtcgaaacgtcgaaggcaagggtacggacggacggtctagtaaccttagttaccgtagttaaccaaacgtaggtaacgaacgtaaggtaaggacggttactacgtaacggtttggggtcgttacgggacgggtacgggaacccgtaagggtaccgtaccggtacccggttaaccgtacgggtaccgaaccggtaccccgtaagggtcccttaccccggtacccccggttacccggg

SEQ ID NO: 202814 - DNA, 774 bp, Homo sapiens
  misc_feature: GYAE6OF02H64FA.21.46.E02.1.454.CMB.1.raw
tcagtcgtcgctcgcacgaccggtgctcgatttagactcatctacagggaaagggggtggtccaggaggcagaactctgggtgtctcaccagtggcctggatcctctacttctcccctctcactctctgcacaggctctgaggcctcctatgagctgacactacgccacccgtggtgtcagtcgtcccaggacacgacggccaggactcacctcgctacgtgaccgtagtagtacggactacgaacctaaaagtaacgtagtgtacctttagtacgaaccaagtagacgtccgacggaccgcggtcccgtagtaggttacgtagacttaagtaataaacggactacgtagagaccggtacctgaacgtaatacctccgtaggacgtaccgttacttaccggtcgtgtaaccctacgttcgacgttaccggaacgtaccgtaacgtcgtacggttaccgtaacgtttacgtaaccgttagtaaccgggaagttttaaaccggaaccggacccgaaagggtaccggaaacgggaacgggtaaccgtaagggaccttacggtaacgtttaaccttaacggacgttaaacgaaaccgttaggtaaacgtaccgttaagggaaccgttaaggtaccttaagtcgggttaagggttaaccgttcggggaacgggtacggtaaacgcggtttaaccggtaccgtaacccgggtttaacttccgggtaactaacccggacccgggttaaaccttcggttaccccccgtaccgggttacccgg

SEQ ID NO: 202815 - DNA, 624 bp, Homo sapiens
  misc_feature: GYAE6OF02H4RVX.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggaccaggaccggccgaggactcacctgctctgcagatggactgaccaaaagaatatgtcttattacggtaccaaacgagaagccgaggaccacggccctgtgttagtgataataataaagacacgtgagacgccctacagagatccctgagcgtattctcgtcgctccacgcgtacgaggtacgacgcgacgtcgtacgttagactatcagtagacgtacgagacgaggacggaacgacggcgtacgtaacgttacttaacgtacgtacgtaaacgaagttaacgacgtaaggtaggaagttaactacgtaaggtttgggttacgggttccggtaccggggacgggtaacccggaacggtacgtaccggtacccgtaccggtttacggtcgtacggaccccgaacggtcgtacccggtccccgttacccggg

SEQ ID NO: 202816 - DNA, 778 bp, Homo sapiens
  misc_feature: GYAE6OF02FS4JB.21.46.E02.1.454.CMB.1.raw
  modified_base (164)..(164): a, c, t, g, unknown or other
  misc_feature (164)..(164): n is a, c, g, or t
  modified_base (180)..(180): a, c, t, g, unknown or other
  misc_feature (180)..(180): n is a, c, g, or t
  modified_base (229)..(229): a, c, t, g, unknown or other
  misc_feature (229)..(229): n is a, c, g, or t
  modified_base (440)..(440): a, c, t, g, unknown or other
  misc_feature (440)..(440): n is a, c, g, or t
tcagtcgtcgctcgcacgaccggtgctcgatttagactcatctacaggggaaagggggtgggtccaggaggcagaactctgggtgtctcaccatggcctggatccctctacttcctccccctcctcactctctgcacagctctgaggcctctatgagctagacncacgcctaccctggtntcagtcgtaccccgaggacaggccgcgaggtactccaccgtgacctcgngaccgagtacgtggactacgaaccgaaaagtaaattacgttacgtactttacgttacggaaacccaagaacggaaacgccgacggacccgtaaccggtccccttgtacggtttaacgtgtaactaaagttaacaaaacggtacgtactagggaacggtacgtccctaacgagtaaccggtccttacccggagtacgtaccgtagtttcccnggttacgtccccgtactacggaccgttacggaacgggtacgacgtaccggtccgttaacggtacgtttacggtaacttaagtacgtaggaacggtaaccgtacggacggtaacggaagggtacgggacggaaggttcgtagtaaccggtttaacttacgtaacgtaccgtaaagtaaggttacgtaaacggtagttaacggtaacggttaccgaagtttaggtacgggttacgggtaccgggacggtaacgggtaccgaaccggtacggtaaccgtaccgttaacggtccggtacgtacccggaccgtacggtccccggttcccgtacccgggtaccg

SEQ ID NO: 202817 - DNA, 845 bp, Homo sapiens
  misc_feature: GYAE6OF02JCYW3.21.46.E02.1.454.CMB.1.raw
  modified_base (184)..(184): a, c, t, g, unknown or other
  misc_feature (184)..(184): n is a, c, g, or t
tcagtcgtcgctcgcacgaccggtgctcgatttagactcatctacagggaaagggggtgggtccaggaggcagaactctgggtgtctcaccatggcctggatccctctacttcctccccctcctcactctctgcacaggctctggaggcctcctatgagctgacacacgccctacccgtcggtntcagtccgtaccccgagggacaggaccgcaggactcacctgctacgtgacgagtacgtacgggcctacgaaccgtaaaagaaattcgtacgttacctttaaggtttaccggtaaacctaaacgaacggtaaccggaccgtaaccgggacccgtacgggtaccccgttaggtttacggtttaaccggtaggttaaactttaacgtaaacggttaaaacggtaaccgtaacggttagggaacgggaccggtacccttaacggaacggtaacgttaccgtcccggtaggaccgttaccgttaacttcccgtaccggttaggtaccccgtaaccgtacggtaccggttacgggtaacgggacctaacggtaccgtacggttaaccggtaacggttacgtaaccgttaacgttaccggtaaacgggtcgtaaacccgggtacgacgggacggtaacggaacgggaacggtacgaccggttacttaccgttaacgttaacgtacgtaaacgaaacgtacgtaacggacggtaagtacggtaacggtacttagggttacggttcgggttacggttacgggacgggtacggtaaccgaggttaccgtaggtaacccgtcggtaacggaccgacgtacccggttacgggccttaccccggtccgtaccgg

SEQ ID NO: 202818 - DNA, 871 bp, Homo sapiens
  misc_feature: GYAE6OF02G3UFT.21.46.E02.1.454.CMB.1.raw
tcagtcgtcgctcgcacgaccggtgctcgatttagactcatctacagggaaagggggtgggtccaggaggcagaactctgggtgtctcacatggcctggatcctctacttctcccctcctcactctctgcacaggctctgaggcctcctatgagctgacacgagccaccctcggtgtcagtcgtcccaggacacgacggccaggatccgacctgctcgtcgacagtagtcgggtactcgaaccgtaaaaaggtaaattacgtacgttacgttaatttacggggtaaacccaaaacgtaggtaaaacgccgaaccgggtacccgaacgggtcccccgttaggttaaggttttaacggttacggaactttaaagttaaaacgtaaaaaccgtaaccgtaacgttcggaaacgaccggggtaccccttaacgtaaacgggaaccgtaacttacccccggtaaggaacggttaccggttaatttcccgtacgtacgggtcctaaacccggtaggaccctttacggggaaacgggttaaccgaaggtccgtaacggtacctaaacgggtttccgtaaccgttaacgtacgtacggttaacggtaacggttaccgaacggtacggaacggtaacggaacggacgggtactacgtaacgtttacttacgtacgtaaccgtaaacgtaacgggtaacgtaagtaacggtaacggtaacggttaacgttacgttacggttaacggggtttcgggtaaccgggtacggggttaaacgggtaacccggtaacggttacggttaccggtaacccggtaccggtttacgggaaccggttaccgaaccgggtaacggtcccgttaccggtcccccgttaaccggg

SEQ ID NO: 202819 - DNA, 825 bp, Homo sapiens
  misc_feature: GYAE6OF02JDH8V.21.46.E02.1.454.CMB.1.raw
  modified_base (181)..(181): a, c, t, g, unknown or other
  misc_feature (181)..(181): n is a, c, g, or t
  modified_base (269)..(269): a, c, t, g, unknown or other
  misc_feature (269)..(269): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacgagctctgacggcctctatgagctgacacacgccctacccgtggtntcgagtccgtacccgaggtaccagaccggccaggtactccaccgtgaccttcgtgaccagtagtcggactcgaacctaaaagtaactntcgtacctttaagttaccggaaacaacgtaacggaacgtaccgacggcccgaccggtaccccttggttacggttagtactaagttaactaaagtaaacgtacctaacgtggaacgtaaccggtccctaagagaacgtacctcccgtaggacgtacgttactttcgtaccgttcgggacccctacgttacggacccgttaccggggaaacggggtaacctaaccgggtacgtaaccgggttttacccgtaagggttttacccgtaaccgtttaacggttaccgtaaacggtaacgtaaccggtccggaaacggtacgggtaaacggtaacggtacggaacgttacgtaacggtaacttaaacgtttctaaacgggtactaacggagtaacgacgtaaggtaacgacgttaacggtacgtagggtttacgggtacgggtaccgggtacgggtaaccggaacggttaccggtaaccgttagggaaccccggttacggttaacccggtaccgtaccggaaccggtaacccggtccccgttaccggacccccggtttcggg

SEQ ID NO: 202820 - DNA, 629 bp, Homo sapiens
  misc_feature: GYAE6OF02JLGET.21.46.E02.1.454.CMB.1.raw
  modified_base (256)..(256): a, c, t, g, unknown or other
  misc_feature (256)..(256): n is a, c, g, or t
  modified_base (354)..(354): a, c, t, g, unknown or other
  misc_feature (354)..(354): n is a, c, g, or t
  modified_base (459)..(459): a, c, t, g, unknown or other
  misc_feature (459)..(459): n is a, c, g, or t
  modified_base (473)..(473): a, c, t, g, unknown or other
  misc_feature (473)..(473): n is a, c, g, or t
  modified_base (500)..(500): a, c, t, g, unknown or other
  misc_feature (500)..(500): n is a, c, g, or t
  modified_base (509)..(509): a, c, t, g, unknown or other
  misc_feature (509)..(509): n is a, c, g, or t
  modified_base (549)..(549): a, c, t, g, unknown or other
  misc_feature (549)..(549): n is a, c, g, or t
tcagtcgtcgctcgcacgaccggtgctcgatttagactcatctacagggaaagggggtgggtccaggaggcagaactctgggtgtctcaccatggcctggatccctctacttcctccccctcctcactctctgcacaggctctgacggccttcctatgagctgacacacgcccacccgtcggtgtcagtcgtccccaggaccacggacggccaaggatcgacctcgctctgcagatcggactggaccaaaagaatnacgtctttacgtaggtacccaaagaagaacgaccgacggtccgacgcccccgttggtgttagtagattataactaaagacacgtagacggacgtaccncgaagagtactacccgtgagtcgtacttgcgttacgcctcgaccgtcgtacgacgggaacgacgcgtataccgacgttacgtaccctatcgagtagacgtaccgnggcaaggaggacgngtagtcgatacgtacgtacaccgaaanagtacgganaggtagtacgtacgtacgttagggtacggttcgtacgggngggtaacggtaacgaggtcgaaccggttacccgccggttaggtacctaccggaccgacggccctacggtcccccgtacgg

SEQ ID NO: 202821 - DNA, 851 bp, Homo sapiens
  misc_feature: GYAE6OF02H9ATX.21.46.E02.1.454.CMB.1.raw
tcagtcgtcgctcgcacgaccggtgctcgatttagactcatctacagggaaagggggtggtccaggaggcagaactctgggtgtctcaccatggcctggactccctctaccttcctccccctcctcactctctgcacaggctctgacggcccttcctatgagctacgacacacgaccctacccgtcggtgtaccacgtccgtaccccaggaccacggaccggccgaaggactccaccgtcgtctacgtcgacgagtacgtcggtaaccgtaccgaactaaaaagtaaattcgtacgttaacgttttacgttaaaccggtaacccaaacgtaaacggaaccgaccgtaaccggaccccgtaccgggtacccccgttggttaacggttacggtataaacgttaactaaaacgttaaaacggacctaacggtaggaccggtaaccggtacccctaagaacggaacgtaaccgttcccgaggtaccgtacgttacttccggtacgtcggtaccttaccgacgtacgtacggacgggtaactacggtaccgtacggtacgttacggttacgacttacgtacgtaagtacgtaaccgtacggtacgaacggtaaggtaacgggacgtacggtaacgttacgtaaacgttacgtttaacgacgtaaaaccgaacggttaaacgtaacgtacgtaagggtacgtaacggtttaccgttaaaggtcgggttaaccggggttggtaccggggacgggtaacgtaccgggacgttacccggtacgggtaaccccggttaacgtaccggtaccgacccggtacccggttaacccgtccgttacccccggcccggtttaaccgg

SEQ ID NO: 202822 - DNA, 744 bp, Homo sapiens
  misc_feature: GYAE6OF02HDTJY.21.46.E02.1.454.CMB.1.raw
  modified_base (263)..(263): a, c, t, g, unknown or other
  misc_feature (263)..(263): n is a, c, g, or t
  modified_base (615)..(615): a, c, t, g, unknown or other
  misc_feature (615)..(615): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacagctctgacgcctcctagtgagctgacacgacgccctaccgtcggtgtcgagtcgtccccgaggacagaccggccaggatccaccgtcgacgtcctgacgagtcgtaggtactacggaacctaaaaanaaagttatcggtaccgtttaagttacgggttaaccaaacggaaggtaacggtaccgaaccggccgtacggtccccgttaggttagttacggtagtaacttagtaaactaaacggtactacgtaggtacggaccgtaccgtaccgaagtacgtacgttacccgtggaacgttcgtaccttaccgtacgtcggtaccctaccggaactcgtacgtacgtacggaactacgtcgtaacgttccgtaacggggtttactaacgttctaccgttaaggtagtaaccggtaacacggggtaacgtaacggacgggtaacggtacgtacgtacgtaaccgttattaaccgtacgttaanaaccggtaagtaacgaacgttaggtaacggttaagacgttacggttaggtacgggttggtacgggaacgcgggtaactacggcgttaacgccgtacgtagacctcgtaccggacgtccgtccgtacccg

SEQ ID NO: 202823 - DNA, 791 bp, Homo sapiens
  misc_feature: GYAE6OF02I4OQU.21.46.E02.1.454.CMB.1.raw
tcagtcgtcgctcgcacgaccggtgctcgatttagactcatctacagggaaagggggtgggtccaggaggcagaactctgggtgtctcaccatggcctggactccctctacttcctcccctcctcactctctgacacgacggcttcgtacggacggtccctcctagtcgagctacgaccacgaacgccctacccgttacgtgtacgtacgtccgtacccgaggaccacggtaccggaccgtaggtaacttccgaccgtcgtacctcgtcgaccgagtacgtacgggacctacgaacccgaaaagtaaacttagttaccgtacgttttaacttaccggaacaacgaagtaacgaccgagtcccgacgtccgtgttagttcgtagtatataacgaagtactacgtggaacgacgccctagaacggactaccgttaccgtaggacgtccgttagttcccgtagtcggtacccctaaccgtaggttcccgaacgggtaaacggccgtaaggtaccgttacgttaaccgttacggttaccggtaaccttacgttacggtaagtaggtacctaccgggaacggtacgaagggtacgaaccgggttcgaacgttacgtacttaacgttacgttaaccaacgtaaaagtgtaaccgaaggtaacgggtactaacggttccgtaagttacgggtttaggacgttagggacggtaccgaacgttacgaaccgttaccgaccggttcgaaaccggtctaacccggccggtaacgtcccggtaacccccgttccggaacccgg

SEQ ID NO: 202824 - DNA, 853 bp, Homo sapiens
  misc_feature: GYAE6OF02F70LF.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacaggacggccaggacctacctacgtcgtcctcgtcgacgacgtagtacggtacgtccgaaaccgtaaaaagtaaattagtacggttactttaacggttaccggtaaacccaaagaacggtaaccgaccggaccggaacccggacccggttcccgttaggtttaggtttacggaagttaagttaacgtaaaagttaaacgaacctacggtaaggaacgggtaacccgtacccgtaacggaaggtaccggtacccgttacccggtaggaaccgtacggtttactttaccgtccgttcggtaccctacggacggtcccgtacgggaaccggtacgacgtaccgtacgttaccgtacggtaccttaacgtactaggtaagtacggtaacccgtcggaagtacggaggggtaaaccggcgggtaaccggttagtacgtttaaaccttacgggttaaccgtagtaaaacccgtaaagttaggggaacctaaggtaaagggttaacccgggttaacttaccgttaacgggttgggtttacgggggtcggtacccggggagggtaacccggtaacgtggtacccgttaaccgggtaccgttaccggttacggaacctccccgggtaaaaccgtcggtacccgtttcccccggggacccctttcggg

SEQ ID NO: 202825 - DNA, 734 bp, Homo sapiens
  misc_feature: GYAE6OF02JYYES.21.46.E02.1.454.CMB.1.raw
  modified_base (164)..(164): a, c, t, g, unknown or other
  misc_feature (164)..(164): n is a, c, g, or t
  modified_base (264)..(264): a, c, t, g, unknown or other
  misc_feature (264)..(264): n is a, c, g, or t
  modified_base (599)..(599): a, c, t, g, unknown or other
  misc_feature (599)..(599): n is a, c, g, or t
  modified_base (715)..(715): a, c, t, g, unknown or other
  misc_feature (715)..(715): n is a, c, g, or t
tcagtcgtcgctcgcacgaccggtgctcgatttagactcatctacagggaaaggggtggtccaggaggcagaactctgggtgtctcaccatggcctggatccctctacttctccccctcctcactctctgcacaggctctgacgtcctctatgagctagacacncgacccacccgtggtagtcacgtcgtcccgaggacaggccgcaggtatcactgctatgacagctggctgaaccaaagaatgtgtactagttacggtacanaagtacgccacggaccgtacggtccccgtggttagtacgtacgtaagttaagtaagtaaacgtaaccacgtagaccggacgttacccgacgtaacgtaacggaccttacccggtagtaaccgcgtacccgtttacttacccggttcgggacccttacccgtaacggaccgttacgaaacgggaccggtaacgtaaccgtaaacgttcgtttaaaccggttacgaaccttaacgtccgtaagtttaacggaaccgttaaacggacggaaccgggtaacgggaacggaacggttacgtacgtaacgttacgttaacgtaccgtagtaacgtaaacgngttaagaacgtaggtaacgttagggtattcggtagttacgggttcgacgggacggtaacggacgaacggtacgttgggtaaccccttaggaccggtacgtaccgaccggttaccgngtaccccggtccgtacccg

SEQ ID NO: 202826 - DNA, 873 bp, Homo sapiens
  misc_feature: GYAE6OF02FHDUH.21.46.E02.1.454.CMB.1.raw
  modified_base (249)..(249): a, c, t, g, unknown or other
  misc_feature (249)..(249): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggcagacgcgaggactcacctgcctactgacgagataggactgaccaaaagaaattagngtacttattcggaacctaagacgaacgcgaacggccacggacccccttggtacggttagacgtaaacgttataaactaaaacggtaacctacgtacgggaacggtaaccgggtaccccctaacgtaacgggaaccggtaaccgtttacccccggttaaggaaccggttaacccgggtaacttttaccggttaccggaccggttacccgtttaacccggacggtacccgttaaccggggaaacgggtaaccgtaccggttaacccggtaccgttaaccgggtacgtttaacggaaccgttaactaacgggtaacgttaacgggtaacccgttacggaacggggacggtaaacggggtaacgggaacgggtaacggtaccgttaacggtttaaccgtttaacgtttaacccggtaacgttaaaacccggtaaacggtaaacgttaaccggtaacgtaaacggggttaaacgggttaaccgtttaaacgtacggtttaacggtttaggggtttacccggtacggggtaaccggacgggtaacccgtaagccggttaacccggtacccgttacggtaaccggtaccggaacggtacccgtaaccggccgttcccgtacccggttaccg

SEQ ID NO: 202827 - DNA, 844 bp, Homo sapiens
  misc_feature: GYAE6OF02IZJSU.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacacgcccaccctcggtgtcagtcgtccccgaggacacggaccggccaggactccaccgtgctcgtgccagacgtacggactacgaaccaaaaggtaaatatcggtactttagttacggtaaccaactaggaaccgccgacggaccgaaccggccccgttgttacggtttacgtagtaacttaagtaaagtaaaacgaccgttaccggtaggtaacgggtacccgggtcccctaaccgaagggaacttaacccgttaccccgttaggaacgtaccgttaacgttttcccgtcgttccgggtacccacccggtacgtaacccgttacgggaaacgggaccaacggtaccggtacggttacccgtacggttaaccggtaaccgttaacgttacgtaacgggttaacggtaaaccggtacccgttagggaaccggttaaacgggccgggtaaaccgggtaacgggtacttaacggttaacctttacgtttaaccgtaacggttaaacccgtaaaggtaacgtaaccggtaaacgttaaggggtaaacggttaccgttaacgttaggttaaacggttcggggttacgtacgggtaccgggtaagtacccggacggtaccggtacgtaccggtacgtacggtaccgaccggtacccggacggtaccctacccggttacccgtaccgg

SEQ ID NO: 202828 - DNA, 890 bp, Homo sapiens
  misc_feature: GYAE6OF02ILQIY.21.46.E02.1.454.CMB.1.raw
tcagtcgtcgctcgcacgaccggtgctcgatttagactcatctacagggaaagggggtgggtccaggaggcagaactctgggtgtctcaccatggcctggatcctctacttctcccctcctcactctctgcacaggctctgacggcctcctatgagctgacacagccacccgtcggtgtcagtcgtccccgaggacaggaccggccaggactccgactgctctgacagagtcggactcgaaccaaaagaattatgtacttaattacggtaaccaacgaggaacgaccgtacggacccgaccggtacccccgttaggttacggttaagttacgtaagttaacgttaaaacgttaaaacggaccgtacgttaaggacggttaacggttacccctagaacggtacgtaccgtacccgtaaggtacgtaccggttacttccttacgtacggtcccgtaccacggtaccgtacggtaacgggaactacggaccgtacgtaccgttacgttacgtaacttacgtacgtacggttaaacgggaccgttaccggaacgggacgtaaacgggaaaccgggtaaccgggtacggttacgttaaaccggttaacgttaaacgtttaacccgttaacggtaaaccgtaaaacgttaaccggttaaaggtaccgttaaacgggttaacgggttaaaccggtttacgtttaacgtttaaacggggtttttacgggggttaaccgggttttacgggggtacggtaaaccggggtaacccggttaaccgggtaacccggttaccggggtaaaccccgttttacggtaaccgggttaacccggaccggtaaccccgggttaacccgggaaccctttaccccccgggttaccccgtttaaccccgggg

SEQ ID NO: 202829 - DNA, 754 bp, Homo sapiens
  misc_feature: GYAE6OF02GUKA2.21.46.E02.1.454.CMB.1.raw
  modified_base (225)..(225): a, c, t, g, unknown or other
  misc_feature (225)..(225): n is a, c, g, or t
  modified_base (298)..(298): a, c, t, g, unknown or other
  misc_feature (298)..(298): n is a, c, g, or t
tcagtcgtcgctcgcacgaccggtgctcgatttagactcatctacagggaaagggggtgggtccaggaggcagaactctgggtgtcctcaccatggcctggatccctctacttctcccctcctcactctctgcacgaggctctggacggcctcctagtgagctgacacagcccaccctcggtgtcagtctccccgaggacagacgcctaggactcacctgcttcncgcagagtcggactacgaaccgaaaagaaattagtacggtactttaagttaccggtaaccaaacgaggaaacnccggaacggcccgtaaccgggtcccccttaggttaggttttagtaggtaattaaagttaacgttaaaaaggacctacgtagggtaacggtaccggtaccccgagtaacggtaacgcccgttaccccgtagtaccggtaccgtaacttttcccgtcgtaccgggtcccttacccgacggtccgtacggaacgggtaacaccggacgtacgtaccgtacggtttacacgttaccgtgtaacgtaggtaaccgtacgtacggacgtaagggaacggacgggaacggtcgttacggtaacttaagttaccgtacgtaaacgaaacgtggtaacggaagttaaggaacgttacggtaacttaacggttggttaacgggtggttaccgggcgggaacgtaccgggtagccgtacgaccgttacgacgttccgacgaccgtacggcttcccggtacccgtcgg

SEQ ID NO: 202830 - DNA, 694 bp, Homo sapiens
  misc_feature: GYAE6OF02IDP5E.21.46.E02.1.454.CMB.1.raw
  modified_base (80)..(80): a, c, t, g, unknown or other
  misc_feature (80)..(80): n is a, c, g, or t
  modified_base (237)..(237): a, c, t, g, unknown or other
  misc_feature (237)..(237): n is a, c, g, or t
tcagtcgtcgctcgcacgaccggtgctcgatttagactcatctacaggggaaagggagtgggtccaggaggcagaactcngggtgtctcaccatggcctggactccctctacttctccccctctcactctctgcacaggctctagacggcctcctatgagctgacacgacgcccaccgtggtctcacgtccgtaccccgaggaccacggaccggccgaggactccacctggcctcgnggactagaggtacgactacggaacgaaaagtatagtgtacgttatacggtaccaagagacgaccgacggccgacgcctaggtcgtagtagtataagtaacgtaacgtaacacgagacggtcgacctagagtaacgacttcgacgacggtacgtagttcgtcggtcgcgtacgtacggaccgtacggaggacacgtgtacgtacgtcgtaagtactacgtacgtaagtacggacgtacggtacggaacggaggtaacggaccggaagtcgtaacgacctttacgtaacgtaacgtaacgttaaacgtaacggtacgtaacgtagggtaacgtagtaacgtacgttagggttacggttccgggtaagggaccgggaacgtacggaacggtacggtaccggtaaccgttacggtaccgacggttaaccggaccgaccgggttaccccgtcccgtacccgg

SEQ ID NO: 202831 - DNA, 750 bp, Homo sapiens
  misc_feature: GYAE6OF02GZTB4.21.46.E02.1.454.CMB.1.raw
  modified_base (465)..(465): a, c, t, g, unknown or other
  misc_feature (465)..(465): n is a, c, g, or t
tcagtcgtcgctcgcacgaccggtgctcgatttagactcatctacagggaaagggggtgggtccaggaggcagaactctgggtgtctcaccatggcctggatccctctacttctccccctctcactctctgcacaggctctgaggcctcctatgagctgacacacgcccacccgtggtgtcagtccgtaccccaggaccacggaccggccaggactccacctgctctgcagtactggactcgaaccaaaagtaatagtcgtacgtttaacgtttacggtaacctaaacgaacggaacgacccgacggacccgtaccggtaccccgttggttacggttaacgtacggtaattaattaaaacgtaaacgaacgtaacgtaggaacggtaccgtacccgtataacgacgtaaccgtcccgtagacgaccgttacttcgtcgtacgcctcgacgtcgtacgacggtacncggtactacgtacgtacgtacgtactacgtacggtaacgtacggtaacgtcggtaacgacggaacggtaaccgggagtaccggttaccgtaaggtaactttaacttacggtactaaacgtaaacgacgttaacgaagtaacggttaaggaacgttacttacggttacggtttagggtacggttacggggttacggggaacggtaaccgtaacggtccggtaccgggtaaccttaccggtaggaccgtacggaccgtaccgtccggtaccccggtcgttacccggg

SEQ ID NO: 202832 - DNA, 874 bp, Homo sapiens
  misc_feature: GYAE6OF02I4ETH.21.46.E02.1.454.CMB.1.raw
  modified_base (136)..(136): a, c, t, g, unknown or other
  misc_feature (136)..(136): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacnggctctgacggcctcctatgagctgacacacgccacccgtggtgttcaggttcgtaccccgaggacgtacggacggccagggactccaccgtgcttctcgcagatcggactacgaacctaaaagaaattatcggacttttaacgttcggtaaccaaagagaacgacccgaacggccccgaaccggtcccccgttagggttaggtttaagtacggttaaagtaacttaaagtaaaacggacgtacgttaggaacgggtacccgtcccgtagaacggtacgacgttaccccagggacgtaccggttacttccgtccgttcgggtaccccttaccgtcgtacggtaaccggacgggaacgtacccgtacgtaccggtacgttaaccggtttacggtaacctacgttacggtagtaacggtaaccggttaccgagggtaaccgaagggtaaccgggacggtacgggtaacttaggtaaccgttttagttaacccgtagtaaacccgtaaacggtaaggttaaaccgaaaccggtaaggttaaaccgggtacggtttaaccgtaacgggtttacggtttacgggggtttaccggggtaacggggtacccgggttaaacgggaaccccggttaaggttacccgggttaacggttacccggttaaccgggtaccggttaccgtaaccccgggtaccggtaacccgggtttaccccggtcccccggggttacccccggttaccggg

SEQ ID NO: 202833 - DNA, 859 bp, Homo sapiens
  misc_feature: GYAE6OF02H2KHY.21.46.E02.1.454.CMB.1.raw
  modified_base (183)..(183): a, c, t, g, unknown or other
  misc_feature (183)..(183): n is a, c, g, or t
tcagtcgtcgctcgcacgaccggtgctcgatttagactcatctacagggaaagggggtgggtccaggaggcagaactctgggtgtctcaccatggcctggatccctctacttcctccccctcctcactctctgcacaggctctgacgcctctatgagctagacactacgcccacccgtcggtntcagtcgtccccgaggacacggaccggccaaggtactccaccgttgcctcgtcgactagagtcgggacctacggaaccaaaaaggtaaattacgtacgttacttttaacgttaacggttaacccgaaaacgaacggaaaccggtacccgaaccgggacccgtaaccgggtcccccgttagggtttacggtttaacggttaagtaaactttaacgttaaacgtaaaaacggtaccgtaaccggttaggaacggtaacccggtacccctaacgacggtaaacgttaccgttccccggtaggaaccggtacgttaacgtttccgttaccgttcggtacctaccgacgttaccgtacggaacgggaactacggaccgtaacgtaccgtacgtttacgaacgttacgtacggtaacggtaacgtaccgtacgggaacgtaacggacggtaaccgggtaaggacggtccgttaacgtaaccgtttaacgttagtaaccgtaacctaaaggtaacgaacgttaccgtaagttaaccgggacgtttaacctacggttaaggttcgggttacgggttcgggacgggtaaccggtacggtaacgttaccgttcgggtaacccgttaggtaaccggttcggaaccggtacccggtaacggtcccgttaccccggcccggttaaccgg

SEQ ID NO: 202834 - DNA, 907 bp, Homo sapiens
  misc_feature: GYAE6OF02F5NLO.21.46.E02.1.454.CMB.1.raw
  modified_base (178)..(178): a, c, t, g, unknown or other
  misc_feature (178)..(178): n is a, c, g, or t
  modified_base (221)..(221): a, c, t, g, unknown or other
  misc_feature (221)..(221): n is a, c, g, or t
  modified_base (226)..(226): a, c, t, g, unknown or other
  misc_feature (226)..(226): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctggtntcagtcgtccccgaggacagaccggccaggatcacctgctcgngcagngtgactcgaacaaaagaatagtcgtactttagttacggtaaaccaaacgaaggaaacgacccgacgggaccccgaaccgggtccccccgtttgggttacgtttaacggttagtaaacgtttaaacgttaaacgttaaaaacggaaccgtaacgtaaggaacggtaaccgggtccccctagtaaacggtaacgtacctttacccgaggtaaccggacggttaacctttccgttccgttaccgggtccctacccgtacggtaccgtaaccgggaacggggtaaccgtacgaacgtaacggtttacccggtaacggttttaccgtaaactttaacgtaaccggttaacggttaaacgggtaaacccgttaccgggaaagggtacccgggaaagggaacggggaacccgggtaacgggtttacgtaaccggtttaaacccgtttaaacgtttaacccgttaacgtaaaaccggtaaacgtaaaggtaacggtaacggtaaagggttaacggttaaccgttacgtacgtttaagggttaccggggtttacggttacgggggtaccgggtaaccggtaaccggtaacgtaccggtttaaccggtaacccggttacgttaacccgggttacgaacccgggtaaccccggaacgggttccccgttaccccggtaccccccggttaccgg

SEQ ID NO: 202835 - DNA, 785 bp, Homo sapiens
  misc_feature: GYAE6OF02FL88E.21.46.E02.1.454.CMB.1.raw
  modified_base (180)..(180): a, c, t, g, unknown or other
  misc_feature (180)..(180): n is a, c, g, or t
  modified_base (225)..(225): a, c, t, g, unknown or other
  misc_feature (225)..(225): n is a, c, g, or t
  modified_base (249)..(249): a, c, t, g, unknown or other
  misc_feature (249)..(249): n is a, c, g, or t
  modified_base (253)..(253): a, c, t, g, unknown or other
  misc_feature (253)..(253): n is a, c, g, or t
tcagtcgtcgctcgcacgaccggtgctcgatttagactcatctacagggaaagggggtgggtccaggaggcagaactctgggtgtctcaccatggcctggatccctctacttctcccccctctcactctctagcacaggctctgagtcctctatgagctgacacagcccacccgttggtntcagtccgtccccgaggtacacggacgccaggaactcacctgctntgcagatcggactcaccgtaaaanaatncgtctttatcggaaccaatacgacgaccgacggcctacggtcccctggttagttacgtagattaagtaactaaacgactacgtacggaacggtaccggtcctacgacgtactaaccgtcccgtggtacgacgtactttccgtacgtcgtcctccgtagtccacgacgggtacacggaccgtacgtacctggttacgtaacttacgtacgtaggtaacgtaacggaccgtacggtacgaagggtaacgggtaccggtaccggtacgttacggtaaccggttttacgtaaccgtttaacggtaaacccgtaacgggttaaacacgggtaacccggtaaacgggttaacgttaacgggtaaaccgtttcggtttaaaccggggtttaccgggtttagggacccccggggttaggggaaaccggtaccgggtaaaccgggtcctttaacccgggggtaaccctttacccgggacgggttaacccttaccggaccccggtaaccctccccgggtaaccccgtcccccggtttaaccg

SEQ ID NO: 202836 - DNA, 788 bp, Homo sapiens
  misc_feature: GYAE6OF02G7F4N.21.46.E02.1.454.CMB.1.raw
  modified_base (132)..(132): a, c, t, g, unknown or other
  misc_feature (132)..(132): n is a, c, g, or t
  modified_base (506)..(506): a, c, t, g, unknown or other
  misc_feature (506)..(506): n is a, c, g, or t
  modified_base (711)..(711): a, c, t, g, unknown or other
  misc_feature (711)..(711): n is a, c, g, or t
  modified_base (765)..(765): a, c, t, g, unknown or other
  misc_feature (765)..(765): n is a, c, g, or t
tcagtcgtcgctcgcacgaccggtgctcgatttagactcatctacagggaaagggggtgggtccaggaggcagaactctgggtgtctcaccatggcctggatccctctacttcctccccctcctcactctcngcacgaggctctggacggcccttcctatgagcctagacacacgtcccacccgtcggtgtcacgttccgacccccgaggaccacggaccggaccgaaggactcccgaaccgtcggtccttcgtagtaccgaagtacgtcgggtacctacggaaaacctaaaaaggtaaaattagtacgttactttaacggtttaacggaaccctaaaacggaggaaacggccgaacggacccgtacccggtccccgttaggttaggtttaagtacgtaagtaaagttaaaacgtaaaacgaccgtaagtacggaaacgccgtacccgaagtaagagtaccttacccggagacgtacgttacttccgtacggtcgtccgtaaccgngtaccctagggaaccgtacacggttccaacggttcaccgggttaactacgtacgtcggtaaacgtacgagttaacccgagggacgtaagggacggtacgtaggtacgttacgtaagttaccgttaacctagtaaaccgaaaagtaggtacaaacgtaggttaacgtaacgttccggtagtttaggttacggggtcgaaccggggnggtaaaccggtacgaaggttccgaacggtccgtaacgttcgggactaccggacnccgggtactcccggcccgttacg

SEQ ID NO: 202837 - DNA, 813 bp, Homo sapiens
  misc_feature: GYAE6OF02GBZHY.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctcccccctcctcactctctgcacaggctctgaggcctcctatgagctgacacagcccaccctcggtgtccagtcgtccccaggacagaccggccaggactccacctgcctcgtgcgagagtggactcgaacccgaaaagtaaactagtagtcttttaacgttacggtaacccaacgtaacggaaccgacccgaacgggacccctaccgggtacccccgttaggttaccggtttaaggtacggtaattaacgttaaagtaaaacgaaccgttaacggtaaggaacggtaaccggtccccgtaacgaacggtaccgtacctaccccggtaggtaaccgaccgttacgtttcctccggttacgggtcccttacccgacgtacccgacggaaacgggtaccacgggaaccctacggttaacctaccgggtttacgaccctttagaccttaagggtaacccggtaaccggtaccggtaacgaccgggtaaagggaccggaacggtaggttaccgtaccgttaaacttacgtttaaccgtagtaaccgaaacgtaggaacgtaacgtaggtaacggtaacgtacgttcgtaagggttttcgggtccgggttacgggacgggtacggaaccgtagggtccctaacggtacccgttacgtacgttaccggaccgacccggtacggtcccgtaccgttccccggtaccg

SEQ ID NO: 202838 - DNA, 718 bp, Homo sapiens
  misc_feature: GYAE6OF02JGIJ6.21.46.E02.1.454.CMB.1.raw
  modified_base (387)..(387): a, c, t, g, unknown or other
  misc_feature (387)..(387): n is a, c, g, or t
tcagtcgtcgctcgcacgaccggtgctcgatttagactcatctacagggaaaggggtgggtccaggaggtcagaactctgggtgtctcaccatggcctggactccctctacttctcccctctcactctctgcacagctctggacgcctactatgagcctgacacagcccacctggtcgtcagttcgtacccaggacacggaccggcgaaggtctcaaccgttgcctctcggacaggtatacgggactacggaccaaaaggtactacgtcgtaactttagttacgaaccaagagtaacgcctaggacaccggtcctagttcgtagttacgattactaaataaacggctacgtgaacgaccggcctacgaagtaacgtctacccgtggntaccgttagttccctagttcggacctcaacgccgtaggacggacaccggtctaaggtccgttaacggttctaacgttaccgtcgtaaggtacggtaacggtaccgacgggtacgaaagggtacggaacggtacccggtgtaacgttaccgttagttaacctgtaaacccgtagtaacggtaatacgtaacggtaagtcgttaaccgtcggttaggttcgggtaacggtccggtagggtaaaccggacggtaagtaccggtaccgttaccgggttaacctacgggttaccgacccggtacgaaccgggttccgaccccggtttccccgtacg

SEQ ID NO: 202839 - DNA, 717 bp, Homo sapiens
  misc_feature: GYAE6OF02FT11P.21.46.E02.1.454.CMB.1.raw
  modified_base (221)..(222): a, c, t, g, unknown or other
  misc_feature (221)..(222): n is a, c, g, or t
  modified_base (586)..(586): a, c, t, g, unknown or other
  misc_feature (586)..(586): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctatgagctgacacagcccaccctggtgtcagtcgtccccaggacagacgccaggactcactgctctgcagnnggactgaaccgaaaagtaaatagtcgtactttacgttacggtaaccaaacgaggaacgccgaacggcccgtaacgggccccttggttcggttagtacgtaattaattaagaaacggactaacgtaggacggaccgggtcccctagacgtaacggtaccttcccggtagaccggtcgttaacgtttccgtaccgtcggtaccctccgaacgtccgtacgaacggggtaaccaggtacctaacggttcgaacggttacggtactagtaccgtaagggtacgtaacgggtaccgacggtacgaagggtaacgggaccggtaggcgtacggtaatacgttcgtaactaaccgaaagacgttaaacggntaaaccggtaaggacgtttaactaggttacgtttggggtacggtttcggggtacgggacggaccgagtcccggtacgtacccggttacgtcgttcgaccggaccgacggtccctaccccggcccttaccgg

SEQ ID NO: 202840 - DNA, 870 bp, Homo sapiens
  misc_feature: GYAE6OF02IY5CR.21.46.E02.1.454.CMB.1.raw
  modified_base (186)..(186): a, c, t, g, unknown or other
  misc_feature (186)..(186): n is a, c, g, or t
  modified_base (234)..(234): a, c, t, g, unknown or other
  misc_feature (234)..(234): n is a, c, g, or t
  modified_base (679)..(679): a, c, t, g, unknown or other
  misc_feature (679)..(679): n is a, c, g, or t
tcagtcgtcgctcgcacgaccggtgctcgatttagactcatctacagggaaagggggtgggtccaggaggcagaactctgggtgtctcaccatggcctggatccctctacttctcccccctcctcacttctctgcacaggctctgacggcctcctagtgagctagacacacgccctacccgtggtntcagtccgtccccaggacgacgaccggccaggactccaccgtgcctcngacagtagtacggactacgaaccaaaagaacttgtacgtactttaacgttacggtaaacccaagaacggaaccgaccgaacggaccccgaccggtaccccgttaggttaggttagtacgtaaacttaacgttaaacgtaaaacggtacctaacgacgggtaacgtaccggtaccctaagaacggtaacgtaccttacccggggtaagaccggttacccgttactttacccgtacggttaccgggacctttacccggaagttacccgttaacgggaaccgggtacgtaaccgtccggttaaacggttacccgggtttaacgttacgttaaccgtttaacgttacgtaacgggtttaaccgtaaccgtacggtaacgggaaccgtaacggggaaccggacgggtaaccgggttcttaacggttaaacccgtttattaacccggtaanaaccgtaaacggtaagttaaccgaacggtaagtaacgttaacggtaccttaagggttaccgggtttagggtacggttaccggggtaccgggtaacggtaaccgtcggtaacccgtccgggttaaccgacggttaacggacccggtaacgaaccccggtttaggaaccccgttccccggtacccgtaaccgg

SEQ ID NO: 202841 - DNA, 703 bp, Homo sapiens
  misc_feature: GYAE6OF02IPSF2.21.46.E02.1.454.CMB.1.raw
  modified_base (298)..(298): a, c, t, g, unknown or other
  misc_feature (298)..(298): n is a, c, g, or t
  modified_base (580)..(580): a, c, t, g, unknown or other
  misc_feature (580)..(580): n is a, c, g, or t
tcagtcgtcgctcgcacgaccggtgctcgatttagactcatctacagggaaagggggtgggtccaggaggcagaactctgggtgtctcaccatgcctggactccctctacttcctcccccctctactactctctcgaccaacgtaggctacgagacggtccttctatcgacgtcgtacgacacacgccctacgtcggtcgtcacggttcccgtccgaaggacacggtccggcaacgtcaccgtactcgcgttaccgacgacacggagtggtaaccgaacgtaaaccgaaaaggtaacnttcggttaacgttacgtaacgaactaacgacgtacgaccgaccggaccgtaccggttccgtagtagttaacgtaggttaactagtaaacacggtaactcggcaaggtcccgtacgaagtaacgggctaccgtacgtcgggacttacgtaccttcgttacggccgtaccttacggacgtccggtacggcgtaaccgggcaacggtccgtatttacccgaatacgctacgtaaggtactcgtacgagtaccggaggacgacgtcgtggtacttagttaacgttntacgacgaacgtagaacgtacgagtactacgtagttcgtaggtggtacggtacggacggacgacgcgtacggtaccgtacgttacgcgtaccgccgtaaccgccggtacgtacccgtcgtccg

SEQ ID NO: 202842 - DNA, 678 bp, Homo sapiens
  misc_feature: GYAE6OF02F36RJ.21.46.E02.1.454.CMB.1.raw
  modified_base (217)..(217): a, c, t, g, unknown or other
  misc_feature (217)..(217): n is a, c, g, or t
  modified_base (242)..(242): a, c, t, g, unknown or other
  misc_feature (242)..(242): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgagcctcctatgagctgacacagcccacctcggtgtcagtgtccccaggacagacggccaggactcacctgactcngcagatggactgaccaaagaaactntgcttataggtaccaacaagaacgccagccgaggcccctgtagttagtgatatagtaaagacactgaagacggccctagaagacgtactcccgtaggacgtcggtaattccgttacgttcgggtacctaccgagtaccttcgaaacggggtacacggtacctaagttccgaacgtttagaacttaacgtacgaaggttacgaacgttacccgaggtacgaagggaacggaacggtagggacctaggttaacttaacgttaacttacggtaaccaaacgtaacggtagaacggtaagttaacgggtagtaacctacttaggtttacgggtagttaccggggacggtacgggaaccgtaaggtccgtaccggtaccgttacccgttaggttaccaaccgggtacccgaacggttccgtacccggtcccccgttacggg

SEQ ID NO: 202843 - DNA, 400 bp, Homo sapiens
  misc_feature: GYAE6OF02GBNSV.21.46.E02.1.454.CMB.1.raw
  modified_base (143)..(143): a, c, t, g, unknown or other
  misc_feature (143)..(143): n is a, c, g, or t
  modified_base (317)..(317): a, c, t, g, unknown or other
  misc_feature (317)..(317): n is a, c, g, or t
  modified_base (320)..(320): a, c, t, g, unknown or other
  misc_feature (320)..(320): n is a, c, g, or t
  modified_base (323)..(325): a, c, t, g, unknown or other
  misc_feature (323)..(325): n is a, c, g, or t
  modified_base (327)..(328): a, c, t, g, unknown or other
  misc_feature (327)..(328): n is a, c, g, or t
  modified_base (330)..(400): a, c, t, g, unknown or other
  misc_feature (330)..(400): n is a, c, g, or t
tcagtcgtcgctcgcacgaccggtgctcgatttagactcatctacagggaaagggactggagtggttattattcctggggccagggaaccctggtaaccgtctcctcagccctccaccaacgggcccatcggtccttcccccnggccgccctgctcccagggacgccaccctccgagacgcacgaggccggccccgtggggcctcgcccgttagggtccgaaagggtacccttaccgtttcccccgtcggttccttccgtaacggacgggccgggggtccttacgggggaccaaagggccggacctaaagttacggntgnacnnncnntnnnnnnnnnnnnnnnnnnnnnnnnnnnnnnnnnnnnnnnnnnnnnnnnnnnnnnnnnnnnnnnnnnnnnnn

SEQ ID NO: 202844 - DNA, 763 bp, Homo sapiens
  misc_feature: GYAE6OF02JCV86.21.46.E02.1.454.CMB.1.raw
  modified_base (569)..(569): a, c, t, g, unknown or other
  misc_feature (569)..(569): n is a, c, g, or t
tcagtcgtcgctcgcacgaccggtgctcgatttagactcatctacagggaaagggggtgggtccaggaggcagaactctgggtgtctcaccatggcctggatcctctacttcctcccctcctcactctctcgcacaggctctgacggcctcctatcgagctagacacacgacctaccgtacgtgtctacgtcgtcccgaggacgacgacggccgaggacgtacacgtcgcctacgtgggacgtagtacggacgtaacgaacctaaaagtaaattacgtacgttactttacgttaacggggtaacctaacgaacggaacggccaacgggtcccggaccggtccccgtaggttaacgttaggtaacgtaagttaactaaaacgttaaacgtacctaaccgtaggtacgacgggttacccaacggtacaacgtacctccgtagaccgtacgtcttcgtcggtcggtacctacgcggtacgtacggacggacgatacgacgtctaacggtacgtacgtacgtacgaacggttacgttaaccggcgtaacgggagacgggaacgggtaaccggnggtacggtaagtacgttaacttacgacttaacgaacgtatacgggtaaatcgggttaacgaacggttcgtaagtgggtttacgggtacgggtaccgggtacgggtaacgcggtaacgtccgggtaccgtaacgggttacaccggggtaccacggtaacgtcccggtcttaccccgggtacgtcccgttacccgg

SEQ ID NO: 202845 - DNA, 710 bp, Homo sapiens
  misc_feature: GYAE6OF02I9ZE0.21.46.E02.1.454.CMB.1.raw
tcagtcgtcgctcgcacgaccggtgctcgatttagactcatctacagggaaagggggtgggtccaggaggcagaactctgggtgtctcaccatggcctggactccctctacttcctcccctctcactctctgcacgaggctctggacgtcctcctatgacgctcgacacacgcccaccttgggtctcacggttccgaccccgaaggacgacggtaccggccaaggactccgaccgttggccttcgtcgaccgtagtaacgtcgggtaacctcggaaaccgaaaaagtaaagttcgttcgtactttaaggttaaccggaaccaacgaacgaaccgaccgtacggaccgacggttcccgtaggttcgttaacggtgtaattaacgaaacgtaaagaccacggtaagacggaccggtccctagaacggtacgtactccgtagacgtagtacttcgtcgtacgtcacggtctacgtaccgtagggaccacgtccgtaagttccgacttacggtactactcgtaacgtaagtcgtacgacgacgacggtaggaccgtggtactcgtaacttacgtactacggaaactacgtacggacaagtagaacgtcgtacgttacgtaggttacgggtcggtacgggcggaacgtacggaccgtcgtaccggtacgcgttaacggacgtccgtacgtaacggtccctaccgtcccgtaacgg

SEQ ID NO: 202846 - DNA, 732 bp, Homo sapiens
  misc_feature: GYAE6OF02HMU4H.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctctcactctctgcacaggctctgaggcctcctatgagctgacacagcccaccgttcggtgtcagtcgtccccgaaggaccaggaccggccaaggacttccaacctgccttcgtgcctagtacgtcggacctaggaccaaaagtaatacgtcgtatttacgtacgttaaccaaacaaggaacgaccgacggccgaacgggtccccgttggtacggttacgtaggtaattaactaaacgttaaaagaccaaccgttaggacggtaccggtcctacgacgtagtacctccgtagacgtaccgtacttccgtcgtggtacctccgacgtacgtacgaacgggaacacgacggtacttacggtacgttaggacctttaacgacggtaagttaacggtaacgtacggtacggacgtaacggggacgacggaggtacctacggacgtttactaacgtacgtaaacaacggtacgtaacgacgtaacggtaaggtaacgtttcgaacgttcggttacgggttcgtacgggacgggtaacggtaccggtaacggtccgtaacggtcccgtacggtaccgtacgacccggtaaccggacgtccgtaccgtacccggttacccg

SEQ ID NO: 202847 - DNA, 732 bp, Homo sapiens
  misc_feature: GYAE6OF02I9M76.21.46.E02.1.454.CMB.1.raw
  modified_base (229)..(229): a, c, t, g, unknown or other
  misc_feature (229)..(229): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagaccggccaaggactccacctgctctgcgagngtggactgaaccaaaagtaaatatagtacttagtttacggtaaacccaaacgaaggaaacgccgaacggaccgaaccggtccccttaggttacgttaggtagtaattaagttaagtaaacgactaacgttaggaggtaccggcccctagaagagacctaccgtagacgacgtattctcgttcgcctacgagtcgtacggacgggacacggactacgtacgtacgttaccgaacttagtaccgtaaggttaaccggtaagttacccggaaaggacgggtaacgggaacgggtaacggtccgggtattaccgtaaacgtttaacttaacgtcggtaaccaaaacgtaggtaacgtacggaagttaagggtcgttaacgttaagttagggtttcgggttagggttaccgggaccgggtaagacccggtaaaggtcccggtaaggtacccggttccgttaaggcccgtaacgacccgtacgggtcgttccccggaccccgttaacgg

SEQ ID NO: 202848 - DNA, 771 bp, Homo sapiens
  misc_feature: GYAE6OF02FQH48.21.46.E02.1.454.CMB.1.raw
  modified_base (103)..(103): a, c, t, g, unknown or other
  misc_feature (103)..(103): n is a, c, g, or t
  modified_base (163)..(163): a, c, t, g, unknown or other
  misc_feature (163)..(163): n is a, c, g, or t
  modified_base (399)..(399): a, c, t, g, unknown or other
  misc_feature (399)..(399): n is a, c, g, or t
tcagtcgtcgctcgcacgaccggtgctcgatttagactcatctacagggaaggggtggtccaggaggcagaactctggtgtctcaccatggcctggatccctntacttctcccccgtcctcactctctgcacacggctctgacgcctctatgagtctgacacngcccacccgttggtagtcagtcgtccccaaggacaacggtccggacaggactccaccgttgacctcgtgcagagttcggaactcgaaccgaaaagtaaactgtcactttacgttacggtaaccaacgtacgaacgtccgacggtacccaacggttcccctagttacggttagtacgaattaccttaaaggaagtacctagtacgaggccgttaccacgtagacgtaccgttaccgngtaacgcgttaacgttccgtaggttccgaccgttaccgacggttaccgacgtaacggggaccaaacggttccggtagtacccgtacggttacgttaaccgaacttaccggaagttacgggaaaccgttaccggacgggtacaagggaaccgggaccggttaggtaccttaacggtaacctttacgttaccgaccgtttaagaacccgtaaggttaaccgacgtttaagggaccggttaatttaccgagttaccggtttaggggtaccggtttacggacccggggtttaagacccgttaggtaaccgttacccggaaccgttccgtacgggtacacccggaccgtaggcccgtttaccccggccctttaccgg

SEQ ID NO: 202849 - DNA, 684 bp, Homo sapiens
  misc_feature: GYAE6OF02H5A2N.21.46.E02.1.454.CMB.1.raw
  modified_base (420)..(420): a, c, t, g, unknown or other
  misc_feature (420)..(420): n is a, c, g, or t
tcagtcgtcgctcgcacgaccggtgctcgatttagactcatctacagggaaagggggtggtccaggaggcagaactctgggtgtctcaccatggcctggatccctctacttctcccctcctcactctctgcacaggctctgaggcctcctatgagctgacacagccaccctcggtgtcagtgtccccaggacagacggccaggactcacctgctctgcagatggactgaccaaaagaatatgtaccttagttcggtaaccaacgtagaacgccgaggccgaacggtccccctaggttagttacgtagaacttaagtaattaaaggaccacgttagaacggacggtcccctagagagtactcccgtgacgcgtattccgtcgtcggctccgagctacgaggacagcgtacgtctacggttnacgttatcgtacggttagaacgtccgaggactaacggaggtacgaacggcttaacggacttaagtttaccgagtaaaccgaacgtaacggtaacgaacgtaaggttaacggacggtttaccgtaggttacggtttcgggggttacgtttaccgggacggggtacgggtaaccgaacgggttccgtaaccggtacccggttaaccggtaggttacccggacgttaaccccggaagggttcccctacccggtaccccgttacccgg

SEQ ID NO: 202850 - DNA, 696 bp, Homo sapiens
  misc_feature: GYAE6OF02JN83R.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttcctccccctcctcactctctgcacaggctctaggacggcctcctatgagctgacacgacgcccgtacccgtggtgtacgtagtcggtacccccgaaggaccacggaccggccgaggtactccgacctgcctcgtcggactagagtcggactacggaaccaaagtaatagtgtacttagttacggaaccaacgagaacgaccgacggaccgtacggtcccgtagttaggttaagtagtaagtaataagtaaacgactacgttggacgtacggtcccagaacggtataccgtaccgaggacgtaacgttattcgtaccgtggcctacgagtaccggtaggacggtaccgaggtctaccggtacgtacggttaacgacgtagtacgtaggtaacggacggacggacgtacggaacggacggaggtcgtacgtagtaacgttagtacgtacgaactaagtagtacgagtaaggtaggtacgtactaggtaggttcgggtagtacggggacggaaggacgtaacgggtgtaacccggtcctaggtacggtccgtaacggaccggtcggtaacccgtcgaccccgttacg

SEQ ID NO: 202851 - DNA, 711 bp, Homo sapiens
  misc_feature: GYAE6OF02G80CB.21.46.E02.1.454.CMB.1.raw
  modified_base (225)..(225): a, c, t, g, unknown or other
  misc_feature (225)..(225): n is a, c, g, or t
  modified_base (608)..(608): a, c, t, g, unknown or other
  misc_feature (608)..(608): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagccaccctcggtgtcagtcgtccccaggacagaccgccaggactcacctgctctgcgagngtaggactgaccaaagaatgtgtacttagttacggtaccaagagaacgccgacggccacggccccttggtcgttagagtacgttaataagttaaaacgacctaggacggaacggaccggtcccgtacaacggaacgtaccgttaccccgtaggacgtaccggtactttcgtaccgttgggtacctaccgacgtccgtacggaaggaccgagtacgtacggtacgtacgttacgaacgttactacgagttacggtaaacgtccgaaacggcaagggaacggacgggacgtacggtacgtaacttagttacgtagtaaccaacgtaggtaacgagtaacgttaaggacggttaagtgtacgggtttacgggtgggttaaccgggnggggtaacggtaacggtaacggtccggtaacggtacccggttacggttacggtacccggacggttacccgaccgggtaccgtcccggtacccccggttaaccg

SEQ ID NO: 202852 - DNA, 702 bp, Homo sapiens
  misc_feature: GYAE6OF02JLBUF.21.46.E02.1.454.CMB.1.raw
  modified_base (637)..(637): a, c, t, g, unknown or other
  misc_feature (637)..(637): n is a, c, g, or t
tcagtcgtcgctcgcacgaccggtgctcgatttagactcatctacagggaaagggggtgggtccaggaggcagaactctgggtgtctcaccatggcctggatccctctacttcctccccctcctctactttctgcacagtctctgaggccctcctatgacgctgaccacgcgcccacccgtcggtgtcaggtcgtaccccgaggaccaaaccggccgaggactccacctgtctctggatacttacagttcgaaccaaaagtaataacttacgttggttcggttaccagctaagaacgtcgacggccgtacggacccttgtacgtcggtacaacgttccgagttcgacggaccgtacgttcgaaccggtcctaacggtaccggaacctccgtcggaacggtacgtaaccgttcgtacgtccgtaccctacccgtatcccgtagggaccgggtacgtacggtcggtaccccttaacgttacgtacaacgttccgacgggtaccggggtccgagggtcgtacgaagtcgaatcgtagtacctattacgttatccgaacgtacgcttacggaggtcgagtacgtacgtcgggtaaggtcggtacgggcggtaccgacgtacgtcgtaccgttgtacgtacnccggtacggcgttacgtcccggtccttaccggtctcccgttcggtacccgttccccgtgttcccg

SEQ ID NO: 202853 - DNA, 664 bp, Homo sapiens
  misc_feature: GYAE6OF02FT2E2.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagaccggccaggatcacctgctctgcagatggactgaccaaagaatatgtacttattcggtaaccaagagaacgccgaaggccacggtcccctgtgttagtgatataataacgactactgaggacggtccctagacgagctacccgtggacgtacgtattctcgtacggcctccgagcgtacgaacgggacagccgtaggtacctacggttacgtaaccttacgtacgtaggtacgtaaacggtaccgaagggtacgaagggaacgggacggacggtacgtacgtaacgtttaaccgttacgtagtaacgaaaccgtaagtaacggacgtaaggttaacggtaacggttaaccgttacgtaaggtttcggggttacggttcggggacgggaacgggtaccgaaggtcgtacggtacccgttacgtacgtacggacgtacccggagtcccgtaccggtcccccgtacgg

SEQ ID NO: 202854 - DNA, 777 bp, Homo sapiens
  misc_feature: GYAE6OF02GVLDG.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgacggccctcctatgagctgaccacacgcccacccgtcggtgtcagttcgtccccgaggacaggaccggccaggactcacctgctcgtgaccagatcggactcgaacctaaaaggaaatgtcgtactttacgttacggtaaccaaagacgaaacgaccgacggaccgaacggtcccccttaggttacggtttaagtagtaatttagtaaacttaaaacggaacaacgtaggagtaaccggaccctacgtaagaacgtaccgtcccctaggaccgtaccgttacgttccgtaccgttcgggtccttaccgaccgtctacggaacgggacgtaacggacgtacggtaccgtttaacgtacggtaacttacgtagttaacggagtaaccggttacgacgggacgacgggtaacggacgggtacggtacgttacggtaacttaacgtttacctacgttaaaccgaaacgtacggtaaacgtacgtaaacgtacggttaacgtacgttacgtacggtttcggggtagggttaccgggacggggttacgaaccggtaacggtaaccgtaccggtccggtttaaccggtcggttaccgaccgggtacccgacgggtcccggtcccggaccccggtttaccgg

SEQ ID NO: 202855 - DNA, 765 bp, Homo sapiens
  misc_feature: GYAE6OF02GE4V0.21.46.E02.1.454.CMB.1.raw
  modified_base (270)..(270): a, c, t, g, unknown or other
  misc_feature (270)..(270): n is a, c, g, or t
  modified_base (395)..(395): a, c, t, g, unknown or other
  misc_feature (395)..(395): n is a, c, g, or t
  modified_base (678)..(678): a, c, t, g, unknown or other
  misc_feature (678)..(678): n is a, c, g, or t
tcagtcgtcgctcgcacgaccggtgctcgatttagactcatctacagggaaagggggtggtccaggaggcagaactctgggtgtctcaccatggcctggactccctctacttctccccctctcactcgtctgctacaggctctggagcctcctatgagtctgacacagcccacctcgggtgtccaggtcgtaccccagggtaccaggaccggccaaggatccaccgtggccttctggaccagagtcgggaccttggaccaaaaagaattncggtcttaagttacgtaacctaagaacgtaacgccgacggtccgaacggtcccctaggttgtaagtacgagttacaagttaacacgtagtacgagtacgggtcctacacggtacgacgttaccgnggtacgaccggttacttccgtcctaacggtccgttaccgagtacccggtagacgggaaaccgtcgtacggtaacgtaccgtacgggtttacgtaaccgtacgttaaccgtaggttaccggaacgtttccggaaggaccgtaaaggggaacgtaccgggaaggttccgtacggtaacttttacgtaaccgtccgttaaacgtaaaccgtaggttaacgacggttaagtaacggtacggtttaactaccggttaggtcgggttacgtacgggtcgggaaaccggngttaaaccggccggtttacgaaccggtttaccgtaagggtacccgtaccgggaaccgtacggcccgtttccccggtaccctaccggg

SEQ ID NO: 202856 - DNA, 718 bp, Homo sapiens
  misc_feature: GYAE6OF02GP3JR.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctcagcacaggctctgaggcctcctatgagctgacacagccaccctggtgtcagtgtccccaggacagacgccaggactcacctgctctgcagagtggactgaaccaaagtaaatatagtactttagttacggtaacctaaacgaacgaacgaccgaggaccccgacggtaccccctggttacgttagtagtaacgttaataaagtaaacgacgtaacgtgaacggacggtccctagaacgagtactacccgtgagaccgtacttcgtcgtcggtcctaccgacgtacctacggaacggtacgacgcgaccgtcgtaacggttcgtaacctactacgtaaggtacgtaaccgtaccggaaggacgtaacgggtaacggacgggttaggtacgttacgttaacttacgtttaccgtacgtaaactaaacgtaagttacgaacgtaacggtaaggtacgttaacgttacgttaggtttacgggtcgttacgggacgggtaacggtaacgtaacggtccgtaaccggtacccgttaccggttacggaccgtaccggaccgtaccgggtcccgtacccggtccccgttaacccgg

SEQ ID NO: 202857 - DNA, 788 bp, Homo sapiens
  misc_feature: GYAE6OF02FL33C.21.46.E02.1.454.CMB.1.raw
  modified_base (135)..(135): a, c, t, g, unknown or other
  misc_feature (135)..(135): n is a, c, g, or t
tcagtcgtcgctcgcacgaccggtgctcgatttagactcatctacagggaaagggggtgggtccaggaggcagaactctgggtgtctcaccatggcctggatccctctacttcctccccctcctcactctctgcnaggctctgaggcctcctatgagctcgacacagcccacccgttcggtgtctagtccgtacccccagggaccaggaccggccaaggtactccacctgcctctagcagagtggacgtcgaaccaaaaggtaaactgtgtacctttagttacggtaaaccaacgtaagaacgtaccgaaccggaccgtaccgggtacccccgttagggttacgtttaaggtacgtaatttaaaagtaaacgttaaaaaccggaaaccgttaaccggttacggaacggtacccgggggtaccccctaacgggtaacgtaaccggacccggttacccccgttagggaacgggttaaccgttaacgtttacttcccggttacgggtaccccttacgacccgggtaacccgttccgggaaaggggtacccaggtacccggttaagtcccgtaccgttatacgtacgtaccgtaggtaagtaaccgtcgagactaggacgacggaggtctacgtacttactactcgtaacaacgttaagacggtataagtacgtagtaacgtgttacggttgtacggtacgggtacgggtaaccggaccgtaaggcgtaccggtaccgttacgtaccgggtacaccggaccgtacggtccctaccccgggtcccttaaccgg

SEQ ID NO: 202858 - DNA, 749 bp, Homo sapiens
  misc_feature: GYAE6OF02FR9NA.21.46.E02.1.454.CMB.1.raw
  modified_base (228)..(228): a, c, t, g, unknown or other
  misc_feature (228)..(228): n is a, c, g, or t
  modified_base (312)..(312): a, c, t, g, unknown or other
  misc_feature (312)..(312): n is a, c, g, or t
  modified_base (472)..(472): a, c, t, g, unknown or other
  misc_feature (472)..(472): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacagctctgaggcctcctatgagctagacacacgccaccctcggtgtcagtcgtaccccgaggacagaccggcaggactccactgctctgacagntcggactgaccaaaagaattatacgcttaagttacggaacccaaagacgaacgtccaacggccacggtccctagtagtttacgngaattataagtaaaacgtcgactaggaagaccggccctagaacgagtaccttacccggagacgtaccgtacgttcgttaccgtgggtacccttacgacggtccctaaggacgggaaacacggtaccgtaacgtttccctaaggtttacgaaccgtttaancggtaaacgtaggtaaccgtaccgtacggacgtaacggacggtacccggagtactacgtaactttaagttacgtaactaacgaaacgtaggtaacaacgtaacgttaagggaacgtttactacggttagtttagggggtaccgttacggggacgggttaacggtaacccgaagggtttaccgtaaaccgggtaccggtttaaccggttacgggtaacccgacccggttaaacccgaacccggggtttacccgtaccccgttaccccggttaacccgg

SEQ ID NO: 202859 - DNA, 942 bp, Homo sapiens
  misc_feature: GYAE6OF02IVRQL.21.46.E02.1.454.CMB.1.raw
  modified_base (182)..(182): a, c, t, g, unknown or other
  misc_feature (182)..(182): n is a, c, g, or t
  modified_base (233)..(233): a, c, t, g, unknown or other
  misc_feature (233)..(233): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctggacgcctcctatgagctgacacacgccctacccgtggtntcgtagtccgtaccccgaggacacgaccggccaaggactcctacctgctcngcgtaagagttcgggactacgaacctaaaaggaattagtacgttactttagttaccgggtaaacctaaacgaacggaaacgtaccgaacgggtacccgtaacccgggtcccccgttaggtttaccggttaaggttacggtaactttaaacgtaaaacgtaaaacggtaacctaacggtacgggtaacggtacccgtaccccgtaacggaaacggtacgttaaccctccggtaacggtaacggtaccgtaccgtttccgtaaccggttccggtaccgtaaccgtacggtacccgttaagggaaaccgggactaccgggtaacctaccggtaccggtttaaccggttacgtaaaccgtttcgtaacgtaaacgggttaaccgacggtaccggtaacgggtaaaccggtacggggtaaaccgggtacggtacggttaaccggttacgttaaaccgtttaaccgttaacggttaaaccgtaaacggtaaccgttaaagggtaaccgtaaacgttaaacggggtaggtaaccgggttaacgttaacggtttaacggggtacgggttttaacggggtcccgggtaaccgggggtaaccgtaaccgggtaaacccggtacgggttccggtaacccgggttaccgggtttacggaaccggtaaccggacccgggtaaccgttacccccgggtaccggtttacccccgtaaccccggg

SEQ ID NO: 202860 - DNA, 745 bp, Homo sapiens
  misc_feature: GYAE6OF02I2WRQ.21.46.E02.1.454.CMB.1.raw
  modified_base (476)..(476): a, c, t, g, unknown or other
  misc_feature (476)..(476): n is a, c, g, or t
tcagtcgtcgctcgcacgaccggtgctcgatttagactcatctacagggaaagggggtgggtccaggaggcagaactctgggtgtctcaccatggcctggatccctctacttcctcccccctcctcactcctcgtcgcacaggctctgaggtcctcctatgagtctcgacacgacgcccacccgtcggttcgtactacgtcgtccccgaacggacacggaccggccagggactccctacctgccttcgtagccgagtcggtggtaccgtacggaaccgaaaacgtaaattatacggttaccttttaacggttacggttaaccgaaaccaaggaaccggaccgacggtaccgaccggtcccgttaggttaggttagtagtatacgttaataaacgacgacgtaggacgtaccggccgtacaaggaccgtacttacccgagggaccgtactcgttaccgtcgtccgtcctacccgtanaccggttacggaacgaaccgtacgaccgttaagtccgtacgttacgtacttacgtacgtaacggtagaacgccgtaacggaggacggaggaacggtagacgttaacgtacttacgttacgtaactaaccaaacgtacgtaagtacgtaagtaagtacgtacttagttacgttgggtagtccgggaggtaaccggtacgaccggtcgtacgtaacccggtacgtacgtacggacccgaacggtccgtaccgttacccggccctttaccgg

SEQ ID NO: 202861 - DNA, 694 bp, Homo sapiens
  misc_feature: GYAE6OF02F4ERF.21.46.E02.1.454.CMB.1.raw
  modified_base (178)..(178): a, c, t, g, unknown or other
  misc_feature (178)..(178): n is a, c, g, or t
  modified_base (264)..(264): a, c, t, g, unknown or other
  misc_feature (264)..(264): n is a, c, g, or t
tcagtcgtcgctcgcacgaccggtgctcgatttagactcatctacagggaaagggggtgggtccaggaggcagaactctgggtgtctcaccatggcctggactccctctacttctccccctcctcactctctgcacaggctctgagcctctatgagctagacacagcccacctcggtntcagtcgtcccaggacagacggcaggatcacctgctctgcagatggactgaccaaaagtaatatgtacttagttacggtaaccaanaagaacgaccaggacccacggtcccctagttacgtttagtactaataataagtaaaacgacctaacgtaggaacggacgggtaccctacgaacgaacgtacttccccgtaggacgtaccgttacttccgtacgtcggtccctaccgtacgtccgtacgggaacggtacctaggaccgtaggttaccgtaacggtttacgaacctttagtacgtaggtacgtaacggtcgaggacgaaggacggacgtaggctagtaaccttagtaccgtataacaacgtagaagtagtaaggtagtacgttaactgttaaggttcgggtcggttaacgggacgggaccggtaacgtaacggtccgtaaccggtaccgttaccggtagggtaccgtaccggaccggtaaccggcccgttacccggtacccccgttaaccgg

SEQ ID NO: 202862 - DNA, 680 bp, Homo sapiens
  misc_feature: GYAE6OF02GTC2B.21.46.E02.1.454.CMB.1.raw
  modified_base (247)..(247): a, c, t, g, unknown or other
  misc_feature (247)..(247): n is a, c, g, or t
  modified_base (268)..(268): a, c, t, g, unknown or other
  misc_feature (268)..(268): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctctatgagctgacacagcccacccgtcggtgtcagtcgtccccaggacacggaccgcgaggatcacctgctcgtgcagatggactgaaccaaaagaatntgtacttagtcggtaaccaanagaacgccgacggccgaccgcccgtaggttgttagtgaataataagtaacgactacgtagacgtaccggtccctacgaggtaactaccgtacccgtaggacgtaccgttatttcccgttcgtacggtcctaccgtacgtcgtacggaacgggtacgacgtactaacgtccgtagttacgaactctacgtagtacgtacgtacgacgacgtaggacggacggacgtcgtagacgttacgtacgtacgtaacaacgtagtaacgacgtaagtacgggtacgtacgttacgttggttacgggttagggtaccggggagggtaaccgacggtaacggttccgtacggtaccggttacgtacccggtacggacccggtaaccggtacggtcccggttccccggtacccccggttccg

SEQ ID NO: 202863 - DNA, 911 bp, Homo sapiens
  misc_feature: GYAE6OF02HW1SX.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttcctcccccctctcactctctgcacaggctctgaggcctcctatgagctgaccacacgccctacccgttcggtgtcacgttccgtacccccgaggaccgaggaccggaccaggactcccaccttgccgtcctgaccgaataggtcgtaaccgtcgaaccctaaaaaaggtaaattagttaccggttaccttttaagttaaccggtaaccccaaaaacgaggaaaaccgccccggaacgggtaccccgaccggggtacccccgttggtttacggttttaacgtacgtaaattaaagttaaagtaaaacggacctaaacgggttggaaacgggtaccccggtaccccgttacgaagtaaaccggtacccgttccccggtagggaccgaccggtttactttaccgttaccggtcgggtcccctaacccggtacgttaccgtaccggaaggtaaccaagtccgtaacgttaccgtacgttagaacccgttaagtcgtaaggtaacggaaccggtacccggtaagggacgtaacggggaaccggaaccgggacggttacacgtttaaccgtttaacgttaacgtacccggtaaaactaacgtaacgggtaacaaccgggtaaagttaaacgggtaggtttaaccgttgggtttaacggttacggggtttaggggtacccgggttaaagggcccggttaaaaccggacggttcgttaaaccgggggtcccgttaaacccggttccggaaccggtacccggaacccgttaccgggtcccccgttaccccgggacccccgttacccgg

SEQ ID NO: 202864 - DNA, 691 bp, Homo sapiens
  misc_feature: GYAE6OF02H8756.21.46.E02.1.454.CMB.1.raw
  modified_base (242)..(242): a, c, t, g, unknown or other
  misc_feature (242)..(242): n is a, c, g, or t
  modified_base (546)..(546): a, c, t, g, unknown or other
  misc_feature (546)..(546): n is a, c, g, or t
  modified_base (577)..(577): a, c, t, g, unknown or other
  misc_feature (577)..(577): n is a, c, g, or t
  modified_base (613)..(613): a, c, t, g, unknown or other
  misc_feature (613)..(613): n is a, c, g, or t
tcagtcgtcgctcgcacgaccggtgctcgatttagactcatctacagggaaagggggtgggtccaggaggcagaactctgggtgtctcaccatggcctggactccctctacttcctccccctcctcactctctgcacaggctctagacggtcctcctatgacgctagacactcgccctacccgtggtctcacgtccgtcccgaggacgacggaccggaccgaggtactaccgacctcgctcngacagtacgtacggtacacgaaccgaaaagtaatacgtacggttactttaacggttaccggaaaccaaacgtaaggaacggtaccgaacgggaccctaccgggtcccttaggtacggtttaggaatacgtaaagttaaacgtaaacgacgtaacgtaggaacggtaccgacctagacggataccgttcgagacgtacgttacgtccgtcgtcggacctacgagtcgacggacggacacgtcgacgtctaacgtacgtactacgtctaggtacgtagtacgaggtacgaaggacgacggtacgtntacgttaactacttagacaaagaactagtanacgtaagtacgtacgtatacgtggtacggttacggnggtaccggacgtaacgcgttaacgtacggtccgttaacgtaggacgtaccgacggtacggccgtacccgtcgtaaccg

SEQ ID NO: 202865 - DNA, 715 bp, Homo sapiens
  misc_feature: GYAE6OF02HOSL7.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctcccctctcactctctgcacaggctctgaggcctcctatgagctgacacagccaccctcggtgtcagtcgtccccaggacagaccggcctaggactccaccttgctctgcagatcggactcgaccaaaagaatatcgtacttacttacggtaaccaacgagaacgtaccaggacccgacggccccttggttacgttaacgtgaacttaataaataaacgacctaacgtggacggaccgtccctagaagacgtacctcccgtagacgtcgtaacttccgtacgtcggtccctacgacgtcgtacgaacggggacctaggaccgtacggtaccgttaacggtttacgtacttaacgtcggtaacggtacggtaacggttacccggaaggtaccggaggggaaacggtcgggaacggtaccgttaacggacgttttaacgttaccgtacgtaaaccaaaggtacggttaagaacgtaaggtacggtaacggttactacggtacggttggggttacgtacgggacgggtacggtaacgaggtccgtacgtacccgttacggtacggttccacggacccgtacggcccgtaccggtccccgttacgg

SEQ ID NO: 202866 - DNA, 759 bp, Homo sapiens
  misc_feature: GYAE6OF02H9WFE.21.46.E02.1.454.CMB.1.raw
  modified_base (166)..(166): a, c, t, g, unknown or other
  misc_feature (166)..(166): n is a, c, g, or t
  modified_base (219)..(219): a, c, t, g, unknown or other
  misc_feature (219)..(219): n is a, c, g, or t
  modified_base (240)..(240): a, c, t, g, unknown or other
  misc_feature (240)..(240): n is a, c, g, or t
  modified_base (571)..(571): a, c, t, g, unknown or other
  misc_feature (571)..(571): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgacgcctcctatgagctagacaacncgccctacccttggtagtccagttcgccccaaggtcgagaaccggccgtaagntccacctgactgtcgactagngtacggctacgaacgaaataaatcgtgtacttagttacggtaaaccaacgaagaacgcgaccggaccgtaacggtcccgttagttaggttacgtagtaagttaactaagtaaaacgtacgaacgtgtaacggacgacccttacgaagacgttacggaccttaggacgtcgttaacgtccgttccgagtccgtacgtcggccgtaacggacgaacgacggtcgaaacgtttcgtctaggtaactacgtacggtagtacggtaaacgtcggtacggtaacgtacgggaacggacgtaccggtaacgttacgtaactttaacgttaacgttaanaaaccggtaaagtacgtaacggaacgttaacggtaaggttaaccgtaacgttacgggttacgttacgggtacgggttccgggttaacgggaccggttaaccggaggtaccggtaccggtaaccggtccgttaaccggcgttaccggtaacccggccggtaacccggtcccgtaccccggttaacccgg

SEQ ID NO: 202867 - DNA, 1004 bp, Homo sapiens
  misc_feature: GYAE6OF02JD2T4.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgacggcctcctagtgagctagacacgacgccacccgtggtcgtacgacggttccgtcccccgaaggggacaacggaccggacccgagggtactccgtacccgtggtcccttcgttcggccgtaagtacggtacgggtaacctacggtaaacccgaaaaagtaaaacgttagttacgttaccgttttaacgggttttaccggttaaacccctaaaacggaaggtaaaccgggacccccggtaaaccggggacccccggtaaccccgggtacccccccgttttagggggtttaacgggttttaaccggtttaacggtaaacggttttaaacttttaaaaaccggttaaaaacgggtaaacccgtaaaccggttacggtaaaaccggggtaacccggttacccccccgtttaggaaaccgggtaaaccgggttacccctttaaccccgggtacggggtaaccggggtaacccgttaccgttttccctaccggtttaccgggccccgtttacccggaacggtcccgttaacggaaccgggggtaaccaaccgggtacgtaccgtttaccggaaaccgtttacggtaaccgttaaaccttcggtaacggtttaacgggtaactacccgggtaaagggtaaccggaacggggaacgggtaccggaacgggtcgttaacggtacgttaaccgttacgtacgtaccgtaacgtacggtaacgtaacgtcggtaagtacggtacgttacggttaggtttcgggttagggttaccgggtacgggaacggaccggtaaggtaccgttccggtaccgttaccgggtagtacccgaccggtccgaacggttcccgtacccggtaccccgttccgg

SEQ ID NO: 202868 - DNA, 825 bp, Homo sapiens
  misc_feature: GYAE6OF02HW243.21.46.E02.1.454.CMB.1.raw
  modified_base (139)..(139): a, c, t, g, unknown or other
  misc_feature (139)..(139): n is a, c, g, or t
  modified_base (145)..(145): a, c, t, g, unknown or other
  misc_feature (145)..(145): n is a, c, g, or t
  modified_base (158)..(158): a, c, t, g, unknown or other
  misc_feature (158)..(158): n is a, c, g, or t
  modified_base (223)..(223): a, c, t, g, unknown or other
  misc_feature (223)..(223): n is a, c, g, or t
tcagtcgtcgctcgcacgaccggtgctcgatttagactcatctacagggaaagggggtgggtccagggaggcagaactctggggtgtctcaccatggcctggatccctctacttcctccccctcctcactctctgcacnggctcngacgcctcatganctgacacacgccctacccgtggtgctaggtccggaccccgaaggacacggaccggccgaggtacncctaccgtcgtctcgtagacaggtatcgggacttacggaaccgaaaaagtaactcgtttcgaacgttttacggttacggaaccgaaacgaggaacggccgaaccggtacccgaccggtcccggttggttacggttaaggtcgtaaattaacgttaaacgaaaacgtactaacgtcggaacgtccgggtaccccgtaagacgggaaccggttaccttaccccgggagtaaccgggtccgtaaccgtttcgtacggcggtaacccgtttccgcggttaccgttacgggaaccgggtacgaacgtaccggttcggtaccttacggggttaccttaacgtacgttacgaaccggtaggtaaccgtacggacggtaggaacgggacgggagtacgggtattacggtaactttcttaaacgggtcaaaacgtaagtacggtaaagtcgtaaacgggttacgttaccggtttagtaaccgggtttaggtccggtttaaggggtccgggtacgggaccggttacgggaacggttccggacggttaaccccgtcggtaaacgttccggaaccggaccggtacccgttcggaccccggttcccgttaaccgg

SEQ ID NO: 202869 - DNA, 850 bp, Homo sapiens
  misc_feature: GYAE6OF02H21YA.21.46.E02.1.454.CMB.1.raw
  modified_base (135)..(135): a, c, t, g, unknown or other
  misc_feature (135)..(135): n is a, c, g, or t
  modified_base (438)..(438): a, c, t, g, unknown or other
  misc_feature (438)..(438): n is a, c, g, or t
tcagtcgtcgctcgcacgaccggtgctcgatttagactcatctacagggaaagggggtggtccaggaggcagaactctgggtgtctcaccatggcctggactccctctacttcctcccctctcactctctgcacnggctcgtggacggtccctctatgacgcgtacgacacgacgacccctacccgtcggtctacgtgtccgtccccgagggaccacggaccggccgacggacttccgcctcgtctcgtacgcagtcgtacggacctacgaaccgtaaaagtaagttacgttacggttacctttaaggtaaccgtaaaccgaacggaacgtaccgaccggaccggaccggttacccggtcccgttaggttacggtttaacgtagtaacgttaataaacggtaaaccgacaacggttacggaaccgtccgttaacccgngaagtaaccggtccctccgggtagtaccgttacgttaccgtttcccgtaggttcccgaccgttaccggtaccggttaccggaacgggacggtaaccctgggtacccgaagttttacccgaggttaccgtaacgtcgaacgggttacgtaccgggacgtaccggaaggtccggtaaagggccggtaacggtcggttaacttacgttaaacttaccgttacggtaacgtaaggaaacccgttaggaacccgtaaggttacggtaccggttaacggtagttacgggttaggtttaaccggggtcggtaccggggtaccgggtaagacggttaccgggtacccgtagggtaccccgttacggacggttccgaacccggtccggtaaccggttccccgtacccgggttcctacccgg

SEQ ID NO: 202870 - DNA, 1019 bp, Homo sapiens
  misc_feature: GYAE6OF02HX0DC.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctctcactctctgcacaggtctctgacggtcccttcctagtgagcgtacgacacacgccccacccgttcgggtgtctaacggtccgtaccccgaggtaccacggaccggacctaaggactccaccgtgtcctcgtcgacgtaagagtacgggtactaccggaaacctaaaaaggtaaattacgttcggttactttacgttaacgggtaaccctaaaacgaacggaaaccgccccgaacgggtacccgaacccgggtcccccgttagggttacggttttaacggtagttaacgtttaaaacgttaaaagttaaaaacggaccgttaaaccggtaacggtaacggaaccccggtaccccttacggaaacggtaaccgtaacccgttcccggtaagggtaccgtaccggttaaacttcccgttttacgggtaccggtcccttacccgtaacggttaccgtaaacgggaacggggtaccgtaacggtaaccgtaaccgttacccgttaacggtttacgtaaacccgttacgtttacggaaacggtttaacggaaacccggtcggtaaacgggaccggtaaaggggaaccgggtaaaccggtaccggtaacggtttaacgtaaacccgttttaacggttaaacgtttaccggtaaaacccaaaaacgggttacggtaaaacggtaacgttaaacgggttaaggggacccgttttaaacgtcgggttttaacggggttagggtttaaccgggggtccggggtaaccgggggtaacgtaaaccccgggtaaccgggtaccgttaaaacccgggggttcccggttaaacccgggttacggtaacccgtaaccccgggttaaccgggaccgggttaccccggtttacccccgtccccggtttaacccggg

SEQ ID NO: 202871 - DNA, 864 bp, Homo sapiens
  misc_feature: GYAE6OF02GA4F7.21.46.E02.1.454.CMB.1.raw
  modified_base (135)..(135): a, c, t, g, unknown or other
  misc_feature (135)..(135): n is a, c, g, or t
  modified_base (183)..(183): a, c, t, g, unknown or other
  misc_feature (183)..(183): n is a, c, g, or t
tcagtcgtcgctcgcacgaccggtgctcgatttagactcatctacagggaaagggggtgggtccaggaggcaggaactctgggtgtctcaccatggcctggatccctctacttctccccctctcactctctgcanaggctctgaggcctcctatgagctgacacgagcccaccctggtagtcngtcgttaccccgaggaccaggtaaccggccgaagggactcctaccgtgtccttcgtggccgaaggacttagggaccgtacggacccaaaaaaggttaaattaactcggtacgttttaacggttaccgggtaaaccctaaacgacggtaaaacgccccggaacggacccccgtagggtaccccccgttagggtttaccgttaaggtcgtaaacgttattaaacgtaaaaccggtaacctaaccggtaggacggtaccggtaccccctagaaggtaaccgtaccttaccccggtagggaaccggccggttactttcgttaccgacggtccctaccgacgtacccgtagaaaccggggtcacggacggttaacgtccgtaacggttagaaccgttagtacgtaggtaggtaaaccggttcgaacgggtaacgacgggacgggacggtaggtaccgtacgtaaacttaacttacggtagtaaccgtaaagtaacggtaacgtaagggtaacgggttaaggttaccggtttaacgttacggttaaaggtttcgggtaccgggtttaacgggaccgggtaacgggtaacccggtaacggacccgttaacgggtaacccgttcggttaaccggtaccgtaaccgaccccggtacggggtaccttaccgggtacccccggttacccggg

SEQ ID NO: 202872 - DNA, 747 bp, Homo sapiens
  misc_feature: GYAE6OF02GVZBI.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggtccaggatcacctgctctgcagagtcggactcggaccaaagaaactagtacgtaccttttaagttacggtaacccaaacgaacggaaagcccaacggacccgaacgggtccccccttaggttcggtttaacggtggtaacttaagtttaaacgttaaaacggacctaaccggtaggtaaacgggaccgggtccccttagaacggtaactaacgtccccggttagacggacgttacttcccgtaggtcgtaccctacgtacgtacgtcggaaacgggactacgtacgtacgtacgtacgttacgtaaccgttacgtacgtacgtaaggtaaccgttcggacgacggtaagggaacggacgtacgtacgttacgtaacttacgtacgtaacgtaaccgtaaacgtacgaaacgtaacggtacgtaagggttaccgttacgtaacggttgttaacggggtcgttacggggacggttacgaacggtgtaccggtacggtaccgtacgtaccgtcggtaccgaccggtacgtccgttacccgccgtaccg

SEQ ID NO: 202873 - DNA, 751 bp, Homo sapiens
  misc_feature: GYAE6OF02F1RSY.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggccttcctatgagctgacacacgccctacccgtggtgtcagtcgtaccccgaggacgacgaccggccaaggatccacctgctctgcagagtgactagaaccaaaagtaatatgttactttagttacgtaaccaaacgagaacgaccgaccggaccgaccggtccccttaggttagttaacgtagtaataaagttaacgaaaacggtaccgtaacgtaggaacgggaaccgggtcccctaacggtaacggaacgttaccttaccccggtaggacggtacgttaaccgtttcgtacgtcggtaccctaccgaacggtccgtaacggaacggacgtacgtacctacggtaccgttaacggttccgtaaaccttagtaaccgtaaggtacggtaacgtacccggaggtaacggaacgggaacggaacgtggtaccgtaagttaccttaacgttacgtcgaaacgtaaagacggttaacgaaggtaaggtaacggtagttacgtacgttcgggtttagggtcgtaggggacgggacggtacgtaacggtcggtaccggtaaccgtcgtaagtacccgtcgacccgacggtccgtaccccggtcccgttacg

SEQ ID NO: 202874 - DNA, 774 bp, Homo sapiens
  misc_feature: GYAE6OF02ILY7K.21.46.E02.1.454.CMB.1.raw
  modified_base (181)..(181): a, c, t, g, unknown or other
  misc_feature (181)..(181): n is a, c, g, or t
tcagtcgtcgctcgcacgaccggtgctcgatttagactcatctacaggggaaagggggtgggtccaggaggcagaactctgggtgtctcaccatggcctggatcctctacttctccccctcctcactctctgcacaggctctgacggcctcctatgagctagacacacgccaccgtcggtntcgagtcgtacccaggacagacggaccaggatccactgctctagacagatcggacgtacgaaccaaaagaatagtgtacttagttacgtaaaccaacgaagaacgccaacggacctaacggacctgtacgttagtaggaattaataaacggaaagacctagtacggagaccggtcctaggaagacgaactccgtagtacggtctacttccgacgttcggcctacgacgtccgtaacgaacggggactacgacgtacgttaaccgtacggttacgtaaccgttacgtaacgtacggttaacggaacggttaacccggaaacggaaccggtaagggtaaaccgggtacgtaagggttacccgttaacggttaaccgtttaactttaaccggtaaggtaacctaaacggtaacggtaaacggtacgtaaggaaacggtttaacgggtacttaaggtacgggtttacggggttaccggttacggggtacgggtaacgggtaacccgtaacggtaaccggtaccggtaacccgttaccggtaaacggtaccgtaaccgggaccgtaaccgggccgttacccgttaccccggtaacggg

SEQ ID NO: 202875 - DNA, 831 bp, Homo sapiens
  misc_feature: GYAE6OF02GS9JH.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttcctccccctcctcactctctgcacaggtctcgtgacggcctccgtatgacgctagaccacacgcccacccgttcggtgtcgacgtccgtcccccaggaccgacggaccggcccgaggactacgacctcggtccttacgtgacgagacgtcggactacggaaccaaaagtaaatgtactacgtttaacgttaccggtaaacccaaagaacggaaccgacccgtaaggaccccgtaaccgggtccccctggttacggttaaggtagtaactaaagtaaaacgtaaaacgtaacctacgttacggacggtaacccggtccccgtaagaagaacggtaaccgttccccggtaggaacggtaccttaaccgtttccgtacgtccggtacccgtaccgtacggtcgtacccgggaaggaacgtacgtcgtaacggtaccgttacgttacgtaacttacgtacggtacgttaacggaacgtaccgaaggtaccgaacgggacggtaaccggtagtacgttacccggtaattaccgttaccaggttaaccaagtacgtaggactaagggtaacggtacgttacgtacgttaggttacgggttacgggtaccgggtagggaaccggtaaccgtacgggtaccgttaaccgggttacccgttaacgggtacgaaccggtacccgggcccggttaaaccgggtcccgtacccccggtcccggttacccgg

SEQ ID NO: 202876 - DNA, 731 bp, Homo sapiens
  misc_feature: GYAE6OF02HAX12.21.46.E02.1.454.CMB.1.raw
  modified_base (84)..(84): a, c, t, g, unknown or other
  misc_feature (84)..(84): n is a, c, g, or t
  modified_base (207)..(207): a, c, t, g, unknown or other
  misc_feature (207)..(207): n is a, c, g, or t
  modified_base (220)..(220): a, c, t, g, unknown or other
  misc_feature (220)..(220): n is a, c, g, or t
  modified_base (241)..(241): a, c, t, g, unknown or other
  misc_feature (241)..(241): n is a, c, g, or t
  modified_base (249)..(249): a, c, t, g, unknown or other
  misc_feature (249)..(249): n is a, c, g, or t
tcagtcgtcgctcgcacgaccggtgctcgatttagactcatctacagggaaagggggtgggtccaggaggcagaactctgggtntctcaccatggcctggatcctctacttctccccctctccactctctgcacaggctctggaggtcccttcctatgagctagacgacacgccctacccgttggtgtcaggtccgtcccgaggacngtaccggcaggcnccacctgcctcgtgacaggtntcgggacncgaacaaaagtatcgtgtcttagtacggtaaccaacgaagacgcgacggccgaccggtccctggttacgttagtgtaagtaataacgtaaacgacctagtgaacggtaccggtcctacgacgacgtacgttccgtagacgtccgttacgttccgttacgcggtccgtactacggcgtacggacggacgacgactacggtcgtacgttacgactacgtacgtaggtacgaacggcgaaggtacggagtaccggacggcgtagttacgactttacgtacgtacggtactaacgtaaccgtacggtaagtacgggttaagacggttaacgttacggttagggtttgggggttaaccgggttcgggaaccggggtacgggtaaccggtacggtaaccggttacccgggtaaccggttacccggtaccggtaaccggtacccggtaccggaaccgggtttccccgccccgggttaccccgtacccgg

SEQ ID NO: 202877 - DNA, 783 bp, Homo sapiens
  misc_feature: GYAE6OF02I797K.21.46.E02.1.454.CMB.1.raw
  modified_base (109)..(109): a, c, t, g, unknown or other
  misc_feature (109)..(109): n is a, c, g, or t
  modified_base (135)..(135): a, c, t, g, unknown or other
  misc_feature (135)..(135): n is a, c, g, or t
  modified_base (138)..(138): a, c, t, g, unknown or other
  misc_feature (138)..(138): n is a, c, g, or t
  modified_base (144)..(144): a, c, t, g, unknown or other
  misc_feature (144)..(144): n is a, c, g, or t
  modified_base (520)..(520): a, c, t, g, unknown or other
  misc_feature (520)..(520): n is a, c, g, or t
tcagtcgtcgctcgcacgaccggtgctcgatttagactcatctacaggggaaagggggtgggtccaggaggcagaactctgggtgtctcaccatggcctggactccctntaccttcctccccctctcatctctcncanggctcngacgccttacctatgagctagaccacgacaccctaccgttcggtgtaccaggttccgaccccaggacgacggacggtaccgaaggtacttacccgacttcgtacgttgacggtacaggtaacgttcggaaccggtcaaccgtaaaaaaggtaacttaagcgtttaaccgtttagttaaccggaacctaaacaagggaaccacggaaccggacctaaccgggtacccttaggtacgttaaggtagtaaattacgtaaaataaaccgcgttaaggactaagggacccaccgttagaacggaactcgtcccggtaagaaccgtcgttaacttccgccgggtacgtaccgtccgtaaaggtccgtaagggaaacccggtnaaccgttcaacggggttaccctaacgggtttacgtaactaacgttcgaaggtaccgaacggtacgacggttaacgaacgggtacggacgggtgacgtaacttacgtaaacgttccgtaagaaacctaagggtacctaagggtacaaggtaacggttgaaccgtttaacgttgggtcggtaagtccgggagggaacttacgaacggttcgtaaccgtcgtactacgggactacggtaacccgacggtctaaccccggcctaacg

SEQ ID NO: 202878 - DNA, 855 bp, Homo sapiens
  misc_feature: GYAE6OF02F3WMT.21.46.E02.1.454.CMB.1.raw
  modified_base (220)..(220): a, c, t, g, unknown or other
  misc_feature (220)..(220): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggactcacctgcctntcgacagtatggactcgaaccaaaagtaaatatgtactttagttacggtaaccaaacgagaacgccgacggccacggccccttggtcgttagtcgaataataacgtaaacgacagtacggaacggtaccgtcctacgaagacgtacctacccgtaggaacgtacgttaacttccgtcggtcgggttaccgtacctaacggtccgttaacgggaaccggggtaacacggaccggttacgtacccggtaacggttacgtaacgttacgtacggtaacgggtaagtaaccggttaccggaagggacggtaacgggaaacgggtacgggtaccggtaacgtaccgttaaacgtttacgttaaccggttacgtaaaccgggtaaacgttaagggtaaacgtaacgggtaaaggttaacgggttaaccgggtttaaccgttacgggtttaaacgggtttacgggggtttaccggggttacccggggggtaacggggttaaccggggaacccggttaaacggggttacccggtttaacccggggtaaccccggtttaccgggttaaccggggtaccgtaaccggggaacccggttaaccggggttcccccggttaccccgggtaccccccggtttacccggg

SEQ ID NO: 202879 - DNA, 800 bp, Homo sapiens
  misc_feature: GYAE6OF02GUWKM.21.46.E02.1.454.CMB.1.raw
  modified_base (157)..(157): a, c, t, g, unknown or other
  misc_feature (157)..(157): n is a, c, g, or t
  modified_base (180)..(180): a, c, t, g, unknown or other
  misc_feature (180)..(180): n is a, c, g, or t
  modified_base (230)..(230): a, c, t, g, unknown or other
  misc_feature (230)..(230): n is a, c, g, or t
  modified_base (241)..(241): a, c, t, g, unknown or other
  misc_feature (241)..(241): n is a, c, g, or t
tcagtcgtcgctcgcacgaccggtgctcgatttagactcatctacagggaaagggggtgggtccaggaggcagaactctgggtgtctcaccatggcctggatccctctacttctccccctctcactctctgcacaggtctctgacggcctctatganctagacacatcccaccgtggtanccgagtccgaccccgaggaccgaggaccgtaccgaaggactcctaccggntactcgtcganagagttacggactacgaaaccaaaagaacttagcgtactttaacgttacgggaaacccaaaggaagaaccggtaccacgggtacggtaaccggttaccccgttgggtttaaaggtttaggtagtaaaagtttaacgtaaaacgtaaaaaccgtacccgaccgaagggtaaggttacccggtacccctaaagaacggttacccggaactttcccgaacggtaagggtaccttaccgttaaccggtcgttaccgggaccttaacccggaaggtccgtaaccgggaaacggggttacaaccgtacgttaaccgggtactaacgggttgaaacttacgtacgtaacgttaacgaaccgtacggaacgtacggaacgtaacgggacggacgtacgtacgtaacttactaagtactaaacgacgtaaacgtataagtgtaaacggttacgtaacgttagttacggttagggttacggtcgggacggtaacggacgtaaggtaccgtacggtacctacgggtactaccgtacggaccgtaacggcccgtacggtccccgttaccgg

SEQ ID NO: 202880 - DNA, 908 bp, Homo sapiens
  misc_feature: GYAE6OF02HMKBX.21.46.E02.1.454.CMB.1.raw
  modified_base (130)..(130): a, c, t, g, unknown or other
  misc_feature (130)..(130): n is a, c, g, or t
  modified_base (157)..(157): a, c, t, g, unknown or other
  misc_feature (157)..(157): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctcngcacgagctctggacgtcctctatganctgacacacgccaccgtcggtgtcagtccgtcccgaggacacggaccgcaaggctccacctgctctgacagtatcggaacgtcgtaaccgaaaagtaattacgtgttacgttacgttaacggtaaccaaacggacgaaaccggaccgaaccggtaccccggtacgggttcccccgttagggtttacggttaggtaccttaagttaacgtaaaacgttaaaacggacctaacggtaggaacggtaccgggtaccccgttagaacggtaacgtacccgttacccgtaggtaacgttccggtaactttacccgccggttcggttaccccgtaccgtaccgtacggttaacgggaaacggggtacctacggtaaccgggttaccgttaacggggttaacttaccggtaacgtttaacgtaccggttaaagggttaacggtaacccgggtaaccggtacggggtaacggtaaccggggaaacggggtaaccggtacggttaccgtttacgaaactttacggtttaacgtaccggtaaacccgaaagttacggtaaaaccgtacggtaaagggttaccggtaagttttacccgttaacgggttacgggtttaccggggttaggttacccggggtaacgggtaacggtaaccgggaaccgtcgggttaaaccccggtccggttaaccggggttaccggtaccggtaaacccgggtacccgtaacggggtccccttacccgggttacccccgttccggg

SEQ ID NO: 202881 - DNA, 615 bp, Homo sapiens
  misc_feature: GYAE6OF02JHSPG.21.46.E02.1.454.CMB.1.raw
  modified_base (165)..(165): a, c, t, g, unknown or other
  misc_feature (165)..(165): n is a, c, g, or t
  modified_base (176)..(176): a, c, t, g, unknown or other
  misc_feature (176)..(176): n is a, c, g, or t
  modified_base (244)..(244): a, c, t, g, unknown or other
  misc_feature (244)..(244): n is a, c, g, or t
  modified_base (371)..(371): a, c, t, g, unknown or other
  misc_feature (371)..(371): n is a, c, g, or t
  modified_base (392)..(392): a, c, t, g, unknown or other
  misc_feature (392)..(392): n is a, c, g, or t
  modified_base (449)..(449): a, c, t, g, unknown or other
  misc_feature (449)..(449): n is a, c, g, or t
  modified_base (524)..(524): a, c, t, g, unknown or other
  misc_feature (524)..(524): n is a, c, g, or t
  modified_base (556)..(556): a, c, t, g, unknown or other
  misc_feature (556)..(556): n is a, c, g, or t
tcagtcgtcgctcgcacgaccggtgctcgatttagactcatctacagggaaagggggtgggtccaggaggcagaactctgggtgtctcaccatggcctggatccctctacttctccccctctcactctctgcacgaggctctgaggcctcctatgagctgacacngccacctggtntcagtcgtcccaggcagaccgcagactccacctgcctagtgacagagtcggactacgacaaagaatgngtacttagttacggtaaccaagagaacgtccgacggaccgacggtacccttgttacgttacgtacgtaatagttaactaacgaccacgtaggacgacggtacctagacgacgtacctccgtagacgntacttcgcgtacgctacgacncgtacgtagactacgctacgtcgtacgttagcttagctacgacacgtccgaagacgnggtaacggacgtagtctacgttaactctaacgtacgaactaaacgtgtacaacgtacggtagtacgttacgtagngtttacggggtcgaccggtacggaggtaaccnggtaccgtacgtacgtacggttacgacgaccggtacgtacgtccgaccgtcccgtaacg

SEQ ID NO: 202882 - DNA, 822 bp, Homo sapiens
  misc_feature: GYAE6OF02H8NYW.21.46.E02.1.454.CMB.1.raw
  modified_base (268)..(268): a, c, t, g, unknown or other
  misc_feature (268)..(268): n is a, c, g, or t
tcagtcgtcgctcgcacgaccggtgctcgatttagactcatctacagggaaagggggtgggtccaggaggcagaactctgggtgtctcaccatggcctggatccctctacttcctcccctcctcactctctgcacaggctctgacggccctcctatgacgctgacacagcccacccgttcggtgtcagtcgtccccaggacacggaacggtccaggatcacctgccttctgcaggtactacgggactcgaaacctaaaagtaaaattntcggtactttaacggttacggtaaccaaagaacggaacgtccgaacgaccccgaacgggtccccttaaggtcgttaagtcggaaactttaataaacgtaaagactaaccttgggacacggtaccctatagacgttactcccgtagaacgtcgtaacctcgtttacctggtacctccgaacgttccggtacggaggaactaacggtaccgggttactaccgtacggtttacgtaaccttaagtaaccggtacgttaaggtaaacggtaccggtacgaaccggaacggaacggggtacggaacgggtaccgtacgtaacgttaaccgttaccgttaactaacggtaaaccgtaaacggttaacggaaccggtaagtaaaccggttaacggttaccgttaacggttagtttaaggggttcggttaaccgggacggggttaaacccgggtaacggaacgttaccggtaccggttaacccggtaccggttaacggttacccggaacccggtaacccggtaaccggtacccggttaccccgttacccccggttaacccgg

SEQ ID NO: 202883 - DNA, 820 bp, Homo sapiens
  misc_feature: GYAE6OF02FJPC1.21.46.E02.1.454.CMB.1.raw
  modified_base (239)..(239): a, c, t, g, unknown or other
  misc_feature (239)..(239): n is a, c, g, or t
tcagtcgtcgctcgcacgaccggtgctcgatttagactcatctacagggaaagggggtggtccaggaggcagaactctgggtgtctcaccatggcctggatccctctacttctcccctctcactctctgcacaggctcgtgaggccttcctatgacgctgactacacgacccacccgttcggtcgtacctagtcgtaccccgtaggacgacgaccggtccaaggtactccctacgttcncccgttacgtcgtaccaggtaacgtcggaccgttagaacccgtaaaagttaaacttgttacgttactttaacggttacggttaaaccaacgaacggaacgccgtacgacccggacggtcccctaggttacgttagtacgttacgtaaacgttaacgtaaacgtactacgtacggacgtaccggtcccgttacgaacggtaactaccgtaccggtacggtacgttaccgtttaaccgttccttaccggtccggtacctaccggaacgtcgtaacgggacgtacgacgtacgtacgtaccgtacggtttacacgttaacgtacgtaggtacgacgttccggagtacggtaacggacgggtacgtacgtacgtacttacgttacgtacgttaactaacggtaccgtaaagttaaccggaacggtaacgttaaccgggttaacgacggtttaacgttcgggttaacggggtttacggtaccgggaccggtaaccggtacgaaccggttaccggtaccggttaccgtttaacgaccgggttaccgacgggtaacccgttacggaccgttcccgtacccgtacccgg

SEQ ID NO: 202884 - DNA, 765 bp, Homo sapiens
  misc_feature: GYAE6OF02IVHTF.21.46.E02.1.454.CMB.1.raw
  modified_base (247)..(247): a, c, t, g, unknown or other
  misc_feature (247)..(247): n is a, c, g, or t
  modified_base (454)..(454): a, c, t, g, unknown or other
  misc_feature (454)..(454): n is a, c, g, or t
tcagtcgtcgctcgcacgaccggtgctcgatttagactcatctacaggggaaagggggtgggtccaggaggcagaactctgggtgtctcaccatggcctggatccctctacttcctccccctcctcactctctgcacgaggctctgacggcccttcctagtgagcctagaccacgacgccccacccgttcgggtctcgacggtccgtaccccgagggaccacggaccggaccaggtactccacgtcnctcgtagcgacgtagtacggtactacgaacgaaagtaagtacgtacgtacgttagttaccggtaaccaagaacggacgaccgacggaccgtacggtacccgttaggtaggttacgtagtaattaaacgtaagtaaacggacctaaggtacggacggtaaccgcccgtaacgaagacgtaccgtaccggtagacgtacgtacgtttcncggtacggccttaccgcggtactaccggacggacacgtacgtacgtacgtcgttacgactacgtagaacggtacggacgtacgaggacgtaacgggacgtaccggacgtacggttactacgttaccgttcgtaaacgtacgtaaagtaacggacgttacgtaagtaacggtaacgttacgtcggtttacgggttacgggtaccgggttacgggacgggtaacgggaaccggtcggttaccggacggttaccggtacggacggttacccggaccgtacccggtacggacccggtacccggtcccgtaaccgg

SEQ ID NO: 202885 - DNA, 778 bp, Homo sapiens
  misc_feature: GYAE6OF02GJ290.21.46.E02.1.454.CMB.1.raw
  modified_base (142)..(142): a, c, t, g, unknown or other
  misc_feature (142)..(142): n is a, c, g, or t
  modified_base (183)..(183): a, c, t, g, unknown or other
  misc_feature (183)..(183): n is a, c, g, or t
  modified_base (428)..(428): a, c, t, g, unknown or other
  misc_feature (428)..(428): n is a, c, g, or t
  modified_base (492)..(492): a, c, t, g, unknown or other
  misc_feature (492)..(492): n is a, c, g, or t
  modified_base (540)..(540): a, c, t, g, unknown or other
  misc_feature (540)..(540): n is a, c, g, or t
tcagtcgtcgctcgcacgaccggtgctcgatttagactcatctacagggaaagggggtggggtccgaggaggcgagaactctgggtgtctcaccatggcctggatccctctacttcgtccccctcctcactctcgtgccagngctctggacggtccctcttaacgtgacgtctagaccgaacncgtcccacccgttccggtctacccgagttccggacccccgggaactaacccggaccgtgacgttaccacccgtgtacctgtcgggaatgttgcccgtattacggaaccaaaaaggtattacttaaccggttgtttcccgttaacgacgtacgaaggtacggccaacggccccgtacggcccccgtttatccggttaaggcctacgactcggtagaaccgcgtagtaccgacccgagaccgtccgngttacccgagaacgagtaacgtttcccgtcgtaccgcccctacggtacgagttacgtaccgggnggtacttacggtccccttaaacgttaccgacggttactaacccggggngggttaccggggaccgtacgggtgaaaccggttggcgtaaacgtcggttactaaccgtattaacgttggttaccacgtaactagacgtacgtaggttcgatccgggtaaagtccgggtacggtcgggtaacgtccggtacggtacgtacgttaccgtccgggttagtcccgggaacgtccgtacgtccgtcccggtacccttccggaacgtcccggtcgttcccgttacccggtcccg

SEQ ID NO: 202886 - DNA, 763 bp, Homo sapiens
  misc_feature: GYAE6OF02FF5PS.21.46.E02.1.454.CMB.1.raw
  modified_base (230)..(230): a, c, t, g, unknown or other
  misc_feature (230)..(230): n is a, c, g, or t
  modified_base (251)..(251): a, c, t, g, unknown or other
  misc_feature (251)..(251): n is a, c, g, or t
tcagtcgtcgctcgcacgaccggtgctcgatttagactcatctacagggaaagggggtgggtccaggaggctagaactctgggtgtctcaccatggcctggatccctctacttctccccctctcactctctgcacaggctctgaggcctcctatgacgctgacacagccacccgtggtgtcagtcgtaccccaggtacacgacggccaaggatccacctgctcgtgcagncggactcgtacaaagtaactntagtactttagtaggtaaccaacgtacgaacgaccgacggacccgaacggtccccccgttaggttacggttaacgtacggtaattaacgtaaacgttaaaacggaacctaccggttagacggtaacggtccctacgaagacgtacgtaccccgtagacggtaccgtaactttccgtcgtacggtcctaccgtacgtaccgttacgaacggggaaccacggtttaccggaacggtttacccgtaacggtttaccggtaactttaacgtaccggtaccgggttaaggtaaacccggttacccggtaacggggaacgttaacggggaacgggaaccggtacgggtaacgtaccggtaacgtttaacgtaccgttagtaacgtaaaccgtagtaacgtacgtaagtaggtaacgtactacctaagttcggtagttacggtacgaccgggtagaaccggtaagccggtaacgtaccgtacgttacgacgtaccggccgaacgtcgtacccgtcccgg

SEQ ID NO: 202887 - DNA, 737 bp, Homo sapiens
  misc_feature: GYAE6OF02FTG5O.21.46.E02.1.454.CMB.1.raw
  modified_base (176)..(176): a, c, t, g, unknown or other
  misc_feature (176)..(176): n is a, c, g, or t
  modified_base (192)..(192): a, c, t, g, unknown or other
  misc_feature (192)..(192): n is a, c, g, or t
  modified_base (247)..(247): a, c, t, g, unknown or other
  misc_feature (247)..(247): n is a, c, g, or t
  modified_base (397)..(397): a, c, t, g, unknown or other
  misc_feature (397)..(397): n is a, c, g, or t
  modified_base (703)..(703): a, c, t, g, unknown or other
  misc_feature (703)..(703): n is a, c, g, or t
tcagtcgtcgctcgcacgaccggtgctcgatttagactcatctacaggggaaagggggtgggtccaggaggcagaactctgggtgtctcaccgatgggcctggactccctctacttcctccccctctcacctctctgccacaggctctgacggtctcctaagtgagcgtgaccacncgcccaccgtcgggtntccagtccgtacccgaaggacacggaccggccaaggtctccaccgtgtccttcgngaccgagtcgtacggactaccgaaaccaaaaagttaattcgtaggttactttacgttacggaaaccagaacggaacgccgacggtaccggacggttccctagttcggtagtataagtaactaacgaacgtcgagtacggacgtcgacccngtacgacgtacctccggatacggagttacttccgcgtccggtaccctaccgacggtactaccggaacgggtacaacggtaccgtacgtccgtaacgttagacctttaacggaccgtagggtaacgacggtacggacgggaacaagggacggaacgtcggtgttaacgacctttacgtacttaaacggtaacgaacgttagaccggttaaggagttaaaccggtacgtttaacggtacgttacggggtttccgacgggtcggggtacggaacgtccggaacgtccggttaccggacggtacgtaacncggaaccgtccgacttcccggccttcccgtaacg

SEQ ID NO: 202888 - DNA, 820 bp, Homo sapiens
  misc_feature: GYAE6OF02IMEF9.21.46.E02.1.454.CMB.1.raw
tcagtcgtcgctcgcacgaccggtgctcgatttagactcatctacagggaaagggggtggtccaggaggcagaactcgtgggtgtctcaccatcggcctggatccctctacttctcccctcctcacctctctgcacaggctctggaggcctcctatgagctagacactacgccacccgtcggtgtcagtcgtaccccgaggacacggacggccgaggactccgacctcgctcgtcgcgtagacgtaggtactcgaaccaaaaggtaactattacggtactttaacggttaccgtaaccgtaaacgaacgaaccggaccgacggaccgaaccgggtcccgttggtttaccggttagtacggtacttaaattaaacgtaaacgacgtacgtacggacggaccgtcctacgaacgagtacctaccgtggtacgtacgttgttacctcggtacggtcctacgacggtccgtaacggagggtaccaggtacgtaccgtcgttaacggttacgtaaccgttataacgtcgggtaaccgtaaacgtccggaacggtaacggaacgggtaacgggaccggtaaggttccgttaacgtaaaccgtttacgttaacggtaacgaaaccgttaaagaacggtaacggtaaccgtaaggttaaccggaacgttactttcggggttacggtttaccgggggttcgaccgggggtacgggaaacgggtacccgtaaggtacccggtcccggttaaccggttacccggtaaacggtacccggtacgggtaacccgttacggggtccccgttaccccggtaccccggtttaaccgg

SEQ ID NO: 202889 - DNA, 828 bp, Homo sapiens
  misc_feature: GYAE6OF02HJYIV.21.46.E02.1.454.CMB.1.raw
  modified_base (107)..(107): a, c, t, g, unknown or other
  misc_feature (107)..(107): n is a, c, g, or t
tcagtcgtcgctcgcacgaccggtgctcgatttagactcatctacagggaaagggggtgggtccaggaggcagaactctgggtgtctcaccatggcctggatccctntacttcctccccctcctcactctctcgccacaggctcgtagacggtccgtaccctaatcgaagtctgaccacacgccctacccgttgggtcgtaccaggttccgtcccccgtaggaccacgggaccggcccgaggactcacccgtgcttccgtggctagtagtcggtacctcggaaaccctaaaagtaaaagttacttaggtaaccgtttaagtttaccgggttaacccaaaaccgttaacgaaaccggacccgacggaaccccgtcccgggtccccccttgggttaggtttaacggtaaggtaactttaaagtttaaaacgtaaaacggtaccctaacggtttacgggaaacgggacccgggttacccctaacccggaaggtaccgtaaccgttcccccgttacggaacggtaccgttaacgtttccgttccgttacgggtccctttacccgacggtcccgtaacgggtaacggacgacggtaccgtacggtaccgtaacgtttacgacttacgtagtaacgggtcgaaccgtccggaaggtagtacgggacggacgtaaggtccgtagtaacgtatttaccgattaacgaacgagtaaggactaaggagtacggtacttaggtggttagggttcgtacgggacgcggaaccgtacggccgttaggaccccgttgtaacgggccaacggtcccgacgtacccgtccccggccctacccgg

SEQ ID NO: 202890 - DNA, 825 bp, Homo sapiens
  misc_feature: GYAE6OF02I55IQ.21.46.E02.1.454.CMB.1.raw
tcagtcgtcgctcgcacgaccggtgctcgatttagactcatctacagggaaagggggtgggtccaggaggcagaactctgggtgtctcaccatggctggatcctctacttcctcccctcctcactctctgcacaggctctgacgcctctatgagctgacacacgcccaccctcggtgtcgagttccgtaccccgaggacacggtaccggccgaacggtactcctacctcgtcttctggactagacgtcggaacgtcggaaccaaaaaggtaaactagttacgtacgtttacgttacggtaaccaaacgacggaacgaccgaggtacccgcggtaccccgttggttagttacggttagtaacttaataactaaaggtaaccgtagtacggaacgacgggtccctacggacgtaacggtaccctacgtaccggtacggtaccgttactttacgttcgtccggtaccgttccgaacggttcctaacggaacgggtacctacgggacgttacgtacgtacgttaacgacttacgtacgtagtacggaacgtaccggaggtaccgtaagggacggaaggtacggacttacggtactttacgttacgtacgtaactaaacggacgtacgaaacgttgaacggttaaccggttacgttacgggttaaggttttaccggggttagttacccgggggtacgggttaacgggttaaaccgtcggggttaacccttaaccgggtaaccgggtttaaccggaaacggtttacccgaaccgggtaaccccgggtttaacggtccccgttccccccgggtttaacccgtttaccccggg

SEQ ID NO: 202891 - DNA, 826 bp, Homo sapiens
  misc_feature: GYAE6OF02IW33S.21.46.E02.1.454.CMB.1.raw
  modified_base (694)..(694): a, c, t, g, unknown or other
  misc_feature (694)..(694): n is a, c, g, or t
  modified_base (705)..(705): a, c, t, g, unknown or other
  misc_feature (705)..(705): n is a, c, g, or t
tcagtcgtcgctcgcacgaccggtgctcgatttagactcatctacagggaaagggggtggtccaggaggcagaactctgggtgtctcaccatggctggactccctctacttcctccccctcctcacttctcgtgcagaggtctactgacggtcctctatgacgctagaccactacgcctacccgtggttacgtcaacggtccgtcccgaaggacaggtaccggcgtaaggactcgtccgtcgacttcgacgacgtaggacgttcggacttgaaaccgaaaaataacttgtaacttgttacgtaccggtaacaaacgtaacggtacgaccgtaacgcccggtaaccggtcccttagggttccgttaagttacggtaattaacgggttaaaactacggtaaccgtaacggtacggtaaacgggtacccggtaccggtaaaccgaggggttaaaccctacccgttacccgggttacggtaaccgtacggtttaaccctttccggaaccgggttccggtaccgttaaccccgtaaggtccgtaacgggtacccggtaaaacgccgggtaacttaacccggtttccgttaaacctaggttaacgtaacccggttaaaggtccgtaacgtaaccggtacgaacggtaacggacgtaacggacggaacgttgtaaccgtagttaaccttcgtaacgtaacncgtaacgtaanacgtaagtacggtacgtaggtttcgtaggtgggttcgtaccggacgggtacgacggtcgtaacgccggtaacgtcgttaccgtacgtccggaaccgttacgtcccgtaccggtcccgtacg

SEQ ID NO: 202892 - DNA, 725 bp, Homo sapiens
  misc_feature: GYAE6OF02H99CY.21.46.E02.1.454.CMB.1.raw
  modified_base (277)..(277): a, c, t, g, unknown or other
  misc_feature (277)..(277): n is a, c, g, or t
tcagtcgtcgctcgcacgaccggtgctcgatttagactcatctacagggaaagggggtggtccaggaggcagaactctgggtgtctcaccatggcctggactccctctacttcctcccctctcactctctgacacgagctcgtgacggcctcctatgagctagaccagcgtacctaccgtcggtcttcgaggtccgtacccgaggacgacggaccggcgaacggctaccaccgtgccttcgcgactagtgtcgacgtacgaacgtaaacgtattcgngtactttacgttacggtaccaacgagacgctacggccgtacgtcccgtgtagttcgatataagtaacgtaaacgcgacgtacgtacgaccgtcctacgagtcgtacctcgtagacgtcggtacttcgtacgtcggtactacgtcgacgtacggacggactacggtacggtactcggtacgttaacggtactacggtaccgttagggtacgtaacggacggtaccggtaacggtaacgcgggtacggtaaccgtggtttaacgttacttaacgtttacgaacgtaagaacggttaccgtaagaccgtaagggtcgtaacgtttcggacgttaggtcgggttacgacggtaccggaaggttacggtaccggtacttaaccggggtccgtaacggttccgacgttaaccgggtactaccgggttccccgtaccgggttacccgtttacggg

SEQ ID NO: 202893 - DNA, 782 bp, Homo sapiens
  misc_feature: GYAE6OF02HPJ2L.21.46.E02.1.454.CMB.1.raw
  modified_base (106)..(106): a, c, t, g, unknown or other
  misc_feature (106)..(106): n is a, c, g, or t
  modified_base (136)..(136): a, c, t, g, unknown or other
  misc_feature (136)..(136): n is a, c, g, or t
tcagtcgtcgctcgcacgaccggtgctcgatttagactcatctacagggaaagggggtggtccaggaggcagaactctgggtgtctcaccatggcctggatccctntacttcctaccccctctcactctctgcacncggctctggacgtcctctagtgacgtctacgacacgacgacccgtaccgtcggtagtactacgtccgtaccccgaaggacacggccgacgaggtactccgtacgtcgtacttccgtagactagtaacggtacgtaccgtacgaaactaaagtaatctacgttactttaacggtaacgaacctaacgaacgtacgaccgtaacggccgacggttccgttaggttacgttaagcgttaaatacgtaaacgtaaacgtccggtaattacgggacgtaccggtccctacggaacgtacgttacccctcggtagtccggtacgtacttcccgtaggtaccgtcctaccgtacggtacgtaccgggtaggacctgggtaaacctttcggtactaacgggttactaacgtacgtaacggtacggtaacgtaccggtcgaacggtacggacggtacgtaacggacggttactacggttaactttagactaaccggtaagtaaccggagtaccgaagtaacgtacggttaaccgttacgtacggttagtcggggttacggaccgggtacggtaaccggaccggtacgtccggtaacgtccgttaacggtacgaccggtaccgaacccggtaggtaccccgtcccgtacccgtccg

SEQ ID NO: 202894 - DNA, 793 bp, Homo sapiens
  misc_feature: GYAE6OF02FMD0Q.21.46.E02.1.454.CMB.1.raw
  modified_base (186)..(186): a, c, t, g, unknown or other
  misc_feature (186)..(186): n is a, c, g, or t
  modified_base (235)..(235): a, c, t, g, unknown or other
  misc_feature (235)..(235): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctagacggcctcctatgacgctacgacacacgcccacccgtcggtntcagtcgtccccaggacaggaccggccaaggacttccaccgtgccttcngaccagtagtcggtactacgaaccgaaaagtaaacttactgttaaccgtttaagtttaccgggtaaacccaaacggtaacggtaaccggccccggtaacgggtaccccgaaccggggtccccctttaggggttaggtttacggtacggtaaagttaacgttaaaacgtaaaacgtacctaacgtagggaacgggaccccggtacccgtagaaacggtaccggttaccttaccccggagggtacgtaccgttactttacccgtccggtttcgggacccttaccggaccggtctacgggacggtaacgactacgtacgtactacggtgtaactatacggagtacggactcgaggacaggacggcgacgcgttacgtacttagtacgtacgtaacaacgtcgtaactacggtaaggtacgtaaccgggttctacgtagggtttagggtccggggttaaccgggcgggaacgggtaaccgtacggtccggttacggtaacccgggttaccgtacgaccggacccggtacggacccgggtcctaccccggtaccccggtaccg

SEQ ID NO: 202895 - DNA, 737 bp, Homo sapiens
  misc_feature: GYAE6OF02F8WLF.21.46.E02.1.454.CMB.1.raw
  modified_base (225)..(225): a, c, t, g, unknown or other
  misc_feature (225)..(225): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgacggcctcctatgagctgacacacgcccaccctcggtgtcagtcgtccccgaggacgaggacggccgaggactcactgctcngcagagtcgactcgaaccgaaagtaatagtcgtactttagttacggtaaccaacgaaggaacgaccgtaacggaccccgtaaccggtcccccgttaggttcggtttaagtcgtaaattaagttaaagttaaaacgaccgtaacgtacggaacggtaccggaccccttacggaagtaacgtacctacccgtagaccgtcgtactttcccgtacgtcggtcctacgtacgtcgtacggtacgggaacacgtcgtaacggtaccgtaacgggttactaacgttacgtacgtaacggtacgtaacgttaccggacgacggtaagggaacggacggtacgtacgtacgtacttaatacgtacaagtaacgtaggtaacgaacgttaggtaaggtacgtaactacgtaggttcggtagggttacgggacggtacgaaccgtacgtccggttacggtacccttacgggtaccgtacgacccggaaccggtcgggtacccgtcccggtaccccgttacgg

SEQ ID NO: 202896 - DNA, 700 bp, Homo sapiens
  misc_feature: GYAE6OF02HF0E6.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttcctccccctcctcactctctgcacaggctcgtgaggcctctatgacgctgaccacacgccctacccgtcggtagttccgaggttccgtccccgaaggaccgacggaccggcccgaaggacttaccacccttggacctccgtaggacacggtagtacgggacctacggaaccaaaagtaaactagtgttacttaagttacggtaaccaaacgtaagaacgaccgacggacccgaccggtccccgttggttacgttacgtagtaataataaacgtaaacgacctacgtacggaacgtaccgcccgtagagtaccgacgtccgtagacgtcgtacttcgtacgtcggctaccgacgcgtacgacggtacacgtacgacgtacgtcgtacacgttgacgtagtagacgtacgagacgaggaacgacggagtacgtacgtattacgtacgtacgtaacgaacgtaagaacgacgtaagtacggtaagtaaccttggtaagtcgggttagacggggtaccgaacggtacggaacgtctaacggaccgttagtacggtacctaccgacggtaccgtaccggtccgcccggtaccg

SEQ ID NO: 202897 - DNA, 806 bp, Homo sapiens
  misc_feature: GYAE6OF02G9W6B.21.46.E02.1.454.CMB.1.raw
tcagtcgtcgctcgcacgaccggtgctcgatttagactcatctacagggaaagggggtgggtccaggaggcagaactctgggtgtctcgaccatggcctggatccctctacttctcccctcctcactctctgcacaggctctgaggcctctatgagctgacacacgcctacccgtggtgtacgagtcgtaccccaggaccagaccggccgaggactccacctgctctgcagctcggactcgaaccaaaagtaactagtcgtactttagttacggtaaaccaagacggtaacgaccgtaccggacccgaacggttcccccgttaggttacggttacggtacgtaacgttaacgtaaagtaaacgaacctacgtagggaacgtaccggtaccctaggaacggtacgtaaccgttacccgaggtaagtaccgttactttaccgttccggcggttacctacccggtaacgtccgttaacggaacgggaaccacggtactacgggttcctaaggttcgaacgttacgtacggtaacggtaacgaaccggttaccggaagggtacgaacggggtaacggtacggacgggttacttacgggttaaaccgttagtaccgttaacgtaaccgaaacgttacggttaacggaaccgttaagggtaacgtaacgttacgtaacggttaacggtttcgggtaacggttacggggacggtaaccgggtaccgaaacgggtccgtaccgtaacccggttacgtacggtaccgtacgggtaacccggaccgggttccctacccgggttaccccgtaaccgg

SEQ ID NO: 202898 - DNA, 206 bp, Homo sapiens
  misc_feature: GYAE6OF02ICJ30.21.46.E02.1.454.CMB.1.raw
  modified_base (108)..(108): a, c, t, g, unknown or other
  misc_feature (108)..(108): n is a, c, g, or t
  modified_base (145)..(145): a, c, t, g, unknown or other
  misc_feature (145)..(145): n is a, c, g, or t
  modified_base (154)..(206): a, c, t, g, unknown or other
  misc_feature (154)..(206): n is a, c, g, or t
tcagtcgtcgctcgcacgaccggtgctcgatttagactcatctacagggaaagggggtggtccaggaggcagaactctgggtgtctcaccaatggcctggatcccctntacttctccccctctcactctctgcaacagctctagnggtccctannnnnnnnnnnnnnnnnnnnnnnnnnnnnnnnnnnnnnnnnnnnnnnnnnnnn

SEQ ID NO: 202899 - DNA, 704 bp, Homo sapiens
  misc_feature: GYAE6OF02GJI0J.21.46.E02.1.454.CMB.1.raw
  modified_base (229)..(229): a, c, t, g, unknown or other
  misc_feature (229)..(229): n is a, c, g, or t
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgaggcctcctatgagctgacacagcccacccgttcggtgtcagtcgtccccgaggacagacggccaggactcacctgctctgcaganggactgaccaaaagtaaatatcgtactttagttacggtaaccaacaaggaacgccgaggcccgaacggtccccttggttagttagtagtaattataaagtaaacgacacgtaggacggacggtccctagagacgtctccgtggacgtcgtactttctcgtggcctacgacgtctacggaggacacgctagtccgtacgttagacttagtcgtaggtacgaacggtccgaaggcgaagggacgggacgacgggtctaggtaacttagttacgtagtacaaacgtgaacgtacgtaggtaagtacgttacttaggtaagggtttcgggagggtttaccggggacggggtaaccggaccgttaacgggacccggtttaaccgggtaccccgggtttaaccgtaccggggtacccgtaacccgggtaaccccgggaacggggtttccccgttacccccgggtaccccccgggttaccgg

SEQ ID NO: 202900 - DNA, 780 bp, Homo sapiens
  misc_feature: GYAE6OF02I6S1V.21.46.E02.1.454.CMB.1.raw
  modified_base (507)..(507): a, c, t, g, unknown or other
  misc_feature (507)..(507): n is a, c, g, or t
tcagtcgtcgctcgcacgaccggtgctcgatttagactcatctacagggaaagggggtgggtccaggaggcagaactctgggtgtctcaccatgggcctggatccctctacttctcccctctcactctctgcacaggctctgacggtcctctatgacgctgacacagcccacccgtggtacgtcacggtccgtacccaggacgacgaccggccacgggacttcgacccttggcctctaggaccgaggtacgtggtacctacggtaacccaaaagtaaacgtcgttacgttacgtttaacgtacggtaacccaaacgtacggaaccggaccgtacggacccgtaccggtcccgttacggttacggttagtaagtaacttaaacgtaacgtaaacggactacggtagggaccggtaccggtacccgtacgacggtacgtaccgtaccgttaggaccgtacgtacgttcccgtacgtaccggtcctaccgtacgcttacggacggtaccngtacgtacggtacgtacccgtagtaccgtacgtacgtaacggtacgaccggtacgaacgggacgtacggaacggtaccggtaggttacgtaccgttacgttactaacgttaacgacgaaacgttaagacgtacgtaggttacgacggttacgtacggttacggttacgggttacgggtacggaccggtacggaccggtaacggtccggtaaccgtaccggttacgacggttaccgaaccggtccggtacgtcccggtacccgtaccggtaccg

SEQ ID NO: 202901 - DNA, 826 bp, Homo sapiens
  misc_feature: GYAE6OF02GPVRV.21.46.E02.1.454.CMB.1.raw
  modified_base (165)..(165): a, c, t, g, unknown or other
  misc_feature (165)..(165): n is a, c, g, or t
  modified_base (432)..(432): a, c, t, g, unknown or other
  misc_feature (432)..(432): n is a, c, g, or t
tcagtcgtcgctcgcacgaccggtgctcgatttagactcatctacagggaaagggggtagggtccgaggaggcagaactctgggtgtctcaccatgcctggatccctctacttctcccctcctcactctctgcacaggctctgacggcctctatgagctgacacncgtaccacccgtggctcagtccgtaccccaggaccaggaccggaccgaaggactccgaaccttgcccgttgtcgccgaagtagtcggactacgaaccgaaaaagtaaagtctaggttacttaacgtacggtaaccaaagtagaaaggccgtaacggcccgtacggtcccccttagggttagttacggtacaagttaataaactaaacgggaacctaacggtggaacggtaccgtaccccgaagaacgtacggtaacctacccgggtnaacggtctaactttcgttacccgaggttcccctaagacggtttaccgaacggaccgggaaaagtccaacgttcggttacctaaacggttaacgtaacgttaacgtttaacgagggtttaaaccgtaacggtaccggaaacggacgtaacgggaacgggttaaccggaacggttaccgtaaaccggttaaccgtttacttaaacggtaacgttaccgaaaaccggttaagaacgttacgtaaacggtacgaacgttacgttaccgtaaggttacggggttacggtaaccgggcgggtaaacggccgtaacggcgtaaaccgggttacccgtacggttaacccggcgtaacccggaacccggtaacggtcccggttcccccgtaccccggttacgg

SEQ ID NO: 202902 - DNA, 912 bp, Homo sapiens
  misc_feature: GYAE6OF02JBPNG.21.46.E02.1.454.CMB.1.raw
  modified_base (611)..(611): a, c, t, g, unknown or other
  misc_feature (611)..(611): n is a, c, g, or t
tcagtcgtcgctcgcacgaccggtgctcgatttagactcatctacagggaaagggggtgggtccaggaggcagaactctgggtgtctcaccatggcctggatccctctacttcctccccctcctcactctctgctacaggctctgaggcctactatgagctgacacacgcccacccgtcggtacgtcacggtcgtaccccgtaaggaaccgaggaaccgggccctaacgggtaactaccgtacccgttcgccttcccgtaggccgaaggaacgttcgggtacctacgggaaacccaaaaagtaaaactacgtacgttacgttttaacgtacggttaacccaaaacgaaacggtaaaccggaccgaacgggtaccccgtacccgggttacccccgttagggttttacggtttaaagttacggtaaacgtttaaacgtaaaaccggtttaaaaacgaaccgttaaccggttaaggaaaccgggtaaccgggttacccccgttaacgaaggggtaacggttaccttccccggtaaggtacgccggtttaacggttttaccctcgttacgggtaccttccgaacgggtccgttacggaacggggaccgttaaacncccggttaacgtaaccgttaggtttaacggatttaacgacggtaaacgttaccggaacgtcccggtaaagaccggaagggtaccggaacgtacggtcttacgtaactacgtttacgtcgtaaacgaaacgtcggacgtaacggtacgtacggttaacggtacctacggtaaggttttccggggagttacggggtaccgggtaaggacccggtaaggttccgtaacccggttaccgggttaccgtacggttaaccctacccgggcgttaacccggcccgtttacccggacccccttaccggg

SEQ ID NO: 202903 - DNA, 764 bp, Homo sapiens
  misc_feature: GYAE6OF02IK4Z5.21.46.E02.1.454.CMB.1.raw
  modified_base (181)..(181): a, c, t, g, unknown or other
  misc_feature (181)..(181): n is a, c, g, or t
tcagtcgtcgctcgcacgaccggtgctcgatttagactcatctacagggaaagggggtgggtccaggaggcagaactctgggtgtctcaccatggcctggatccctctacttcctccccctctcactcctctgcacagctctgacgcctcctatgacgctgacacacgcccaccgttggtntacgtaggtcgtaccctaaggacacggaccggcaggctaccacgtcgcttcgtgacgaggtactcggactaccgaacgaaaagtatcgtgtactttagttacggtaacaacgtaacgacgaccgacggccgtacgcccgttgttacggttagtacgtagtaacttaagtaaacacgtaacgtagacggtacgacccagtacgacgtctaccgtaggacgtcgtacgttctcgtcgtacctcgacgtcgtacggaacggacgtactacggtacgtaccgtacgttacgtaacgtaagtaccgtaaggtaaccggtaacgttcggaacgtaaccggtaacgggaccggtacggtacggttacgtaacgtaacgttaaccttacgtaacgtaaaccgtaacggtaacggttacgaaacggtacggtaacgtaaccggtttacgtaacggtttacgggttacgggtacgggtaccgggacgggtaaaccggtaccgtacgggtaccgttaccgggtaaccggttaccggttacggacccgggtaaccggtcccggtaaccggtcccgtaccccggtccggttaccgg

SEQ ID NO: 202904 - DNA, 808 bp, Homo sapiens
  misc_feature: GYAE6OF02JKVQK.21.46.E02.1.454.CMB.1.raw
  modified_base (283)..(283): a, c, t, g, unknown or other
  misc_feature (283)..(283): n is a, c, g, or t
tcagtcgtcgctcgcacgaccggtgctcgatttagactcatctacagggaaagggggtgggtccaggaggcagaactctgggtgtctcaccatggcctggatccctctacttcctccccctcctcacctctctgcacaggctctgacggcctcctatgacgctggacctacacgccctacccgttcgggtacgttacaggttccgtacccccgaagggtaccacggaaccgggcccagggacttaccgaccgtcgctacctggaccgagtagtacgggtaccncgaaccgaaaagtaaacgtcgttacgtactttacgttacggttaaccgaactaacggaacgtccgaccggtaccgacggtacccccgtaggttacgtacggttaggataacgtaacgtaaacgactaacgtaggaacggaaccggtcccgtacgacggactaccgtcccgtaggtacgaccggtacttccgttacgtacggccttaccgacgtacgtacggtagggtaacctacggtaccgtacgtccgtaacggttcgaaccttacgtacgtacggtacgaacggtaccggagtacggacgggacggacgtacggtcgttacggtacttaaccgttgtacgtacctaaagtacgtacgaacgtacgttagggtaaccttaggtaccgttaggttcggtacggtttaccgggacggttaaccggaaccgtacggtaccggttacggtacccgtttaaccgggtacgttacccggaccggtacccggtaaccggttcccggtaccccggtaccccgttacccgggg

SEQ ID NO: 202905 - DNA, 666 bp, Homo sapiens
  misc_feature: GYAE6OF02H4E41.21.46.E02.1.454.CMB.1.raw
  modified_base (254)..(254): a, c, t, g, unknown or other
  misc_feature (254)..(254): n is a, c, g, or t
  modified_base (422)..(422): a, c, t, g, unknown or other
  misc_feature (422)..(422): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgagcctctatgagctgacacacgcccaccctcggtgtcacgtcgtccccgaggacaggaccggcaggactccacctgcctgtgactagagtcggactacgaacaaaagaactntacgttactttagtacggtaaccaaagaacgacgccgtacggccgaccgcccttgtacgtcggtacacgtacgtacgtaggaccgcctacggacgaaccggacctaaccggtccggacttccgtagacgtacgtacttccgtcgtcgcctacagtaccaggacggacncggtaccgaccttgtactaactcgcggtacggtccggacgtagggtcgaaggtacgtagacgtcgtactacgttacgttacgtacgtcgacacgtaagacgttacggtagtcgtacgtacggtacgggtggggttacgtacggggaccggtagtaaccggttagttaccggaccgttcgttccggtacaaccggacgtaaccggtccgtcccggtcccggttacctcgtcctccggttaccccg

SEQ ID NO: 202906 - DNA, 799 bp, Homo sapiens
  misc_feature: GYAE6OF02J2QF4.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgacggcctcctatgacgctgaccacacgcctacccgtcggtgtcacgtcgtaccccaggacaggtaccgccaggacttaccgacctgccttactcgcgtaagtagtacggtactacggaaccaaaaggtaatactcggttactttaacgttacggaaaccaaacgaacgaacggccgaacggtcccgtaaccggtccccgttaggtacggtttagtacgtaagttaacgttaagtaaaaccgtaccacggttacggaacgggtaccgttacccctagaacgtaccggtaccttacccgtagaaccgtacggtacctttacccgttcggtcgggttaccctaccggacgtaccgttacggaacggggtaccaccggtacgtacgttacgtaccgttacgaacttacgctaggtactaacggtaccaggtaccagggacgacggactcgtaacgcgttaacctagtaccgaaccgttaaacgacggtaactaaccgtaaggttacggtaacgtttaccgaagttacgggtttaggttaccgggttaccgggagggtaacccggtaacggtaacgtttaccgaaccgttaccggttaacgtaccgggttacccaaccggtacccggttaaccgggcccgttaaccccggtcccttaccggg

SEQ ID NO: 202907 - DNA, 730 bp, Homo sapiens
  misc_feature: GYAE6OF02FLOMA.21.46.E02.1.454.CMB.1.raw
  modified_base (131)..(131): a, c, t, g, unknown or other
  misc_feature (131)..(131): n is a, c, g, or t
  modified_base (670)..(670): a, c, t, g, unknown or other
  misc_feature (670)..(670): n is a, c, g, or t
tcagtcgtcgctcgcacgaccggtgctcgatttagactcatctacagggaaagggggtgggtccaggaggcagaactctgggtgtctcaccataggcctggactccctctaccttctccccctctcactcnctgacacagctctgacgtcctctatgacgcgtgacacacgcccaccgttcggtgtcgtacgtcgtacccgagaccaggccggcaggactaccgactcgtcctcgtcgcgtacgactacggtacgtacgaaaccgtaaaagtaaacgttagtacgttactttaacgttacgaaccaaggtacgaaccgacggtccgacgacccgttcccggtgttacggttagtctaagttaacgtaagaacgtacgtacgtggaacggtacgacctagtacgacgtacctcgtagcgtactacttcgtcgtctaccgtacgtactccggacggtaacggccgtacggaaccgttacgtaaccgttacgttacgtaacgtaacgtacggttacgggtaaccggttacgacggtacgaacggacgggaccggaacgtccggtagtaactttactaaccggtataacgaaccgttaaagagttaacaggttaacgtgtacgttaaccggtggttaccggttgggtacgttacggggccgagaccggttacgngtacccggttacgccgttaaccgcgaacgttacccggagtcccggtcccgtaccgtacgg

SEQ ID NO: 202908 - DNA, 795 bp, Homo sapiens
  misc_feature: GYAE6OF02FKRM4.21.46.E02.1.454.CMB.1.raw
  modified_base (218)..(218): a, c, t, g, unknown or other
  misc_feature (218)..(218): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcacaggctctgaggcctcctaatgagtctgacacagccacctcggtgtacagtgtaccccaggaccagacggcctaggatacaccgngccttcgtgacgagtactgggacttagaacccgtaaaagaaagttatagtccgttaagtttacgggtaccaaaccgaagaaacggcaacgggccctagggtaacccccttggttacgttagtaggacttaagtaactaaaaggaccgtaagtcggtaacgacggtccccgtacgaacgagtacctaccccgtagttaaggccgtacgttccgttaccgtcgtaccgtccgacgtacgtcggtaaacggctacgacgtacgttacgtaacgttacgtacgtacgtacgtaacgtagtaacgttaccgaccggtaaccgtaggaacggacggtaacggtacgtacgtaacgtaacttaacgtacgttaacgtaaaccgtaaggaacgtaaacggtaacggtaacggtaacgggttaacgttaacgtaacgttttaggggtacggtttaccggtaacgggacggtaaacccggtaaccggttacggtacccggtaacgggtttaccccgaagggttttacccggaaccggaaccccgttaacgggtacccggttaccggtaccccccggtttaacccggg

SEQ ID NO: 202909 - DNA, 1100 bp, Homo sapiens
  misc_feature: GYAE6OF02HPLFM.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttctccccctcctcactctctgcacaggctctgacggccttcctatgagctgaccacacgacccacccgttcggtcgtctagttccgtccccaaggacgacggaccggccgaaggactaccgaccgtcgtacctcgtcgactaaggagtacgggactacgaaaccgaaaagtaaattacgtacgttctttaagtttacggtaacccaaacgaaacggaaccggaccgaacgggtaccccgtaacccgggtccccccgtttagggtttacggtttaacgtacgtaacgtttaaacgttaaaagttaaaaaccggacctaaacggttacggaaccgggaaccggtacccccttaaggaacggaacgttaccgttacccggtaggcggtaccgttaaccgtttccgttaccggtcggtacccgtaccgtaccggttaccggaaccgggtaaacggggtaaccgaacggtacccgttaaaccgggttaccttaacccgggttttaaaccgtacgtttaaaccgtacgggttaacgggttaaacccgggtaaacccgggttaccggaacggggtaaacgggtaaacggggtaaacggggtaaaccgggggttaaccggttaaccggtttaaacgggtaaacccgttttttttaaaccggtaaccggttaacccgtttaaaaacccgaaaaaacggggttaccgtttaaaaacgggttacggttaaaaaccgggggtttttacggtaaaaccccgggttttacgtttaaccgggttaaacggggttttacgggggtttttaccgggggtaaccccgggggaacggggggttaaacccggtttaaaccgggacccgtttaaacccccggggtaacggtttaacccccggggtttaaacccggtttaaccggggaaaccccgtacccggggtaaaaccccggttaccggggggtttcccccctaacccccccggttacccgggttttaaacccccggg

SEQ ID NO: 202910 - DNA, 747 bp, Homo sapiens
  misc_feature: GYAE6OF02GNFJ0.21.46.E02.1.454.CMB.1.raw
  modified_base (177)..(177): a, c, t, g, unknown or other
  misc_feature (177)..(177): n is a, c, g, or t
tcagtcgtcgctcgcacgaccggtgctcgatttagactcatctacagggaaagggggttggggtccaggaggcagaactctgggtgtctcaccatcggcctggactccctctacttcctcccctcctcactctctgcacgacggctcttgacggcctcctagtgacgtctagacacncgcccgacccgttcggtgtcaggtccgtaccccgagacgacggaccggcgaggaactccgaccgtcgaccttcgtggaccaggagtacggtaccgtagaaccgaaaagtaacttagtacgtactttacgtacggtaaccaacgaagaccgaccgacgaccgtacgtccgttagttagttacgacgtaacttaagtaagtaacaccgtacgtggacgtaccgcctagaagtacgacgtccgtaggaccgtacgttacgttccgtcgtaccgtcgaccgtacgacgtacgggaacggacacgacgtacgtaccgtacgtctaattctacggtaagttcgaaccggtcgacgtacgaacggtacggactagggttacgactttaacgtacgttcggtaacaaacggaatacgggaactaccggtaaagtcggtaccttaaggtcgttaacgggtttccgggtacggacggttaaccggcgtaaccggtaacgttccggtaccggtacccgtttaacgtccgggtaacaccccgggtagttacccggcccggtacccccggttttacggaccgg

SEQ ID NO: 202911 - DNA, 714 bp, Homo sapiens
  misc_feature: GYAE6OF02IVWTZ.21.46.E02.1.454.CMB.1.raw
tcagtcgtcgctcgcacgaccggtgctcgatttagactcatctacaggggaaagggggtgggtccaggaggcagaactctgggtgtctcaccatggcctggatccctctacttctcccccctcctcactctctgcacaggctctgaggccctcctatgagctgacacagcccacccgtcggtgtcagtcgtccccaggaccaaacggccaggactccacctgctcgtggagtattcattcgaaccaaaaagtactatactttggttcggtaccagacagaagtccaggccacggcccctggtactggtacatccagtggacggccaggtccggacgaccgaccgtccgggtactccccgtagagtagtacttcctcgttccgtccctaccgacgcctcggacgggtactagggtccgtccctaacgttcggtaacttaacgtcgtacggggtaccgggcccgaggggtacggacgtagtacgggaagtccgtaggtaaccttaacgttacgtttagttaacccggacctaacgacgtaccgtaggttacggtcggtactacggtcgggtaacggggttcgtacgggacgggacgggtaaccgtaggttaccgaccgtttccggttacggtacgtaccggtacccgtaacggtcccgtacccggttcccccgtacggttcccgtacccgttcgttcccgtcccccgttacccccg

SEQ ID NO: 202912 - DNA, 852 bp, Homo sapiens
  misc_feature: GYAE6OF02FR5B9.21.46.E02.1.454.CMB.1.raw
  modified_base (134)..(134): a, c, t, g, unknown or other
  misc_feature (134)..(134): n is a, c, g, or t
tcagtcgtcgctcgcacgaccggtgctcgatttagactcatctacagggaaagggggtgggtccaggaggcagaactctgggtgtctcaccatggcctggatccctctacttctcccctcctcactctctgcanaggctcgtagaggcctcctatggagctagacacacggcccaccgtcggtgtctaggtcgtaccccgaggaccaggaccggtccaggtactccgaccgttgccttacgtgaccgtaagtacgtacggaccttacggaacccgtaaaagggtaaaacttacgttcgggttacttttaagttaaccgggttaaacccaaacggtaaacggaaacggtaccccgaaccgggtaaccccgaccggggttacccccttagggttaacggttttaaccggtagtaaagttaacgttaaacgaaaacggtacctaaccggtaggtaaccgggtaccggtaccccgttcgaaaggtacgtacccgttacccggtagtacggtaccgttaacgtttccgtccggttaccggtacccgttaccggacgttacccggtaaccggtaacgggggaaccctaacggttaccggtacgttaccgggttaacgttcgggaacccttttaggaccggtaggtttaaccggaacggttaaccggagttacccggaagggtaaccgggtaacgtcggtaccgtaagttaccgttaagttacgtaacgtactaaacgggtagtacgtacgtaacggtagaaccgttacttgtaggttcggtacgtcgggacggcggtacgtaggcgtaccggtacttcggtaacgcacggtacccgtaggcctcccggtaccgtccgg

SEQ ID NO: 202913 - DNA, 832 bp, Homo sapiens
  misc_feature: GYAE6OF02G9A6T.21.46.E02.1.454.CMB.1.raw
tcagtcgtcgctcgcacgaccggtgctcgatttagactcatctacagggaaagggggtgggtccaggaggcagaactctgggtgtctcaccatggcctggatccctctacttcctccccctcctcactctctgcacgaggctctggacggtccctcctatgagctgaccacgacgcccacccgtcggtcgtactagttccggtacccccaagggaccacggtaccgggacccgaagggtactcccgaccttcggcttcgtcggacgtagacgtcgggaccgtacggaaccaaaagtaactgttacgtactttaacggttacggtaaccaaacgaagaaccgaccgtaacggacccgacgggtacccctaggttagtacgtataagtaataagtaaacgactacggtagacgtaccggacctacgagtaacgtccgtaccgtaggacgccttaacgttcgtccggtacggtaccctaccggttaacgaccgtaccggtaacgggacccgtacgttaccgaacggttccgtaacggttacaacgttacgtacggtaacggtacgtaaccgtaccgacggtacgaagggtacggacggacgttacgtacgttaacgtacgttaacgtacgtaaacctaacggttaacggaacgttaaaccggtaagtttacgggtaacgttaccgttacggtaacgggttacggggttcgggaccgggtacggtaaccgggtaaccggtcgggttacccgttaaccggtaccgttaccggggaacttacccggggtaccgtaaccggttaccccgggaaccttcccccgggtaccccggttacgg

SEQ ID NO: 202914 - DNA, 565 bp, Homo sapiens
  misc_feature: GYAE6OF01CZHX1.34.63.F08.1.454.CMB.1.raw
  modified_base (199)..(199): a, c, t, g, unknown or other
  misc_feature (199)..(199): n is a, c, g, or t
  modified_base (289)..(289): a, c, t, g, unknown or other
  misc_feature (289)..(289): n is a, c, g, or t
tcagtacacgtgatcacgaccggtgctcgatttagcgatcgtataaggggggaggaactgctcagttaggacccagacggaaccatggaagccccagcgcagcttctcttcctcctgctactctggctcccagacaccactggagaaatagtgatgacgcagtctccagccaccctgtctgtgtctccgagggggaaancgcccaccctctcctgcagggccagtcagagtgtggcagcaacttagcctggtaccagcagaaacctggccaggcctcccagacgtcctnatctagtgactacatcccacgagggccactgctatccagccaggttcagtggctaggtgggtctgggacaggtacgttcactcgtacaccgatccgagcagcctgcagtctagaagtattctgtcttaacttttattacttgtacagtctaagtacttaagtagtcgggaccgttggtaccggttcggaccgtaagggacccgtaaggtacgaaacgtacgaaacggtaacgtcggtacggacctacggtacctacgtagttcctgttccttaccg

SEQ ID NO: 202915 - DNA, 519 bp, Homo sapiens
  misc_feature: GYAE6OF01D9ISW.34.63.F08.1.454.CMB.1.raw
tcagtacacgtgatcacgaccggtgctcgatttagcgatcgtataagggggaggaactgctcagttaggacccagacggaaccatggaagccccagcgcagcttctcttcctcctgctactctggctcccagatactactggagaaatagtgatgacgcagtctccagccaccctgtctgtgtccccaggggaaagagccatcctctcctgcagggccagtcagagtattagcaccaacttagcctggtaccagcagaaacctggccagactcccaggctcctcatctatggtgcatccaccagggccactggtactcccaggcaggttcagtggcaggtgggtctgggacagagttcactctcacatcagcagtacttgacgcctgaagtatttgctagtatattactgtcagtactaatatcgagacgcacgtgtgggtcgttcggaccgaacgggaccgaagggtacggaaatacgaaacgtacgtggtcggactgaccactatcttgtctctacg

SEQ ID NO: 202916 - DNA, 539 bp, Homo sapiens
  misc_feature: GYAE6OF01ENN05.34.63.F08.1.454.CMB.1.raw
tcagtacacgtgatcacgaccggtgctcgatttagcgatcgtataagggggaggaactgctcagttaggacccagacggaaccatggaagccccagcgcagcttctcttcctcctgctactctggctcccagatactactggagaaatagtgatgacgcagtctccagccaccctgtctgtgtccccaggggaaagagccatcctctcctgcagggccagtcagagtattagcaccaacttagcctggtaccagcagaaacctggccagactcccaggctcctcatctatggtgcatccaccgagggccacgtggtactcccaggcaggttcaggtgcaggtgggtctgggacagagttcactctcaccatcagcagtctgcagtctgaagatgtggctagtttatactgtacatactaataattagtacgtcctccgtctactacgtttcggacgggtaacgggacctaagggtggaagacgtacgaaacggtaacgtggtacggctacggtaccacctaattcgttcgttcttaccg

SEQ ID NO: 202917 - DNA, 581 bp, Homo sapiens
  misc_feature: GYAE6OF01B889H.34.63.F08.1.454.CMB.1.raw
  modified_base (406)..(406): a, c, t, g, unknown or other
  misc_feature (406)..(406): n is a, c, g, or t
tcagtacacgtgatcacgaccggtgctcgatttagcgatcgtataagggggaggaactgctcagttaggacccagacggaaccatggaagccccagcgcagcttctcttcctcctgctactctggctcccagatactactggagaaatagtgatgacgcagtctccagccaccctgtctgtgtccccaggggaaagagccatcctctcctgcagggccagtcagagtattagcaccaacttagcctggtaccagcaagaaacctggccagactcccaggctcctcatctatggtgcatccaccgagggccacgtggtactccccgaggcaggttcaggtggcaggtgggtcgtggggacaggtagttcactctcaccatcagcagcctgcagtctagaagtattcngctaacttttattacctgtcagtctaagtcttaaagtaacggttcggccggttagggtacgttaccgggaccgaacgggtaccgtaaagggtaggaaaacctacgaaaaccggtacgttaggtcgggacttacggacctacccgtaattccgttagtcctttccgactttccccg

SEQ ID NO: 202918 - DNA, 490 bp, Homo sapiens
  misc_feature: GYAE6OF01CH5DX.34.63.F08.1.454.CMB.1.raw
  modified_base (472)..(472): a, c, t, g, unknown or other
  misc_feature (472)..(472): n is a, c, g, or t
tcagtacacgtgatcacgaccggtgctcgatttagcgatcgtataagggggaggaactgctcagttaggacccagacggaaccatggaagccccagcgcagcttctcttcctcctgctactctggctcccagatactactggagaaatagtgatgacgcagtctccagccaccctgtctgtgtccccaggggaaagagccatcctctcctgcagggccagtcagagtattagcaccaacttagcctggtaccagcagaaacctggccagactcccaggctcctcatctatggtgcatccaccagggccactggtatcccaggcaggttcagtggcagtgggtctgggacagagttcactctcaccatcagcagtctgcagtctgaagtatttgctagtttattactgtcagcactataataagtgcctcgatcaccttcgccaaggcacgactaggagtattaaacgactgngctgcacatctgtcttac

SEQ ID NO: 202919 - DNA, 524 bp, Homo sapiens
  misc_feature: GYAE6OF01CXBQY.34.63.F08.1.454.CMB.1.raw
tcagtacacgtgatcacgaccggtgctcgatttagcgatcgtataagggggaggaactgctcagttaggacccagacggaaccatggaagccccagcgcagcttctcttcctcctgctactctggctcccagatactactggagaaatagtgatgacgcagtctccagccaccctgtctgtgtccccaggggaaagagccatcctctcctgcagggccagtcagagtattagcaccaacttagcctggtaccagcagaaacctggccagactcccaggctcctcatctatggtgcatccaccagggccactggtatcccagcaggttcaggtgcaggtgggtctgggacagtacttcactctcaccatcagcagtacttgagtcctagaagtattttgactagtattattactgtcagactaatatcgagacgctacgtggtgggcgttcggacgaagggaccgaaggtaggaaagtacgaaaaccggtactaggtcggactgacacctatctcgtcttcgtac

SEQ ID NO: 202920 - DNA, 566 bp, Homo sapiens
  misc_feature: GYAE6OF01CJOG0.34.63.F08.1.454.CMB.1.raw
  modified_base (303)..(303): a, c, t, g, unknown or other
  misc_feature (303)..(303): n is a, c, g, or t
  modified_base (315)..(315): a, c, t, g, unknown or other
  misc_feature (315)..(315): n is a, c, g, or t
tcagtacacgtgatcacgaccggtgctcgatttagcgatcgtataagggggaggaactgctcagttaggacccagacggaaccatggaagccccagcgcagcttctcttcctcctgctactctggctcccagatactactggagaaatagtgatgacgcagtctccagccaccctgtctgtcgtccccgaaggggaaagagccatccctctcctgcgagggccagtcagagtatagcaacctaacttagcctggtaccagacaagaaacctggaccagactcccaggctcctcatctatggtncatcccaaccgngggccactggtactcccgaggctagggttcaggtcggactagggtgggtcgtgggacaggtacgttcacttcacacctatcagcagtctgcagtctagtaagttatttgacttagtttatacgtgtacagtactaattaataagtaggtcgtacctaccgtactaccgtacgtcggaccgaaggaccacgacgtaggaacgtaacgttaaacgagtggtacgtactacgactaactattcgttgttccttc

SEQ ID NO: 202921 - DNA, 488 bp, Homo sapiens
  misc_feature: GYAE6OF01DU8BU.34.63.F08.1.454.CMB.1.raw
  modified_base (472)..(472): a, c, t, g, unknown or other
  misc_feature (472)..(472): n is a, c, g, or t
tcagtacacgtgatcacgaccggtgctcgatttagcgatcgtataagggggaggaactgctcagttaggacccagacggaaccatggaagccccagcgcagcttctcttcctcctgctactctggctcccagatactactggagaaatagtgatgacgcagtctccagccaccctgtctgtgtccccaggggaaagagccatcctctcctgcagggccagtcagagtattagcaccaacttagcctggtaccagcagaaacctggccagactcccaggctcctcatctatggtgcatccaccagggccatggtatcccaggcaggttcagtggcagtgggtctgggacagagttcactctcaccatcagcagtctgcagtctgaagtattttgctagtttattactgtcagcactataataagtgcctcgatcaccttcggccaagggacacgactggagattaacgactgngctgcacatctgtctc

SEQ ID NO: 202922 - DNA, 525 bp, Homo sapiens
  misc_feature: GYAE6OF01CHCTA.34.63.F08.1.454.CMB.1.raw
  modified_base (392)..(392): a, c, t, g, unknown or other
  misc_feature (392)..(392): n is a, c, g, or t
tcagtacacgtgatcacgaccggtgctcgatttagcgatcgtataagggggaggaactgctcagttaggacccagacggaaccatggaagccccagcgcagcttctcttcctcctgctactctggctcccagatactactggagaaatagtgatgacgcagtctccagccaccctgtctgtgtccccaggggaaagagccatcctctcctgcagggccagtcagagtattagcaccaacttagcctggtaccagcagaaacctggccagactcccaggctcctcatctatggtgcatccacagggccactggtatcccaggcaggttcagtggcaggtgggtctgggacaggagttcactctcaccatcagcagcctgacagtctgaaagtnttctgctaacttttatactgtacagcagtctaataagtggccgttggacgttcggaccaagggaccaaaggttaggaaaatacgaaaacgtaactggtaggctagactaaccattctagttcttcgattcccg

SEQ ID NO: 202923 - DNA, 576 bp, Homo sapiens
  misc_feature: GYAE6OF01BJIEB.34.63.F08.1.454.CMB.1.raw
  modified_base (199)..(199): a, c, t, g, unknown or other
  misc_feature (199)..(199): n is a, c, g, or t
  modified_base (431)..(431): a, c, t, g, unknown or other
  misc_feature (431)..(431): n is a, c, g, or t
  modified_base (447)..(447): a, c, t, g, unknown or other
  misc_feature (447)..(447): n is a, c, g, or t
  modified_base (452)..(452): a, c, t, g, unknown or other
  misc_feature (452)..(452): n is a, c, g, or t
tcagtacacgtgatcacgaccggtgctcgatttagcgatcgtataagggggaggaacgtgctcagttaggacccagacggaaccatggaagccccagcgcagcttctcttcctcctgctactctggctcccagatactactggagaaatagtgatgacgcagtctccagccaccctgtctgtcgtcccgaggggaaagngccatcctctcctgcagggccagtcagagtattagccaccaacttagcctggtaccagcaagaaacctggaccagacctccgaggcctcctcatctatggtgcactccaccgagggcccacgtcggtactcccgaggtccgtaggttcaggtcggactagggttcgggtcgtaggggactaggtacgttacacgtctacacctagtcagctagtctgctagtctagtaagtntttagcttagtttatntagtnacgtatactataatagtacgacctcgtactccgtacgttcggacgaaggaccacgtacgtacggaacgtaacgttaacgacgttcggcggtacgttacgactaccgtatcgttcgtccttaccg

SEQ ID NO: 202924 - DNA, 626 bp, Homo sapiens
  misc_feature: GYAE6OF01AEECR.34.63.F08.1.454.CMB.1.raw
  modified_base (197)..(197): a, c, t, g, unknown or other
  misc_feature (197)..(197): n is a, c, g, or t
  modified_base (398)..(398): a, c, t, g, unknown or other
  misc_feature (398)..(398): n is a, c, g, or t
tcagtacacgtgatcacgaccggtgctcgatttagcgatcgtataagggggaggaactgctcagttaggacccagacggaaccatggaagccccagcgcagcttctcttcctcctgctactctggctcccagatactactggagaaatagtgatgacgcagtctccagccaccctgtctgtcgtccccaggggaaanagccatccctctcctgcagggccagtcagagtattagcaccaacttagcctggtaccagcaacgaacctggccagacctcccaggctcctcatctatggtgcactcccacgcgggccacgtggtactcccgaggctaggttcaggtcggctaggtgggtctgggactagtacgttcactctacacctatcgagcgtagtcngtctaggttctaaggtaagtttagttttcggtacttaagttttacttaaccgtcgttaacctaacgttacggtttcggttacctactaaccgtaaccggtaccggttgggtaacccgttcgggaaccgtaacgggaccgtaaagggtacgaaagtaccgaaaacgtacgttggacggtcgtcgaccacctacgttccttacgttaccttacgtcttcccgttaccccg

SEQ ID NO: 202925 - DNA, 599 bp, Homo sapiens
  misc_feature: GYAE6OF01DHGJD.34.63.F08.1.454.CMB.1.raw
  modified_base (197)..(197): a, c, t, g, unknown or other
  misc_feature (197)..(197): n is a, c, g, or t
tcagtacacgtgatcacgaccggtgctcgatttagcgatcgtataagggggaggaactgctcagttaggacccagacggaaccatggaagccccagcgcagcttctcttcctcctgctactctggctcccagatactactggagaaatagtgatgacgcagtctccagccaccctgtctgtgtccccaggggaaagngccatcctctcctgcagggccagtcagagtattagcaccaacttagcctggtaccagcagaaacctggaccagactccaggctcctcatctatggtgcatccaccgagggccacgtggtactcccgaaggctacggttcaggtcggcgtaggtggggtctggggactaggtacgttcacgttctacaccgatcagtctacgtctcgctagtcgtagtaacgtattttagcttaaggttttacttacgttagtctacgtactaacttaataagtaacggtcggacccttacgtacttcccgtacgttaccggaccgaacgggtaccacgtacgtagggtaagtaacgttaaaccggaagttcggacggtctacgtaccgtaactagtccgttgttccttaccg

SEQ ID NO: 202926 - DNA, 496 bp, Homo sapiens
  misc_feature: GYAE6OF01BQAZN.34.63.F08.1.454.CMB.1.raw
  modified_base (398)..(398): a, c, t, g, unknown or other
  misc_feature (398)..(398): n is a, c, g, or t
tcagtacacgtgatcacgaccggtgctcgatttagcgatcgtataagggggaggaactgctcagttaggacccagacggaaccatggaagccccagcgcagcttctcttcctcctgctactctggctcccagatactactggagaaatagtgatgacgcagtctccagccaccctgtctgtgtccccaggggaaagagccatcctctcctgcagggccagtcagagtattagcaccaacttagcctggtaccagcagaaacctggccagactcccaggctcctcatctatggtgcatccaccgagggcccactggtactccccgaggcaggttcagtggcaggtgggtctgggacaggtgttcactctcaccatcagcagtctgctagtctgaagttntttgcttagtttattactgtcagtctacttataatagtgcctcgtatccacttcgacaggcagacgtgagattaacgatgtgctgacacatctgtctc

SEQ ID NO: 202927 - DNA, 728 bp, Homo sapiens
  misc_feature: GYAE6OF01ADFKK.34.63.F08.1.454.CMB.1.raw
  modified_base (198)..(198): a, c, t, g, unknown or other
  misc_feature (198)..(198): n is a, c, g, or t
  modified_base (298)..(298): a, c, t, g, unknown or other
  misc_feature (298)..(298): n is a, c, g, or t
tcagtacacgtgatcacgaccggtgctcgatttagcgatcgtataagggggaggaactgctcagttaggacccagacggaaccatggaagccccagcgcagcttctcttcctcctgctactctggctcccagatactactggagaaatagtgatgacgcagtctccagccaccctgtctgtcgtccccgaggggaaangcccatccctctcctgcgagggccagtcagagtatagcaccacttgcctggtaccagcagaacctggccagactcccaggctccgtacatctagtggtcncactccaaccgacgggcccacgtcggtactccccgaggtactagggttccgaggtcgggacgtaggggttacgggtcgttaggggaactaggtaccggtttaccaccgttcccttaccaacccgtaacgttccgaacgtaccgtaacgttccgtacggtaccgttaacggttaccgttaaggtaaacggtttagtttttacggtacgttttaaacggtttttaactttaacgtacggttacaacgttaaccgttaaccgttaaagttaaacgttaacggttaccggtacccttaacccggtagttacccgtacccgggttccggaacccggtaagggacccgtaacggtaccgttagggaaacgttaacgtaaacggtacgtggttcgggtacctacggtaccctacgtacttcgttcgttcccttaccg

SEQ ID NO: 202928 - DNA, 807 bp, Homo sapiens
  misc_feature: GYAE6OF01CA81K.34.63.F08.1.454.CMB.1.raw
tcagtacacgtgatcacgaccggtgctcgatttagcgatcgtataagggggaggaactgctcagttaggacccagacggaaccatggaagccccagcgcagcttctcttcctcctgctactctggctcccagatactactggagaaatagtgatgacgcagtctccagccaccctgtctgtcgtcccccgaaggggaaagagcccatcctctcctgcgagggccagtcagtagtattagcaacctaacttagcctggtaccagtcagaaacctggcctagactcccaggcctctcatctatggtcacactcccaacgacggcctacgtcggtactcccgaggtccgtaggttcaggttcggacgtagggtcgggtcgtacgggacgtaagtacggttccaaccgttccgtacccaaccgtagttcccgaaggtaccgtaacggttccgttacggaccgtaggttacccgttaagggtaaacgtttacgtttttacggaccgttaagggtttagttttaaacgttacggttacgttaaccgtaaacggtttacgggtttaccgggttacccttaaccgtaaaccgtaacccgggttaaccgggttttacccggggtaaacccggttttaccccggggaaacccgttaaacggggggaaaccccgttaaaaggggggtttaacggaaaaaacccttaccgggtaaaaaacccggttaaccggttagggttcgggtaaccctacggtaaaccccgtaaccgttacggtttaccgttaccgtttaacccttaccgaacccgttttcccccg

SEQ ID NO: 202929 - DNA, 576 bp, Homo sapiens
  misc_feature: GYAE6OF01D3W95.34.63.F08.1.454.CMB.1.raw
  modified_base (410)..(410): a, c, t, g, unknown or other
  misc_feature (410)..(410): n is a, c, g, or t
  modified_base (562)..(562): a, c, t, g, unknown or other
  misc_feature (562)..(562): n is a, c, g, or t
tcagtacacgtgatcacgaccggtgctcgatttagcgatcgtataagggggaggaactgctcagttaggacccagacggaaccatggaagccccagcgcagcttctcttcctcctgctactctggctcccagatactactggagaaatagtgatgacgcagtctccagccaccctgtctgtcgtccccaggggaaagagccatcctctcctgcagggccagtcagagtatagcaccaacttagcctggtaccagcagaaacctggccagacctcccagcctcctcatctatggtgcactccaccgacgggccacgtggtactcccgaggctaggttcaggtggcagggtgggtcgtgggacaggtacgttccactctcaccatcagcagtctgctagtctaggtaagttnttttgacttaggttttacttacttggtacacgtctaattaattaaagtaacgtcggtacccttacgtactccgtacccgttacggaccgaacgggaccacgtacgtaggaacgtaaacttaaacggacgttggacgtctacgaccctaactnttactgttcttacc

SEQ ID NO: 202930 - DNA, 573 bp, Homo sapiens
  misc_feature: GYAE6OF01DVNUB.34.63.F08.1.454.CMB.1.raw
  modified_base (417)..(417): a, c, t, g, unknown or other
  misc_feature (417)..(417): n is a, c, g, or t
tcagtacacgtgatcacgaccggtgctcgatttagcgatcgtataagggggaggaactgctcagttaggacccagacggaaccatggaagccccagcgcagcttctcttcctcctgctactctggctcccagatactactggagaaatagtgatgacgcagtctccagccaccctgtctgtgtctccgaggggaaagcgccaccctctcctgcgagggccagtcagagtgttggcagcaacttagcctggtaccagcaagaaacctggccaggcctccagacgtcctcatctatcgactacactcccaccgagggccactcgcttacttccacgcctaggttcagtggctaggtgggtctgggacaggtagttcactctcaccatcagcacgcctgacagttctagaagtctttcgngtaccttacttttatacttgtcagctagttacctaagtacggtggtaccggttggaccggttcggaccggaacgggtaaccgtaaagggtaggaaacgtaccgaaaacggtacggtgggtacggctacggaccaaccgtattccgtgttcttaccg

SEQ ID NO: 202931 - DNA, 705 bp, Homo sapiens
  misc_feature: GYAE6OF01C4UOW.34.63.F08.1.454.CMB.1.raw
  modified_base (305)..(305): a, c, t, g, unknown or other
  misc_feature (305)..(305): n is a, c, g, or t
  modified_base (321)..(321): a, c, t, g, unknown or other
  misc_feature (321)..(321): n is a, c, g, or t
  modified_base (430)..(430): a, c, t, g, unknown or other
  misc_feature (430)..(430): n is a, c, g, or t
tcagtacacgtgatcacgaccggtgctcgatttagcgatcgtataagggggaggtaacgtgctcagttaggacccagaccggaaccatggaagccccagccgcagcttctcttcctcctgctactctggcctcccagactactactggagaaatagtagatgacgcagtctccacgcccaccctgtcctgtcgtctccgaaggggaaacgcggccaccctctccctgaccgagggccaggtcaaggtagtggttggcagctaacttacgccgttggtaccagcaagaaccgtggaccacgggccncccgagacgtccctanacttctaactgacctaccactaccccgaaccgaccggggacccaactcggtacctttacgtcccacggtcccgaaggttccgaggttcggacgtacggtcgggttacgngggtactaaggtacgtttacaccgtctacccgtaacacgttaccaccgtacgacgtacgggtagacctaggtacgttatttacggacttagttagttaacttacgttcgtactaacgttaggtacgttactaccgtacctacgggttaccgacggttaccggttacccggaacggtacgggaaccgtaagggtaacgggaaaactaccggaaaagttaccggaggttacgacgttacggaccaccgttagtactacgtttctcgtacctttcccg

SEQ ID NO: 202932 - DNA, 642 bp, Homo sapiens
  misc_feature: GYAE6OF01CPJME.34.63.F08.1.454.CMB.1.raw
  modified_base (297)..(297): a, c, t, g, unknown or other
  misc_feature (297)..(297): n is a, c, g, or t
tcagtacacgtgatcacgaccggtgctcgatttagcgatcgtataagggggaggaactgctcagttaggacccagacggaaccatggaagccccagcgcagcttctcttcctcctgctactctggctcccagatactactggagaaatagtgatgacgcagtctccagccaccctgtctgtcgtccccgaggggaaagagccatcctctcctgcaggccagtcagagtatagcaccaacttgcctggtaccagcaagaaacctggccagacctccaggcctcctcatctagtggtcncactcccaccgacggggccctacgtcggtactccccgaagggtccgtagggttccaggtcggcgtaggttggggtcgtggggaacaggtacgttcaccgtctaccaccatcgacggctacgtctgctagtactagtaagttattttgcgttaagttttatttacgtagtacacgtactaacgttaataagttaacgtcggtacccgttaccggtattaccgtaacccgtttccggaccgtaaacgggaccgtaaccggtaccgtaggtaaacgtaacgttaaaccggaacgttggtacggtaccgttacgaccctaacgtattaccgttcgttaccgtttacccg

SEQ ID NO: 202933 - DNA, 729 bp, Homo sapiens
  misc_feature: GYAE6OF01ALDXD.34.63.F08.1.454.CMB.1.raw
  modified_base (198)..(198): a, c, t, g, unknown or other
  misc_feature (198)..(198): n is a, c, g, or t
  modified_base (310)..(310): a, c, t, g, unknown or other
  misc_feature (310)..(310): n is a, c, g, or t
tcagtacacgtgatcacgaccggtgctcgatttagcgatcgtataagggggaggaactgctcagttaggacccagacggaaccatggaagccccagcgcagcttctcttcctcctgctactctggctcccagatactactggagaatagtgatgacgcagtctccagccaccctgtctgtcgtccccgaggggaaagngccatcctctcctgcagggccagtcagtagtattagcaaccaacttagcctggtaccagacaacgaaacctggaccacgacctcccgaggtcctcctcgactctagtggtcncactcccgacgacgggccacgtcggtactcccgaggtctaggttcaggtcggacgtagggttcgggtcgtaggggaactaggtaccgttacgaccgtcctacctaaccgtataccgacggtacctacggttctacggtaccgttacggttacgttaaggttaaacggtttacttttacggaaccttttaaggtttttaaccttaccgttacgtaccgtaaggtacccttaaacgttaagttaaacggttacggtacccggtaccctacgtaaccgttacccgtacccggtttacggaaccggtaaacgggtaccaaccggtacggtaagggtaaacgttaaaccggttaaacggtcgttgggtaccggtaacccttacgtaccttaccttaacggtttcgttacccgtttcgtaacccg

SEQ ID NO: 202934 - DNA, 566 bp, Homo sapiens
  misc_feature: GYAE6OF01A4OD9.34.63.F08.1.454.CMB.1.raw
  modified_base (288)..(288): a, c, t, g, unknown or other
  misc_feature (288)..(288): n is a, c, g, or t
tcagtacacgtgatcacgaccggtgctcgatttagcgatcgtataagggggaggaactgctcagttaggacccagacggaaccatggaagccccagcgcagcttctcttcctcctgctactctggctcccagatactactggagaaatagtgatgacgcagtctccagccaccctgtctgtgtccccaggggaaagagccatcctctcctgcagggccaggtcagagtgttaatagcatctacttagcctggtaccagcagaaacctggccagcctcccagactcctnattaatggtgcatactacacgggcccctggcatcccagacaggttcagtggcaggtggtctgggacagtacgttcactctacaccatacaccgagactggacgccgtagtaagtagtttcgactagttgttattacgtgtacaacgtagttcgtctacacacgtcggtagtaccggttcgaccgaacgggactaagggtagaaagtaccgaaaacgtaacgtcggtaggacgtggaccctaacgacttcgtacgttaccttccgattcccgtaccccg

SEQ ID NO: 202935 - DNA, 622 bp, Homo sapiens
  misc_feature: GYAE6OF01E4ZZH.34.63.F08.1.454.CMB.1.raw
  modified_base (197)..(197): a, c, t, g, unknown or other
  misc_feature (197)..(197): n is a, c, g, or t
tcagtacacgtgatcacgaccggtgctcgatttagcgatcgtataagggggaggaactgctcagttaggacccagacggaaccatggaagccccagcgcagcttctcttcctcctgctactctggctcccagatactactggagaaatagtgatgacgcagtctccagccaccctgtctgtcgtccccaggggaaanacgccatccctctcctgcgagggccagtcagagtatagcaccaattagcctggtaccagcagaacctggccagactcccaggcctcctcatctagtggtcgccactcccacgacgggcccacgtggtactcccgaggcctaggtcagtcggctaggtgggtcgagggacagtacgttcaacttctccacctatccagccgagtcgtgaccgtagtctagtaagttcgtttgtacttagtttacttacgtagtcacgtctaacgttattaacgtacgtcgtacctaccggtacttccggtaacccgttcggaacccgtaacgggaccgtacggtaaccggtacggtaaacgtaacgtttaaaaccggtcggttacgtacggtacccgtacgtaccgtaccctaattccggttcgtttcgttacccg

SEQ ID NO: 202936 - DNA, 571 bp, Homo sapiens
  misc_feature: GYAE6OF01A2O8K.34.63.F08.1.454.CMB.1.raw
  modified_base (418)..(418): a, c, t, g, unknown or other
  misc_feature (418)..(418): n is a, c, g, or t
tcagtacacgtgatcacgaccggtgctcgatttagcgatcgtataagggggaggaactgctcagttaggacccagacggaaccatggaagccccagcgcagcttctcttcctcctgctactctggctcccagatactactggagaaatagtgatgacgcagtctccagccaccctgtctgtgtccccaggggaaagagccatccctctcctgcagggccagtcagagtatagcaccacttagcctggtaccagcaagaaacctggccagacctcccaggcctcctcatctatggtcgccactcccaccgacggggcccacgttcggtactccccgagggcctagggttcaggtgggctaggtgggtctggggactaggtagttcactctcaccatcagcagtctgcagtctagaagtntttgcttagtttattacgtgtcagtcattactaagtacgtcgtcctacgtactccgtaccgttcggaccgaagggtaccacggtacgtaggaaggtaacttaaacggacttggtacgcgttacgaccaccgtattcccttcggttccttaccg

SEQ ID NO: 202937 - DNA, 571 bp, Homo sapiens
  misc_feature: GYAE6OF01AHWI1.34.63.F08.1.454.CMB.1.raw
  modified_base (297)..(297): a, c, t, g, unknown or other
  misc_feature (297)..(297): n is a, c, g, or t
  modified_base (523)..(523): a, c, t, g, unknown or other
  misc_feature (523)..(523): n is a, c, g, or t
tcagtacacgtgatcacgaccggtgctcgatttagcgatcgtataagggggaggaactgctcagttaggacccagacggaaccatggaagccccagcgcagcttctcttcctcctgctactctggctcccagatactactggagaaatagtgatgacgcagtctccagccaccctgtctgtcgtccccgaggggaaagagccatcctctcctgcagggccagtcagagtatagcaccaacttagcctggtaccagcaagaacctggccagacctcccaggctcctcatctagtggtncactcccaccgacgggcctacgtcggtactcccgaggtcgtacggtttcaggttcggacgtagggtcgggtcgtaggggactaaggtacgttaccactcctccaaccctatccgagcacgttcgtggctagttctaggtaaagtttgtttacgacttaagttttatacgttgtacagtactataataagtgtcgtcctcgtactccaccgttcggacgaaggaccncgtacgtggaacgtaacgtaagagtgtcgtcacgccactatctgtctc

SEQ ID NO: 202938 - DNA, 529 bp, Homo sapiens
  misc_feature: GYAE6OF01ANLO7.34.63.F08.1.454.CMB.1.raw
  modified_base (398)..(398): a, c, t, g, unknown or other
  misc_feature (398)..(398): n is a, c, g, or t
tcagtacacgtgatcacgaccggtgctcgatttagcgatcgtataagggggaggaactgctcagttaggacccagacggaaccatggaagccccagcgcagcttctcttcctcctgctactctggctcccagatactactggagaaatagtgatgacgcagtctccagccaccctgtctgtgtccccaggggaaagagccatcctctcctgcagggccagtcagagtattagcaccaacttagcctggtaccagcagaaacctggccagactcccaggcctcctcatctatggtgcatccaccgagggccacgtggtactcccgaggcaggttcaggtggcaggtgggtctgggacaggagttcactctcaccatcagcagtctgcagtctagaagtntttgactagtttattactgtcagtctactaataatagtcgcctacgatccaccttcggacaaggaccacgtacgtggaacgtaacgttaaacgacgtggtacgtctacgaccacctattcgtgtcttaccg

SEQ ID NO: 202939 - DNA, 611 bp, Homo sapiens
  misc_feature: GYAE6OF01AF1L8.34.63.F08.1.454.CMB.1.raw
  modified_base (266)..(266): a, c, t, g, unknown or other
  misc_feature (266)..(266): n is a, c, g, or t
  modified_base (269)..(269): a, c, t, g, unknown or other
  misc_feature (269)..(269): n is a, c, g, or t
  modified_base (280)..(280): a, c, t, g, unknown or other
  misc_feature (280)..(280): n is a, c, g, or t
tcagtacacgtgatcacgaccggtgctcgatttagcgatcgtataagggggaggaactgctcagttaggacccagacggaaccatggaagccccagcgcagcttctcttcctcctgctactctggctcccagatactactggagaaatagtgatgacgcagtctccagccaccctgtctgtgtccccaggggaagagccatcctctcctgcagggccagtcagagtatagcaccaacttagcctggtaccagcagaacctggccanccnccgagtcctcnctactctagtgcgacactaccacgcggaccacgtgtacctccgagcgtaggtgaggtcggcgtaggtcggtcggaggacgagtacgtctactcaccactactcgagcgtacgtcgtcgctagtctaagtaagtttgtttcgtagtttagttttactacgtcgtacgtacgtacttaagttaaagttaacggttacggtcccgtacccgtacgtacttacccgtaccgggttaccggaaccggtaacggaacctacggtacggtaggtaaacgttaacgtaaacgtcggtcggtacggtactccggacctactagttcgttcgtccttaccg

SEQ ID NO: 202940 - DNA, 609 bp, Homo sapiens
  misc_feature: GYAE6OF01BKCAC.34.63.F08.1.454.CMB.1.raw
  modified_base (198)..(198): a, c, t, g, unknown or other
  misc_feature (198)..(198): n is a, c, g, or t
  modified_base (297)..(297): a, c, t, g, unknown or other
  misc_feature (297)..(297): n is a, c, g, or t
  modified_base (409)..(409): a, c, t, g, unknown or other
  misc_feature (409)..(409): n is a, c, g, or t
tcagtacacgtgatcacgaccggtgctcgatttagcgatcgtataagggggaggaactgctcagttaggacccagacggaaccatggaagccccagcgcagcttctcttcctcctgctactctggctcccagatactactggagaaatagtgatgacgcagtctccagccaccctgtctgtcgtccccaggggaaagngccatcctctcctgcagggccagtcagagtattagccaccaacttagcctggtaccagcaagaaacctggccagactcccaggctcctcatctatggtncactccaccgagggcccacgtggtaactcccgaggctaggttcagtggcgaggtgggtctgggacagtagttccactctacacctatcagcagtctgctagtctagaagttntttgactagttttacttatgtacagtactaactaataacgtacgtcggaccctaccgtattaccctacccgttacgggacccgaaaggggtacccaacgggtaccgtagggtaaacgtaacgtttaaaacggaaccgtttgggtacgggtaccgttacggtacccctaaccgtaagtttcccgttcgtttacccttaccg

SEQ ID NO: 202941 - DNA, 714 bp, Homo sapiens
  misc_feature: GYAE6OF01EGQKT.34.63.F08.1.454.CMB.1.raw
  modified_base (199)..(199): a, c, t, g, unknown or other
  misc_feature (199)..(199): n is a, c, g, or t
  modified_base (302)..(302): a, c, t, g, unknown or other
  misc_feature (302)..(302): n is a, c, g, or t
tcagtacacgtgatcacgaccggtgctcgatttagcgatcgtataagggggaggaactgctcagttaggacccagacggaaccatggaagccccagcgcagcttctcttcctcctgctactctggctcccagatactactggagaaatagtgatgacgcagtctccagccaccctgtctgtcgtccccgaggggaaagngccatcctctcctgcgagggccagtcagagtattagcaccaacttacgcctggtaccagcaagaacctggccagacctcccaggcctcctcatctagtggtcncactccaccgagggccctagtggtactcccgaggcgtaggttcaggtcggacgagggttcggggtcgtaggggaactacggtagttccacgttcctacacccgtatccgaacggtctacgttccgtcggacgttacggttacgttaggtaaacgtttacgtttttcggaacgtttaggtttttaactttaccgttcggttacaaccgtactaacgttaagttaaacgttacggttaccggtacccttaaccggtactttacccgtacccggtttaccggaaccccggtaacggggtaacctaaccgggtacgttacggggaaacgtttaaaccggttaaaaccggtacgttcgggtacggtaccttacggtaccctaacccgttagttccccgtttgttaccccgtttaccg

SEQ ID NO: 202942 - DNA, 733 bp, Homo sapiens
  misc_feature: GYAE6OF01DTE2C.34.63.F08.1.454.CMB.1.raw
  modified_base (198)..(198): a, c, t, g, unknown or other
  misc_feature (198)..(198): n is a, c, g, or t
tcagtacacgtgatcacgaccggtgctcgatttagcgatcgtataagggggaggaactgctcagttaggacccagacggaaccatggaagccccagcgcagcttctcttcctcctgctactctggctcccagatactactggagaaatagtgatgacgcagtctccagccaccctgtctgtcgccccgaaggggaaangccatcctctcctgcagggccagtcagtagtattagcaccaacttagcctggtaccagccaagaaaccgtggaccagacctcccaggcctcctcatctatggtgcatcccaacgtacgggcctaacgtggtaactccccgagggtacctagggtttaccagggtacgacgtagggttcgggtaccgtaggggaacctaggtaacgtttccacgttacctaccaaccctattacccaggtacccgtaagttccttacggaccgtaggtttacccttaagggtaaaacggtttagttttttaccgggaattttaaccgggttttttaaatttaacccgttgggtttaacctaacgcgttaaaccttaagtaaaacgtacgttacgggaccccttaccggtacttaacccgttaacccgttaccgggaacccggaaagggaacctaaccggtagtaacggtaaagtaaacgttaaaacggtacgtacgggttcgtaaccgacggtacctaaccctaagtttccttggttcctttaccg

SEQ ID NO: 202943 - DNA, 693 bp, Homo sapiens
  misc_feature: GYAE6OF01DB790.34.63.F08.1.454.CMB.1.raw
  modified_base (197)..(197): a, c, t, g, unknown or other
  misc_feature (197)..(197): n is a, c, g, or t
  modified_base (242)..(242): a, c, t, g, unknown or other
  misc_feature (242)..(242): n is a, c, g, or t
  modified_base (312)..(312): a, c, t, g, unknown or other
  misc_feature (312)..(312): n is a, c, g, or t
tcagtacacgtgatcacgaccggtgctcgatttagcgatcgtataagggggaggaactgctcagttaggacccagacggaaccatggaagccccagcgcagcttctcttcctcctgctactctggctcccagatatcaccggagaaattgtgttgacacagtctccaggcaccctgttctttgctccgaaggggaancgccaccctctcctgccgagggtccaagtcaggtagttagttaangctatcttacttagcctggtaccagcaagaacctggaccacgccctccagacctcctacattaagtggtnactactacgtacgaccggccctggccactcccagacgtagttacgaggtcggcgtagggtcggtacgtcggggactaggtaaccctttcgaacctttcctaacccgacctacgttaccgaaacccgtaggtaccgtacggggtaactacccggttagtaacgtttacgttttgacgttagtagttactttacgtcgtacgtaacgtgttcgtacactaacgtacgtacggttcggtaacccggttacggaccggtaaacgggtacgtaaagggtacgtaaaaccgtaccgaaacggtacgttaggacgggtaccgtacgaaccgtacccgttacgttaccttccggttacctaccttacgtccccttcccggtaccttacg

SEQ ID NO: 202944 - DNA, 760 bp, Homo sapiens
  misc_feature: GYAE6OF01CMQ56.34.63.F08.1.454.CMB.1.raw
  modified_base (391)..(391): a, c, t, g, unknown or other
  misc_feature (391)..(391): n is a, c, g, or t
  modified_base (517)..(517): a, c, t, g, unknown or other
  misc_feature (517)..(517): n is a, c, g, or t
tcagtacacgtgatcacgaccggtgctcgatttagcgatcgtataagggggaggaactgctcagttaggacccagacggaaccatggaagccccagcgcagcttctcttcctcctgctactctggctcccagatactactggagaaatagtgatgacgcagtctccacgccaccctgtctggtcgtccccgaaggggaaagacgccaactccctctccgtgcagggccagtcaagtagtattacgctaacctaacttacgccgtaggtaccagacaacgaaaccgtcggaccaacgtacctacccgaggcctacctcacttcctaagtgggcactactcccaacgcgggacccacgttacggtactccccggaggtaccgtacggttacgnggtacggtacggtagggttcggggtccgtacgggaacgtacggtacgtttccaaccgtttccaccgtaaactcgtaccgacgtacgtacgttcgacggtaccgtataccggtaagttaaacgtttntttacggacttttaagtttaccttacgtcgtacttaacgtacttaacttaaaaggttaacggttaccggtaccgttacccggttaaccgtaacctttaccccggttaacccggttacgggaaacccgtaacgggacctaaacgggtaccgttaaagggaaaccgttttaaaccgaaacgggtacgttcgggtacgttaccccgtagacccttaacgtccgtttagtcccgttaaacgtttccc

SEQ ID NO: 202945 - DNA, 698 bp, Homo sapiens
  misc_feature: GYAE6OF01AX9IN.34.63.F08.1.454.CMB.1.raw
  modified_base (247)..(247): a, c, t, g, unknown or other
  misc_feature (247)..(247): n is a, c, g, or t
  modified_base (314)..(314): a, c, t, g, unknown or other
  misc_feature (314)..(314): n is a, c, g, or t
  modified_base (338)..(338): a, c, t, g, unknown or other
  misc_feature (338)..(338): n is a, c, g, or t
  modified_base (374)..(374): a, c, t, g, unknown or other
  misc_feature (374)..(374): n is a, c, g, or t
  modified_base (425)..(425): a, c, t, g, unknown or other
  misc_feature (425)..(425): n is a, c, g, or t
tcagtacacgtgatcacgaccggtgctcgatttagcgatcgtataagggggaggaacgtgctcagttaggaccagacggaaccatggaacgcccagcgcagcttctcttcctcctgctactcgtggctccagatactactggagaaatgtgatgacgcagtctccagtccaccctgtctgtcgtaccccgaggggaaagcacctactccgtctaccgtgcgacgggacccaggtcagtatacgttanccgaacctagttacgcctggaaccaggaccaacgtaaccgtggaccacgacctcccggagcctcccntatcgacgttggcgcaccctaccncggacggctacgcgtactcccgagggtcctagggtntacggcggtctaagggtcgggtcagggacctagtcggttaccaccgttacnccgtaacgctacgtcgtacgtacgtcgtacgtcgtacgtacgtacgtaagttacgtttacgttacgttacgtttagtttacgttacgttacgtacgttacgtacttaacgttaacgttacgtaccggttaccgtaccgttttttacgaccgttaaccgttaccggtaaccggtaacggtacgtaaccggtacggttaacggacggttaaacgttaaccggtaacgttcggtacgtacgtacgtacgtaccgtactacgttcgttacgttaccg

SEQ ID NO: 202946 - DNA, 662 bp, Homo sapiens
  misc_feature: GYAE6OF01ASY7Q.34.63.F08.1.454.CMB.1.raw
tcagtacacgtgatcacgaccggtgctcgatttagcgatcgtataagggggaggaactgctcagttaggacccagacggaaccatggaagccccagcgcagcttctcttcctcctgctactctggctcccagatactactggagaaatagtgatgacgcagtctccagccaccctgtctgtcgtccccgaggggaaagagccatccctctcctgccgagggccagtcagtagtattacgcaacctaacttagcctggtaccagcaacgaaccgtggaccagacctcccaggcctcctctatctagtcggtcactactcccgaccgacgggtaccacggtcggtactccccggaggccgtaggttcgaggtcggcgtagggtcgggtcgtggggacaggtacgttacctacgttcctaccgaacccgtataccgacggtactacggtctcgcgtacgttcgtagtaacgtttagtttcgtacgtttagttttacttacgtgtacgacgtactaacttaagtaacgttacggtccggtacctaccgtacttacccgtaccggttaccggaaccgtaacgggaccgaccggtacgtaggtaacgtaaccgttaaacggtacggttcggacgtacgtacgtaccacgtacttccgtcttcttaccg

SEQ ID NO: 202947 - DNA, 724 bp, Homo sapiens
  misc_feature: GYAE6OF01ESJX0.34.63.F08.1.454.CMB.1.raw
tcagtacacgtgatcacgaccggtgctcgatttagcgatcgtataaggggggaggaactgctcagttaggacccagacggaaccatggaagccccagcgcagcttctcttcctcctgctactctggctcccagatactactggagaaatagtgatgacgcagtctccagccaccctgtctgtcgtccccgaggggaaagagccatcctctcctgcagggccagtcagagtatagcaccaacttagccgtggtaccagacaacgaaacctggaccagacctcccgaggcctcctacatctagtcggtcgcactcccaccgacgggccacgtggtactcccgagggcctagggttcaggtcggacgtagggtcggggtcgtaggggactaggtacgttaccacgttccgtacaaccacgtacccaacgacgtacgtacggacgtccgtaggtaacgttagttttacgacgttaggttacgttaacgttacgttacggtacctaacgttacggtttacgggttaccttacgaacctaacgtaaccgggttacgggtacccggtttaccgggaaccggtaaacgggggtaaccgtaaacgggttaacggtaaaacgttaacgtaaaaccggtaaagttacgggttacgggaccgttaacggacccgttaacctaacgtttccgttacgttaccgtttaccctaccgtttacccgttcccccgtaaccg

SEQ ID NO: 202948 - DNA, 834 bp, Homo sapiens
  misc_feature: GYAE6OF01CF922.34.63.F08.1.454.CMB.1.raw
  modified_base (199)..(199): a, c, t, g, unknown or other
  misc_feature (199)..(199): n is a, c, g, or t
tcagtacacgtgatcacgaccggtgctcgatttagcgatcgtataagggggaggaactgctcagttaggacccagacggaaccatggaagccccagcgcagcttctcttcctcctgctactctggctcccagatactactggagaaatagtgatgacgcagtctccagccaccctgtctgtcgtccccgaaggggaaanacgcctatcctctcctgcgacgggccaggtcaggtagtattacgccacctaacttacgcctaggtaccagtacaacggaaaccctggaccaacgacctcccgaggtcctccctacactcgtaagtcgggtcactactacccgaaccgacgggtaccctacgttacgggtaacctaccccggaagggtccgtaagggtttaccgaagggttccgggaacgtaacggggttcgggggtaccgtacgggggtaacctagggttaaccgtttaccgtaaccttaccgtacccgtaaccccgtaagttacccgaacggtacccgtaacggttcgtaccggtacgtaacggtttcccgttaaagggtaaacgttttacgttttacgggtaccttttaaaggtttttaaccgtttaaccgttacggttaaccgtaacggtaaccttaaaccgtttaagttaaaacgggtttaccgggttaccggtacccccgtttaacggtaaccgttacccgttaaaccccggttccggggaaccggaaaccgggtaaccgtaccggtacggtaaggtaaacggttaaacgttaaaccggtaggtcggtacgccgttacgtacctaccgtactttaccgtgttcttaaccg

SEQ ID NO: 202949 - DNA, 673 bp, Homo sapiens
  misc_feature: GYAE6OF01D2L1U.34.63.F08.1.454.CMB.1.raw
  modified_base (195)..(195): a, c, t, g, unknown or other
  misc_feature (195)..(195): n is a, c, g, or t
  modified_base (447)..(447): a, c, t, g, unknown or other
  misc_feature (447)..(447): n is a, c, g, or t
tcagtacacgtgatcacgaccggtgctcgatttagcgatcgtataagggggaggaactgctcagttaggacccagacggaaccatggaagccccagcgcagcttctcttcctcctgctactctggctccagatactatggagaaatagtgatgacgcagtctccagccacctgtctgtcgtctccgaaggggaancgcccaccctctcctgcgacgggccagtcgaggtagttggttggccagacctaactttagccgtggtaaccaggcaacggtaaaccgtgggacccaagggtcctaccgaagtaccgttcctacgacttcccgttaatcggtaccttaaccgactccccgaacggaccgggaccctagttccgtacttaaccgttccgaaacggtccgttaggttacctaggtacggcgtaaggttcgggtactcgggaaacnggtacgtcctacgtctaccgactagtcacgcacgtcctgctagtacgtagtaagtcttacgtgtacctttactttagtcgtattacgagtacgtagttaacgtaagttacggtcggtaacggtcggttaccggtacggaaccggtaacggggtaaactacggggtaacgtaaacgtacgtaaacgtcgtagggtcaagttccacgtactacgttctagttctaccg

SEQ ID NO: 202950 - DNA, 754 bp, Homo sapiens
  misc_feature: GYAE6OF01EO8FC.34.63.F08.1.454.CMB.1.raw
tcagtacacgtgatcacgaccggtgctcgatttagcgatcgtataaggggggaggaactgctcagttaggacccagacggaaccatggaagccccagcgcagcttctcttcctcctgctactctggcctcccagatactactggagaaatagtgatgacgcagtctccacgccaccctgtctgtcgtccccgaaggggaaagacgccactcctcctcctgccgagggccagtcagagttattagaccacctaacttcgcctagtaccagacaacgaaccgtcgaccagaccctaccgaggcctcctacgatacgttagtggtcgacacgtcccacggtacgggaccctacgtacggtacctcccgaggtcgtacgggttcacggtggacgtagggtcgggtacgtgggactaggtacgttaccacgttccaccgaacctataccgacgtctaggttcctacggcctagttaccgtagtaacgttttacgttttcggacttttaacggttttaactttcggtacggttaccgtaagtaacctttaacggttaaatttaacggttaccgggttacccggtacccttaaccccgttaatacccccggttaaccgggttacccggaacccggtaacggggtaaaccctaccgggtaaacggtaagggtaaccgttaaaaacgggttaaccgtaaggttcgggtaccgtatacccggtaccgttaaactaccgtttaccggtttgttaccccgttaccg

SEQ ID NO: 202951 - DNA, 829 bp, Homo sapiens
  misc_feature: GYAE6OF01C2XKX.34.63.F08.1.454.CMB.1.raw
  modified_base (225)..(225): a, c, t, g, unknown or other
  misc_feature (225)..(225): n is a, c, g, or t
tcagtacacgtgatcacgaccggtgctcgatttagcgatcgtataagggggaggaactgctcagttaggacccagacggaaccatggaagccccagcgcagcttctcttcctcctgctactctggcctcccagtatactacgtagggaagaaaattaggtgatggacgcgagtcctaccgagccctacctgtctgtcgacccgaggggaaagcgcctactcctcnccgtcgcgacggcctagtacaggtagttactacgaccaactaactacggcctacggtaccagacgaacgaaaccgtcggaccaacggacctcccgacggtcctacctactacgttacgtagtcgggtcaacctaccgtacccgaaccggtacgggaccctaacggtacgggtaaccctcccggaacggtacggtaacgggttacgtacggggtacgggtccgtaggggttcgggggttaaccggtagggggtaaaccgtaacgggttacccggttaccctaaccgtacccgtaccaaaccggttactacggtacgtacgtacgttcggtacgacggttaacgtacgtaacggttaatttacgttttcgtaacgtttaagttttaactacggttacgtacgttacgtaacttaataaacgtttaacggaacgtttccggtacccgttacgttaacttaccccggttaaccggttacccggggaaccgaaccggggtaaccttaacggaaacggttacggtaaacgtaaaacccggttaaggtaaccggttggtacccggtactaccgggtaacctaccgttagtttccgttcttaccggttaccg

SEQ ID NO: 202952 - DNA, 657 bp, Homo sapiens
  misc_feature: GYAE6OF01DXHPD.34.63.F08.1.454.CMB.1.raw
  modified_base (427)..(427): a, c, t, g, unknown or other
  misc_feature (427)..(427): n is a, c, g, or t
tcagtacacgtgatcacgaccggtgctcgatttagcgatcgtataaggggggaggaactgctcagttaggacccagacggaaccatggaagccccagcgcagcttctcttcctcctgctactctggctcccagataccactggagaaatagtgatgacgcagtctccagccacgtgtctgtgtctccgagggaaagactccaccctctcctgcgagggccagccagtagtgtagcagctacgttggtctggtaccagacaacgaaccgtggccacggcctcccgagcctcctctatctagtcggtgcctactcccgaccggacgggccctacgttggtacctcccgacgcccgtagggttacacggtcggacgtagggtcgggtacgtgggaacaagtacttcacctcctacaccctatcgcgtacncgccgtcgacgtcgtactaggttaacgttgttttacgtactttaaggttttactaacgtcttacgagttactaagttaacttaacgtaaccggtccggtacccgggttaccgggggttacgtacccgggaacggaccgggtaacgttaagggtaacgtaccttaaacgaacggtaccggttagccggtactccacgtacctcgttactcgttcttccgtacgttcccccg

SEQ ID NO: 202953 - DNA, 810 bp, Homo sapiens
  misc_feature: GYAE6OF01AVDVM.34.63.F08.1.454.CMB.1.raw
  modified_base (474)..(474): a, c, t, g, unknown or other
  misc_feature (474)..(474): n is a, c, g, or t
  modified_base (777)..(777): a, c, t, g, unknown or other
  misc_feature (777)..(777): n is a, c, g, or t
tcagtacacgtgatcacgaccggtgctcgatttagcgatcgtataagggggaggaactgctcagttaggacccagacggaaccatggaacgccccagcgcagcttctcttcctcctgctactctggcctccagatactacgtggaagaaatagtgatcgacgcagtcctaccacgccctacccttgtccgtcggtaccgttaccccggaaagggggtaaacgccgccctaccttcccttcccgttcccgtgaccggacgggtacccgaagttaccgaaggtaattaacgttaccgaccctaaacctaacgttacgtccgttaacggtaaccacgactaaaccggtaaaccctccgggaacctaacgaacccgtcccgaacggtcctacctcgtaagtcttaagtcggtcacctaccgttacccgaccggaccggtacctacggtaccggtaccgtccgacggtacgtacggtcnggttcggacgtaggttcgggtacggtacggaacgacgttccgttaccgacctttcgaacctaacctaggtcccgtaaggaccgttaacgtttcgaccggtacgtacgttacggttaaggtttacgttactttacgggttaactttagttttacgtacgttacgtacgtacgtaacttaattaaactaacgggttaccgtaaccgtcccttaaacggttccgttaccgttaccggttacccgggaacgttaaccgggactaacggtacgtaaacggagttaacccgtaaatcgggtaataccgntaacgtcctaggttaacctcttcgttctacccg

SEQ ID NO: 202954 - DNA, 642 bp, Homo sapiens
  misc_feature: GYAE6OF01AD4TF.34.63.F08.1.454.CMB.1.raw
  modified_base (196)..(196): a, c, t, g, unknown or other
  misc_feature (196)..(196): n is a, c, g, or t
tcagtacacgtgatcacgaccggtgctcgatttagcgatcgtataagggggaggaactgctcagttaggacccagacggaaccatggaagccccagcgcagcttctcttcctcctgctactctggctcccagatactactggagaaatagtgatgacgcagtctccagccacctgtctgtcgtccccgaggggaangccatcctctcctgcgaggcagtcagagtatagcacaacttagcctggtaccagcagaacctggaccacgactcccgaggcctcctcactctatgggtacactactccaccgacgggcctaacgtcggtactcccgaggctagggttcaggtcggacgaggtcgggtcacggggtacaggcgttccactcctaccacctagccgagaccgtacgttcctggacctaggtccgtaaggtaagttattttacgacttaggttttacttacgtcgtacacgtctaaggttaccttaaagttacggtcggtaccgggttacgggtaccggttccgggaaccggtaacgggaccgtaagggtaacggaaacttaaccgaaacggtaaccgtggtacggactcggacctaccgtacgttcgtacgttaccttacgtccgttccgttaccccg

SEQ ID NO: 202955 - DNA, 784 bp, Homo sapiens
  misc_feature: GYAE6OF01ERHX0.34.63.F08.1.454.CMB.1.raw
  modified_base (204)..(204): a, c, t, g, unknown or other
  misc_feature (204)..(204): n is a, c, g, or t
tcagtacacgtgatcacgaccggtgctcgatttagcgatcgtataaggggggaggagctgctcagttaggacccagagggaaccatggaaacccagcgcagcttctcttcctcctgctactctggctccagatatcgaccggagtaaattgtgttgacacagtctccgagcctaccttgttctttgtcctaccgaaggggaaanacgccctaccctcctccgtcgcgagggtcacgtcacgtcgttactaaccacccgtactttccgttacgccttacggtacacgtcgagacgaccgtggaccgacggtccctcccgacggtccttcccgtactacgtttccgttttacggggtccgtacccggtacccgtaccggaccggggtccctaacggttcggaccctaccgtaaccccgaggtaccgtagggttacgtacggtcggcggtacgggttcgggccgttagggaactacggttaacttccaccgttccgtacgaaccgtacgtacggaactacggtaactaccgttagaccgttacgtagtaacggttgtttacgataagttacgttacttacgtgtacgaagtaactaagttacgaacgacgtaaccgtcgtaacggttcgggtaccgggttccgggtaaccggacggtaaaccgggtaacggtaacgggtaacgtaaacgtaaaccgaaacgggttaccgtacgggtacgtactaccggaccgttaaccgtacgtttacggtacctttaccgttacttaccccgttccgttaacccgg

SEQ ID NO: 202956 - DNA, 680 bp, Homo sapiens
  misc_feature: GYAE6OF01AP0HP.34.63.F08.1.454.CMB.1.raw
  modified_base (163)..(163): a, c, t, g, unknown or other
  misc_feature (163)..(163): n is a, c, g, or t
  modified_base (182)..(182): a, c, t, g, unknown or other
  misc_feature (182)..(182): n is a, c, g, or t
  modified_base (205)..(205): a, c, t, g, unknown or other
  misc_feature (205)..(205): n is a, c, g, or t
  modified_base (212)..(212): a, c, t, g, unknown or other
  misc_feature (212)..(212): n is a, c, g, or t
  modified_base (292)..(292): a, c, t, g, unknown or other
  misc_feature (292)..(292): n is a, c, g, or t
  modified_base (306)..(306): a, c, t, g, unknown or other
  misc_feature (306)..(306): n is a, c, g, or t
  modified_base (532)..(532): a, c, t, g, unknown or other
  misc_feature (532)..(532): n is a, c, g, or t
  modified_base (644)..(644): a, c, t, g, unknown or other
  misc_feature (644)..(644): n is a, c, g, or t
tcagtacacgtgatcacgaccggtgctcgatttagcgatcgtataagggggaggaactgctcagttaggacccagacggaaccatggaacgccccagcgcagcttctcttcctctgctactctcggcctccagatactacgtaggagaaatagtgatcgacgnacgtccacacgccaccgtntctacgtcgacccgaaggggaanacgaccnctcctcgcctcgcgacggaccagtacgagtaattatacgaccaaccgtagttaccgcgtacggtacacgacaacgtaccncggaccacgtaccnccacgtcctactcacttgtcggtgtccgctaccgaccaccggacgggtacctacgtaccggtactcccggaaggtccggttaagtcgtcggacgtaccggtagggtccggttacggacgggtactaacggttccgtacctactccggtaaccacgtacgtaccgtagcgtacgtccgtacgtacgtacgtacttaggtaacgtctttaggtacttagttaacgttntacgtacgataagtactagtacgacgttacggtaccggtggtaccgtaccggacgtacggaagtacggtaacggtactaaccggaagtacgtgtacgtccgagtcccgtaancgttaccgttactacgtcccttccgtaccgttcccg

SEQ ID NO: 202957 - DNA, 488 bp, Homo sapiens
  misc_feature: GYAE6OF02HRFSJ.34.63.F08.1.454.CMB.1.raw
  modified_base (388)..(388): a, c, t, g, unknown or other
  misc_feature (388)..(388): n is a, c, g, or t
  modified_base (392)..(392): a, c, t, g, unknown or other
  misc_feature (392)..(392): n is a, c, g, or t
  modified_base (486)..(486): a, c, t, g, unknown or other
  misc_feature (486)..(486): n is a, c, g, or t
tcagtacacgtgatcacgaccggtgctcgatttagcgatcgtataagggggaggaactgctcagttaggacccagacggaaccatggaagccccagcgcagcttctcttcctcctgctactctggctcccagatactactggagaaatagtgatgacgcagtctccagccaccctgtctgtgtccccaggggaaagagccatcctctcctgcagggccagtcagagtattagcaccaacttagcctggtaccagcagaaacctggccagactcccagagtcctcatctatgctacatccaccagggccactgctattccagccaggttcagtggcagtgggtctgggacagagttcactctcaccatcagcagcctgcagtctgaagnttcngctacttttatactgtcagcagtctaatagtgccgtgacgttcggaccaagggaccaaggtgaatacgaaacgactgagctgcacatctgtctnac

SEQ ID NO: 202958 - DNA, 547 bp, Homo sapiens
  misc_feature: GYAE6OF02HZJKH.34.63.F08.1.454.CMB.1.raw
  modified_base (293)..(293): a, c, t, g, unknown or other
  misc_feature (293)..(293): n is a, c, g, or t
  modified_base (371)..(371): a, c, t, g, unknown or other
  misc_feature (371)..(371): n is a, c, g, or t
  modified_base (396)..(396): a, c, t, g, unknown or other
  misc_feature (396)..(396): n is a, c, g, or t
tcagtacacgtgatcacgaccggtgctcgatttagcgatcgtataagggggaggaactgctcagttaggacccagacggaaccatggaagccccagcgcagcttctcttcctcctgctactctggctcccagatactactggagaaatagtgatgacgcagtctccagccaccctgtctgtgtccccagggggaaagagccatcctctcctgcagggccagtcagagtatagcaccaacttagcctggtaccagcagaacctggccagactcccaggctcctcatctatggtncactccacagggccacgtggtactcccgaggctaggttcaggtggcaggtgggtctgggacagagttcactctcaccntcagcagtctgcagtctagtaagtntttgcttagtttattacttgtcagtctactaattaataagtcgccctaccgatcctaccgttccggacgaagggaccacggtactagggtacgtaacgttaaacggactggtacggtcgtacggacctaccgtagtcgttcgttccttacg

SEQ ID NO: 202959 - DNA, 514 bp, Homo sapiens
  misc_feature: GYAE6OF02GUYI4.34.63.F08.1.454.CMB.1.raw
  modified_base (195)..(195): a, c, t, g, unknown or other
  misc_feature (195)..(195): n is a, c, g, or t
  modified_base (390)..(390): a, c, t, g, unknown or other
  misc_feature (390)..(390): n is a, c, g, or t
tcagtacacgtgatcacgaccggtgctcgatttagcgatcgtataagggggaggaactgctcagttaggacccagacggaaccatggaagccccagcgcagcttctcttcctcctgctactctggctcccagatactactggagaaatagtgatgacgcagtctccagccaccctgtctgtgtccccaggggaanagccatcctctcctgcagggccagtcagagtattagcagcaacttggcctggtaccagcagaaacctggccaggctcccaggctcctcatctatggtgcatccaccagggccactggtactcccagccaggttcaggtggcagtgggtctgggacagaattcactctcaccatcagcagcctgcagtctgaagtnttttgctagtttattactgtcagctagtataatactggcctccggggtacgttcggccaagggaccaagggtcggtaattacgaaacggtaactggtcggctgcacacgtctgtcttcattccc

SEQ ID NO: 202960 - DNA, 589 bp, Homo sapiens
  misc_feature: GYAE6OF02H33VS.34.63.F08.1.454.CMB.1.raw
  modified_base (197)..(197): a, c, t, g, unknown or other
  misc_feature (197)..(197): n is a, c, g, or t
  modified_base (402)..(402): a, c, t, g, unknown or other
  misc_feature (402)..(402): n is a, c, g, or t
tcagtacacgtgatcacgaccggtgctcgatttagcgatcgtataagggggaggaactgctcagttaggacccagacggaaccatggaagccccagcgcagcttctcttcctcctgctactctggctcccagatactactggagaaatagtgatgacgcagtctccagccaccctgtctgtgtccccaggggaaagngccatcctctcctgcagggccagtcagagtattagcaccaacttagcctggtaccagcaagaaacctggccagacctcccaggctcctcatctatggtgcactccaccgagggcccacgtggtactccccgaggcaggttcagtggcaggtgggtctgggacagtacgtcactctcaccatcacgcagtctgcagtctagaagtntttgctagtttacttacgtgtacatactactaagttaataaggtcggtcccttaccgacttaccctaaccgtttccggaccaaacgggtaccacggtacgttacgggtaacgtaagtttaaaccggaaacgttcggttacgggaccttacgaccgtaacccgttagtaccttcggtacctttacccg

SEQ ID NO: 202961 - DNA, 514 bp, Homo sapiens
  misc_feature: GYAE6OF02FHB0V.34.63.F08.1.454.CMB.1.raw
  modified_base (294)..(294): a, c, t, g, unknown or other
  misc_feature (294)..(294): n is a, c, g, or t
tcagtacacgtgatcacgaccggtgctcgatttagcgatcgtataagggggaggaactgctcagttaggacccagacggaaccatggaagccccagcgcagcttctcttcctcctgctactctggctcccagatactactggagaaatagtgatgacgcagtctccagccaccctgtctgtgtccccaggggaaagagccatcctctcctgcagggccagtcagagtattagcaccaacttagcctggtaccagcagaaacctggccagactcccaggctcctcatctatggtncatccaccagggccactggtatcccaggtaggttcagtggcagtgggtctgggacagagttcactctcaccatcagcagtctgcagtctgaagattttgctagtttattactgtcagcagtctaataagtggccgtggacgttcggaccaagggaccaaaggtggaaactcgaaacgacgtggtcggctgccaccattctgtcttcacttccttcccgcc

SEQ ID NO: 202962 - DNA, 513 bp, Homo sapiens
  misc_feature: GYAE6OF02FNG3A.34.63.F08.1.454.CMB.1.raw
tcagtacacgtgatcacgaccggtgctcgatttagcgatcgtataagggggaggaactgctcagttaggacccagacggaaccatggaagccccagcgcagcttctcttcctcctgctactctggctcccagatactactggagaaatagtgatgacgcagtctccagccaccctgtctgtgtccccaggggaaagagccatcctctcctgcagggccagtcagagtattagcaccaacttagcctggtaccagcagaaacctggccagactcccaggctcctcatctatggtgcatcccaccagggccactggtatcccaggcaggttcagtggcaggtgggtctgggacagagttcactctcaccatccagcagtctgcagtctgaagtatttgctagtttattactgtcagcagtataatactggccgtcgggacgttcggccgaagggaccaaggtgaagttacaaacgtacgtgtggctgcacactctgtcttactacttcttccccg

SEQ ID NO: 202963 - DNA, 540 bp, Homo sapiens
  misc_feature: GYAE6OF02F3PM5.34.63.F08.1.454.CMB.1.raw
tcagtacacgtgatcacgaccggtgctcgatttagcgatcgtataagggggaggaactgctcagttaggacccagacggaaccatggaagccccagcgcagcttctcttcctcctgctactctggctcccagatactactggagaaatagtgatgacgcagtctccagccaccctgtctgtgtccccaggggaagagccatcctctcctgcagggccagtcagagtattagcaccaacttagcctggtaccagcagaaacctggccagactcccaggctcctcatctatggtgcatcccaccagggccacgtggtactcccgaggcaggttcagtggcaggtggggtctggggacaggtacgttcacgtctcacctatcagcagtctgcagtctagaagtatttgctagtttattactgtcagctactataagtaagtcgtacctaccgtactcctaccgttcgaccgtaagggacacgtacgtaggaagtaacgttaaacgacgttcgtacggcgtacgacacctatcttcgtcttacc

SEQ ID NO: 202964 - DNA, 545 bp, Homo sapiens
  misc_feature: GYAE6OF02FQB0S.34.63.F08.1.454.CMB.1.raw
  modified_base (196)..(196): a, c, t, g, unknown or other
  misc_feature (196)..(196): n is a, c, g, or t
tcagtacacgtgatcacgaccggtgctcgatttagcgatcgtataagggggaggaactgctcagttaggacccagacggaaccatggaagccccagcgcagcttctcttcctcctgctactctggctcccagatactactggagaaatagtgatgacgcagtctccagccaccctgtctgtgtccccaggggaaanagccatcctctcctgcagggccagtcagagtattagcaccaacttagcctggtaccagcagaaacctggccagactccaggctcctcatctatggtgcatccacagggccactggactccaggcaggttcagtggcagtgggtctgggacagagttcactctcaccatcagcagtctgcagtctagagtatttgctagtttattactgtacagactactaataagtaagtggtcctacgtatcctaccgttccggaccgaacgggtacaccggtacgtacgggtaagtaacgttaaacgaacgtcggtacggtacgtacggaccaaccgtactcgttacgtccttaccg

SEQ ID NO: 202965 - DNA, 516 bp, Homo sapiens
  misc_feature: GYAE6OF02HF2R7.34.63.F08.1.454.CMB.1.raw
tcagtacacgtgatcacgaccggtgctcgatttagcgatcgtataagggggaggaactgctcagttaggacccagacggaaccatggaagccccagcgcagcttctcttcctcctgctactctggctcccagatactactggagaaatagtgatgacgcagtctccagccaccctgtctgtgtccccaggggaaagagccatccctctcctgcagggccagtcagagtattagcaccaacttagcctggtaccagcagaaacctggccagactcccaggctcctcatctatggtgcatcccaccgagggccactggtactcccaggcaggttcagtcggcaggtgggtctgggacaggtagttcactctcaccatcagcagtctgctagtctgaagtatttgactagtttattacgtgtcagctactataataggtcgcctcgatcaccgttcggacaaggacacgacgtaggagtaataacgactgtagcgtagcctaccgatctcgtacttccg

SEQ ID NO: 202966 - DNA, 579 bp, Homo sapiens
  misc_feature: GYAE6OF02IB6I5.34.63.F08.1.454.CMB.1.raw
  modified_base (199)..(199): a, c, t, g, unknown or other
  misc_feature (199)..(199): n is a, c, g, or t
  modified_base (311)..(311): a, c, t, g, unknown or other
  misc_feature (311)..(311): n is a, c, g, or t
tcagtacacgtgatcacgaccggtgctcgatttagcgatcgtataagggggagggaactgctcagttaggacccagacggaaccatggaagccccagcgcagcttctcttcctcctgctactctggctccagatactactggagaaatagtgatgacgcagtctccagccaccctgtctgtcgtccccgaggggaaagngccatcctctcctgcagggccagtcagagtatagcaccaattagcctggtaccagcaacgaaacctggaccagacctcccaggctcctctatcctatggtgcactccaccgngggcccagtcggtactcccgaggctaggttcaggtgcaggtggtcgtgggacagtgttacactctacaccatcagcagtctgcagtctgaacgtgtttgcgttagtttacttactgtcagactactaattaaagtacgtacgtaccgtaccgtactacgttacccgtaccggacgaacgggtaccaacggacgtacggtaacgtaaacgttaaaccgacgtacggtacggtcgtacgacgtaaccctacgtcttacgtacctttaccg

SEQ ID NO: 202967 - DNA, 519 bp, Homo sapiens
  misc_feature: GYAE6OF02GGYQ2.34.63.F08.1.454.CMB.1.raw
  modified_base (294)..(294): a, c, t, g, unknown or other
  misc_feature (294)..(294): n is a, c, g, or t
tcagtacacgtgatcacgaccggtgctcgatttagcgatcgtataagggggaggaactgctcagttaggacccagacggaaccatggaagccccagcgcagcttctcttcctcctgctactctggctcccagatactactggagaaatagtgatgacgcagtctccagccaccctgtctgtgtccccaggggaaagagccatcctctcctgcagggccagtcagagtattagcaccaacttagcctggtaccagcagaaacctggccagactcccaggctcctcatctatggtncatccaccagggccactggtatcccaggcaggttcagtgcagtggtctgggacagagttcactctcaccatccagcagtctgcagtctgaagtatttgctagtttattactgtcagtcactaataataagtcggcctaccgattcctacccttcggacccaaagggacaacggtactgggaacgaattaaaccggaacgtggtaggctgcaccatctgtcttacg

SEQ ID NO: 202968 - DNA, 549 bp, Homo sapiens
  misc_feature: GYAE6OF02GVLRH.34.63.F08.1.454.CMB.1.raw
  modified_base (381)..(381): a, c, t, g, unknown or other
  misc_feature (381)..(381): n is a, c, g, or t
  modified_base (386)..(386): a, c, t, g, unknown or other
  misc_feature (386)..(386): n is a, c, g, or t
  modified_base (390)..(390): a, c, t, g, unknown or other
  misc_feature (390)..(390): n is a, c, g, or t
tcagtacacgtgatcacgaccggtgctcgatttagcgatcgtataagggggaggaactgctcagttaggacccagacggaaccatggaagccccagcgcagcttctcttcctcctgctactctggctcccagatactactggagaaatagtgatgacgcagtctccagccaccctgtctgtgtccccaggggaaagagccatcctctcctgcagggccagtcagagtattagcaccaacttagcctggtaccagcagaaacctggccagactcccaggctcctcatctatggtgcatcccaccagggccactgctattccagccaggttcagtgcagtgggctgggacagagttcactctcacatcagcagcctgcagtcngaagnttcngctactttattactgtacagtcagttactaagtaggtcggtccggtacggtacgtttccggaccgtaaacggggaccgtaagggtcggtaaaacgtccgaaaacggtaacgttggtacggacttaggaccaccgtagttccgttacgttcttactaccg

SEQ ID NO: 202969 - DNA, 747 bp, Homo sapiens
  misc_feature: GYAE6OF02G9865.34.63.F08.1.454.CMB.1.raw
tcagtacacgtgatcacgaccggtgctcgatttagcgatcgtataagggggaggaactgctcagttaggacccagacggaaccatggaagcccagcgcagcttctcttcctcctgctactctggctcccagatactactggagaaatagtgatgacgcagtctccagccaccctgtctgtcgtccccgaaggggaaagagccatcctctcctgcagggccagtcagagtatagcaccaacttagcctggtaccagcagaaacctggccagacctccaggctcctcatcttaagtggtcgctaactcccaaccgacggggaccctaacgttcgggtactccccgaagggtccgtaacgggtttcacgggttcgggacaacgggttcgggggtcgttacgggggactaagggacgtttaccgaaccttccctacgaaccctacgtaccgagtaccgtaggttccttcggaccgttaacggtaccgttaaggtaaaggtttacgtttttacggaccttaaaggtttttaacctttaacgttcgtacgtaacgtactaacctaaagttaaagttaaacggttccggaccctttaccggtaacttacccgttaaccgtttacccggggaaacctaaacgggggtaccctaacgggtacgttaggggaacgttaaaacgtttaaacccggtaacgttcggtacggtcgttacggtaccctaacgtacggtttccttacggtttcccttaaccg

SEQ ID NO: 202970 - DNA, 578 bp, Homo sapiens
  misc_feature: GYAE6OF02JULZ5.34.63.F08.1.454.CMB.1.raw
  modified_base (282)..(282): a, c, t, g, unknown or other
  misc_feature (282)..(282): n is a, c, g, or t
  modified_base (290)..(290): a, c, t, g, unknown or other
  misc_feature (290)..(290): n is a, c, g, or t
tcagtacacgtgatcacgaccggtgctcgatttagcgatcgtataagggggaggaactgctcagttaggacccagacggaaccatggaagccccagcgcagcttctcttcctcctgctactctggctcccagatactactggagaaatagtgatgacgcagtctccagccaccctgtctgtgtccccaggggaaagagccatcctctcctgcagggccagtcagagtgttggcagcaacttagcctggtaccagcagaacctggccaggctcccagagtccncatcctangctacactcccaccacgggccactcgctaacttccagccgtagttcaggtcggcaggtcgggtctgggacagtacgttcactctcaccatcagcacgcctgcgacgtctagaagtatttgacttagtttattactgtcagctaacgttactaagtaggttcggtaccgttgggtacgttcggaccggtaaacgggaccgtaaagggtacgtaaagtaccgtaaaacggtaccgtaggttacggaccgttcgaaccgtacctagttccgttacggttccttacgtaccg

SEQ ID NO: 202971 - DNA, 596 bp, Homo sapiens
  misc_feature: GYAE6OF02GQ9BW.34.63.F08.1.454.CMB.1.raw
tcagtacacgtgatcacgaccggtgctcgatttagcgatcgtataagggggaggaactgctcagttaggacccagacggaaccatggaagccccagcgcagcttctcttcctcctgctactctggctcccagatactactggagaaatagtgatgacgcagtctccagccaccctgtctgtgtccccaggggaaagagccatcctctcctgcagggccagtcagagtattagcaccaacttagcctggtaccagcagaaacctggccagactccaggcctcctcatctatgtgcatccaccgagggccacgtggtactcccaggcaggttcaggtggcaggtgggtctgggacaggagttcactctcaccatcagcagtctgctagtctagaagtatttgcttagtttattactgtacagtctagttaactaaattacgtcggacccgttccgggggtacgttccgggaccgaaacgggtaccctaaagggtcggtaacgttaccgaaaacggtacgttagggtacggtaccgtacggaacctaaccgtacgttacgttccggttacctttacgtacctttcccgttaacccccgg

SEQ ID NO: 202972 - DNA, 597 bp, Homo sapiens
  misc_feature: GYAE6OF02FQD5T.34.63.F08.1.454.CMB.1.raw
  modified_base (197)..(197): a, c, t, g, unknown or other
  misc_feature (197)..(197): n is a, c, g, or t
  modified_base (235)..(235): a, c, t, g, unknown or other
  misc_feature (235)..(235): n is a, c, g, or t
  modified_base (298)..(298): a, c, t, g, unknown or other
  misc_feature (298)..(298): n is a, c, g, or t
  modified_base (410)..(410): a, c, t, g, unknown or other
  misc_feature (410)..(410): n is a, c, g, or t
  modified_base (422)..(422): a, c, t, g, unknown or other
  misc_feature (422)..(422): n is a, c, g, or t
tcagtacacgtgatcacgaccggtgctcgatttagcgatcgtataagggggaggaactgctcagttaggacccagacggaaccatggaagccccagcgcagcttctcttcctcctgctactctggctcccagatactactggagaaatagtgatgacgcagtctccagccaccctgtctgtgtctccgaggggaaanagcccaccctctcctgcagggccagtcagagtgttaangcatctacttagcctggtaccagcagaaacctggccagcctcccagactcctcattaatggtncatactacgacgggcccctggccactcccagacaggttcaggtggcaggtcgggtctaggggacaggtacttcgacttcacaccatacaccagacgtggagccgtagaagtntttcgactagtnttattactgtactacgtagttgtactacgacacgtacggtcggtaccggttacggaccgaaacgggtaaccgaagggtacggtaaacgtaccgaaacggtaccgttaggtacggtaccgtacgaccgtaccgtacgttacgttacggttacccttactacgttcccgttaccccg

SEQ ID NO: 202973 - DNA, 507 bp, Homo sapiens
  misc_feature: GYAE6OF02IPHZ5.34.63.F08.1.454.CMB.1.raw
  modified_base (194)..(194): a, c, t, g, unknown or other
  misc_feature (194)..(194): n is a, c, g, or t
  modified_base (393)..(393): a, c, t, g, unknown or other
  misc_feature (393)..(393): n is a, c, g, or t
  modified_base (484)..(484): a, c, t, g, unknown or other
  misc_feature (484)..(484): n is a, c, g, or t
tcagtacacgtgatcacgaccggtgctcgatttagcgatcgtataagggggaggaactgctcagttaggacccagacggaaccatggaagccccagcgcagcttctcttcctcctgctactctggctcccagatactactggagaaatagtgatgacgcagtctccagccaccctgtctgtgtccccagggaanagccatcctctcctgcagggccagtcagagtattagccaccaacttagcctggtaccagcagaaacctggccagactccagctctcatctatggtgcatccaccgagggccactggtactccccgaggcaggttcaggtggcagtgggtctgggacagagttcactctcaccatcagcagtctgctagtctagtaagtntttgcttagtttattactgtcagtctactataatagtcgctcgattcaccgttcgaccgaaggaccacgatcggagtattaaacgacttgngctacgacaccagtctagtcttc

SEQ ID NO: 202974 - DNA, 639 bp, Homo sapiens
  misc_feature: GYAE6OF02HL1C7.34.63.F08.1.454.CMB.1.raw
tcagtacacgtgatcacgaccggtgctcgatttagcgatcgtataaggggggaggaactgctcagttaggacccagacggaaccatggaagccccagcgcagcttctcttcctcctgctactctggctcccagatactactggagaaatagtgatgacgcagtctccagccaccctgtctgtcgtccccgaaggggaaagagccactccctcctcctgcgacgggccagtcagagtattagccaacctaacttacgcctggtaccagacaacgaaacctcggaccacgacctcccgaggccttcctacactctagtgggtcgactactacccaccgacgggccctacgtcggtactcccgaggcgtaggttcaggtggcgtaggtcgggtcgtgggacagtacgttacactccgtacacctatcgagcgtagtctagacgtagtcgtagtaagttagtttgacgttagttttaacttcgttacgttacgagtacctaaacgttaagttaaagttacggtacgtaccctacgtacttaccgtaccgttaccgggacgaaacggacctaacggactagggtaacgtaacgttaacgaacgtggtacgtactacgacctactacgttcgttactcgttaacc

SEQ ID NO: 202975 - DNA, 746 bp, Homo sapiens
  misc_feature: GYAE6OF02HDVHC.34.63.F08.1.454.CMB.1.raw
  modified_base (199)..(199): a, c, t, g, unknown or other
  misc_feature (199)..(199): n is a, c, g, or t
  modified_base (301)..(301): a, c, t, g, unknown or other
  misc_feature (301)..(301): n is a, c, g, or t
  modified_base (326)..(326): a, c, t, g, unknown or other
  misc_feature (326)..(326): n is a, c, g, or t
tcagtacacgtgatcacgaccggtgctcgatttagcgatcgtataagggggaggaactgctcagttaggacccagacggaaccatggaagccccagcgcagcttctcttcctcctgctactctggcctcccagatactactggagaaatagtgatgacgcagtctccagccaccgtgtctgtgtcctccgaggggaaangtccaccctctcctgcagggccagccagagtgtagcagctaacgttggcctggtaccagcaagaacctggccaggcctcccgaggcctcctcatctatggtncactcccacgaggccacgtgtaccnccagtcctaggttcaggtcgcaggtcgggtactgggaactaggtaacttccaacgttcctaccaacctatccgacgacgacgtcctggacctacggttaccgtaggtaaacgtttacgtttttacggacgtttaacggtttttaactttaccgtacgggtttaccaaaggttaccgtaaaaggtttaacttaaaaccgtttaaacggttccggggttaaccccggttacccggggggttaaccgtttccggggaaaccgggtaaaccggggtaaacccggtaaggggtttacgggtaaaccgtttaaccggtaaaaacccgggtcggtttaaccgggtacgggttacccgttaacggtaccctaaccggttacgttacccggtttacggttaccctttacccgtccgtttaaccccccgg

SEQ ID NO: 202976 - DNA, 632 bp, Homo sapiens
  misc_feature: GYAE6OF02IL9CB.34.63.F08.1.454.CMB.1.raw
  modified_base (368)..(368): a, c, t, g, unknown or other
  misc_feature (368)..(368): n is a, c, g, or t
tcagtacacgtgatcacgaccggtgctcgatttagcgatcgtataagggggagggaactgctcaggttaggacccagacggaaccatggaagccccagcgcagcttctcttcctcctgctactctggctcccagatactactggagaaatagtgatgacgcagtctccagccaccctgtctgtcgtccccaggggaaagagccatcctctcctgcagggccagtcaggagtatagaccacctaactacgacgtacgtaccagcaagaacctacggaccagacctaccgaggtcctcctcatactagtcggtacactactacccgacgacggccacgtcgtacgtaccgaggacgtacgttacgtaggnggactagggtcggtcgtacggactagtacgtactactcctaccaacctactaccgacgacgtacgtctacggacctacgtcgtacgtaacgttctttacgacgttagttttacttacgttcgtacacgtactacttaataacgtacggtccgtcctacgtactacgtaccgttcgaccgtaacgaccacgtacgtaggtaacgtaacgttaaccgacgttcggtacggacgtacgacctaacctagttcgttaccgtattaccg

SEQ ID NO: 202977 - DNA, 642 bp, Homo sapiens
  misc_feature: GYAE6OF02HO119.34.63.F08.1.454.CMB.1.raw
  modified_base (197)..(197): a, c, t, g, unknown or other
  misc_feature (197)..(197): n is a, c, g, or t
tcagtacacgtgatcacgaccggtgctcgatttagcgatcgtataagggggaggaacgtgctcagttaggacccagacggaaccatggaagccccagcgcagcttctcttcctcctgctactctggctcccagatactactggagaaatagtgatgacgcagtctccagccaccctgtctgtgtccccaggggaagngccatcctctcctgcacgggccagtcaggagtattagccaccaacttagcctaggtaccagccaagaaacctggccagacctcccaggcctccgtctatctactggtcgctactccgaccacgggacccacgtggtactcccgaggtcgaggttcaggtggctaggtcgggtctagggcagtagtcacgtcactaccatcgacgctagtcctagctaagtcgtagtaagtacgtttgaccgttagtttaacttacgttagtacgacgtactaataattaaacgttaaggtacgtacccgttaccgtacgttaccgtacccgttaccgggaaccgaacgggtaaccgaccggacgttacgggtaacgtaacggttaaaaccgttaacgttcgggtacggtacgttacggaccctaaccgtactttacccggttgttaccgttaccg

SEQ ID NO: 202978 - DNA, 691 bp, Homo sapiens
  misc_feature: GYAE6OF02HI1CY.34.63.F08.1.454.CMB.1.raw
  modified_base (201)..(201): a, c, t, g, unknown or other
  misc_feature (201)..(201): n is a, c, g, or t
  modified_base (256)..(256): a, c, t, g, unknown or other
  misc_feature (256)..(256): n is a, c, g, or t
tcagtacacgtgatcacgaccggtgctcgatttagcgatcgtataaggggggaggaactgctcagttaggacccagacggaaccatggaagccccagcgcagcttctcttcctcctgctactctggctccagatactactggagaaatagtgactgacgcagtctccacgccaccctgtctgtcgtccccaagggggaaanagccatcctctcctgcacgggccagtcagagtatagcactacttagctggtaccngcacgaactggaccagcctaccgaggtctccctacattcctaagtggttcgactacgtacccacgacgggcccaagtcgggtactcccggaggactaggtttccaggttcggacgtagggttcggggtccgttagggggaaccaaggtttacgttaccgtaccttaccgtacccgtaacctacgtacgaccgtaccgaacgtttccgtacggtaccgtaaggtttcccgtaaggttaaaggttcgttttaccgagtttaacgttttacgttaacgttcgttaacgtacggtacttaacgtaaattaacgttaaggtcgtaccgttacgtaatcccgtactttccgggaactacggactacgtacgtaggaacgtaataaaccggcttggtacggtcacgtacctaaaccgttgttaaccgtcgttaccttaaccg

SEQ ID NO: 202979 - DNA, 760 bp, Homo sapiens
  misc_feature: GYAE6OF02GQRMA.34.63.F08.1.454.CMB.1.raw
  modified_base (193)..(193): a, c, t, g, unknown or other
  misc_feature (193)..(193): n is a, c, g, or t
tcagtacacgtgatcacgaccggtgctcgatttagcgatcgtataagggggaggaactgctcagttaggacccagacggaaccatggaagccccagcgcagcttctcttcctcctgctactctggctccagatatcaccggagaaattgtgttgacacagtctccaggcacctgtctttgtctcgagggaaancgccacctctctgcgagggccagtcagagtgttagcgactactagccgtggtaccagacaagaaaccgtggaccgaggcctccgaggtcctccgtcatctatcgatgccgtaccaacgacgggcccacgtggacactcccagccgtaggttcaggtcggcgtaggttcggggtcgtcggggacctaaggtccttaccgacttccgtaacccgacctacgtccgaacgccgtaacggtacccgttaaggaaccgtaaccgtttaaaaggttacttttacggaaccttttaaagtttacttaacgttcgtaacgtacggtccgttacgggtaccgttaacgtaccgtaaaccggttcggttaccccttacccgttagggaacccggtcccggttaaccccggtttccggggaaccccgggtaacgggtaacccgtaaccgggttaccgggtagggttaaaccgttaaaccggttaaaaccggtacgggtttacgggttaccggtacgtttaccggacccgttaaacccgttacgttccggtttacggtttacccttacggttaaccccg

SEQ ID NO: 202980 - DNA, 555 bp, Homo sapiens
  misc_feature: GYAE6OF02FIZTM.34.63.F08.1.454.CMB.1.raw
  modified_base (374)..(374): a, c, t, g, unknown or other
  misc_feature (374)..(374): n is a, c, g, or t
tcagtacacgtgatcacgaccggtgctcgatttagcgatcgtataagggggaggaactgctcagttaggacccagacggaaccatggaagccccagcgcaacttctcttcctcctgctactctggctcccagatactactggagaaatagtgatgacgcagtctccagccaccctgtctgtgtccccaggggaaagagccatcctctcctgcagggccagtcagagtattagcaccaacttagcctggtaccagcagaaacctggccagactcccaggcctcctcatctatggtgcatccaccgagggcccagtggtactcccgaggcagggttcaggtggcaggtgggtctgggacagagttcactctcaccntcagcagtctgctagtctgtaagtagttttgacttagtttattactgtacagctataataataagttcggccttaccgattccgtaccgtttcggacctaacgggaccacgtacgtaggagtaacgttaaacgacgttaggtaggtacgtagaccacctacttcgtcgttcttacgtaccg

SEQ ID NO: 202981 - DNA, 651 bp, Homo sapiens
  misc_feature: GYAE6OF02F1EL2.34.63.F08.1.454.CMB.1.raw
  modified_base (197)..(197): a, c, t, g, unknown or other
  misc_feature (197)..(197): n is a, c, g, or t
  modified_base (308)..(308): a, c, t, g, unknown or other
  misc_feature (308)..(308): n is a, c, g, or t
tcagtacacgtgatcacgaccggtgctcgatttagcgatcgtataagggggaggaactgctcagttaggacccagacggaaccatggaagccccagcgcagcttctcttcctcctgctactctggctcccagatactactggagaaatagtgatgacgcagtctccagcccaccctgtctgtcgtcccgaggggaangccatcctctcctgcagggccagtcagagtattacgacacctaacttagcctaggtaccagccaagaaaccctggccagacctcccgaggccttcctcatctagtcggtcncctactcccacgacgggcctacgtggtactcccgaggctacggttacaggtcggcgtagggtcggggtcgtagggaactagggtacgtttaccacttcgacctaaccgattccgagctacgtctagaccgtagttcgtaaggtaacgtttagtttacgaccgttagttttactacgttcgtacgtacgtactattaacgtaagttacgtacggtacccttacgtaacttccgtacccgttacggaccgtaacgggaactaccggtacgtagggtaaacgttaacggttaaaccgacgtggtacggtactacggacctaacgtcgttcgttacgttcttaaccg

SEQ ID NO: 202982 - DNA, 614 bp, Homo sapiens
  misc_feature: GYAE6OF02I73WW.34.63.F08.1.454.CMB.1.raw
  modified_base (355)..(355): a, c, t, g, unknown or other
  misc_feature (355)..(355): n is a, c, g, or t
tcagtacacgtgatcacgaccggtgctcgatttagcgatcgtataagggggaggaactgctcagttaggacccagacggaaccatggaagccccagcgcagcttctcttcctcctgctactctggctcccagatactactggagaaatagtgatgacgcagtctccagccaccctgtctgtcgtccccgaggggaaagcgccatcctctcctgcagggccagtcagtagttatacgccaacctaacttaggccttagggaaccagcaacgaaaccgtggacccagacctcccgaggccctcctacactctagtggtcgaccactcccgaaccgacggggccctacgtcggtaccncccgaggactacggttctaggtcggcgaggtcgggtcggtggacgaggtacgttcgactcgtacaccagttcacgtctacgttccgtaggtactcgtagtaagttagttttgcgttagtagttactttagtcgtacacgtagttcgtctcacacgtacgtgggaccgttcgggaacctaacgggacgtaaggtagtaacgtacgaaacgtcgtaggtcgactcgacgaccgtactcgttctacttactccttctacccg

SEQ ID NO: 202983 - DNA, 793 bp, Homo sapiens
  misc_feature: GYAE6OF02JVHF0.34.63.F08.1.454.CMB.1.raw
  modified_base (204)..(204): a, c, t, g, unknown or other
  misc_feature (204)..(204): n is a, c, g, or t
  modified_base (499)..(499): a, c, t, g, unknown or other
  misc_feature (499)..(499): n is a, c, g, or t
  modified_base (507)..(507): a, c, t, g, unknown or other
  misc_feature (507)..(507): n is a, c, g, or t
  modified_base (630)..(630): a, c, t, g, unknown or other
  misc_feature (630)..(630): n is a, c, g, or t
tcagtacacgtgatcacgaccggtgctcgatttagcgatcgtataagggggagggaactggctcagttaggacccagacggaaccatggaacgccccagcgcagcttctcttcctcctgctactctggctcccagatactactggacgaatagtgatgacgtcagtctccagccaccctgtctgtcgtccccaaggggaaacgngccagtccctctccgtggcaacgggccctaagtcgaacgtagtacttacgccaactaactttcggacccttgggtaaccaggtaccaagaaacccgtggaccctaagacccttcccgaacggtcctaccctacgtattaccgtagttacggggtacactaaccttacccgaaccggtaacggggtcccaacgttacgggtactaccccgaggaccgttaggtacctaaggttcggaccgtaggttcgggggaccgtggggaacctagggtctttaccggacctacgtacccgtanacgtacgngtacccgtaagtcctacggtacctaggtttaccgaagtacgttactttacggaacctttagtttaacctacggttagttacagttacctaattacgtaagtacgggttacctaccggttaacncgttaccgaacccgtttacggggaaacccaggggttaaccctaacgggtccgtaaacggttaacggtaaaacccggtttaacggtaaacctcggggttacccgtaacgttacccggacgtttactaaacccggtttttccaaccggttttatttaacccccgg

SEQ ID NO: 202984 - DNA, 733 bp, Homo sapiens
  misc_feature: GYAE6OF02GO80K.34.63.F08.1.454.CMB.1.raw
  modified_base (199)..(199): a, c, t, g, unknown or other
  misc_feature (199)..(199): n is a, c, g, or t
  modified_base (366)..(366): a, c, t, g, unknown or other
  misc_feature (366)..(366): n is a, c, g, or t
tcagtacacgtgatcacgaccggtgctcgatttagcgatcgtataagggggaggaactgctcagttaggacccagacggaaccatggaagccccagcgcagcttctcttcctcctgctactctggctcccagatactactggagaaatagtgatgacgcagtctccagccaccctgtctgtcgtccccgaaggggaaancgcctactcctctccgtgcgacgggccagtcgagtagttattacgcaacctaacgttacgccgtacggaaccagacaacgtaaaccgtcggaccacgacctcccgaggtcctcctacacttctagtggtacacctactaccgaccggacgggcctacgtcggtaccncccggaggtacgtacggttcgaggtcggacgtgggttcgggtcgtacgggaactaggtacttacgaccttcgacctaacgtactacgacgtactcgttcgacgtacgtacggttacgtaaggttaacgtttagtttacgtaccgttttaatttacgttacgtcgttaagtacctaagttaacttaaacgttaaacggttcgggtacccgtttaccgtaccgttaaccgttaccggtttaaccggtaacccggtaaccggtaaacggacccgttacgaacgttaaggtaacgttaaaccggtaaacgtcggttaggtaccgtacgtacccgtaaccgtaccgttacttccgttaccgttcttacccgg

SEQ ID NO: 202985 - DNA, 534 bp, Homo sapiens
  misc_feature: GYAE6OF02GBF04.34.63.F08.1.454.CMB.1.raw
  modified_base (196)..(196): a, c, t, g, unknown or other
  misc_feature (196)..(196): n is a, c, g, or t
tcagtacacgtgatcacgaccggtgctcgatttagcgatcgtataagggggaggaactgctcagttaggacccagacggaaccatggaagccccagcgcagcttctcttcctcctgctactctggctcccagatactactggagaaatagtgatgacgcagtctccagccaccctgtctgtgtccccaggggaaanagccatcctctcctgcagggccagtcagagtatagcaccaacttagcctggtaccagcagaacctggccagactccaggctccctcatctatggtgcatccaccagggccactggtatcccaggctaggttcagtggcaggtggtctgggacaggagttcactctcacatcagcagtctgctagtctgtaagtatttgactagtttattacgtgtacagctactataatagtcgtacctcgatctaccgttcggaccgaagggaccacgtactagggaataacgttaaaccgtaacgtcggttacgactaggacctaccgagttcctgttacttaccg

SEQ ID NO: 202986 - DNA, 713 bp, Homo sapiens
  misc_feature: GYAE6OF02ISSR2.34.63.F08.1.454.CMB.1.raw
  modified_base (208)..(208): a, c, t, g, unknown or other
  misc_feature (208)..(208): n is a, c, g, or t
  modified_base (250)..(250): a, c, t, g, unknown or other
  misc_feature (250)..(250): n is a, c, g, or t
  modified_base (539)..(539): a, c, t, g, unknown or other
  misc_feature (539)..(539): n is a, c, g, or t
tcagtacacgtgatcacgaccggtgctcgatttagcgatcgtataagggggaggaactgctcagttaggacccagacggaaccatggaagccccagcgcagcttctcttcctcctgctactctggctcccagatactactggagaaatagtgatgacgcagtctccgagccaccctgtctgtcgtccccaggggaaacgccatcctcncctgcagggccagtcagagtatagcaccaattgctggtaccngacaagaacctggaccagacctcccggagtcctaccactactagtaggtcgtacgactaccgtacccgaacgggtaccgaccttacggtaccgttacccgaccggtacggttacggttacgtacggtacggtcggacggttaacggggtttcggaccgggttaaggaaccgtaaggtttaccttaccgaccgttaccctaacccaacgtacgtacgaccgactccggttagacctacggtacttggtaaacgttatttcgttactaacgttttattaacgttcgttaanaccggtaataacggttaaataacgttaacgtaccgggtcggttaccccgggtacggtacgggttaacggaaccgttaacgggtaaagttagggaactttaaccggaacgttaagtccggttaggactacgtccgaactagttcgtactaccgttcaccttcgtcccccgttaac

SEQ ID NO: 202987 - DNA, 658 bp, Homo sapiens
  misc_feature: GYAE6OF02G32RC.34.63.F08.1.454.CMB.1.raw
  modified_base (197)..(197): a, c, t, g, unknown or other
  misc_feature (197)..(197): n is a, c, g, or t
tcagtacacgtgatcacgaccggtgctcgatttagcgatcgtataagggggaggaactgctcagttaggacccagacggaaccatggaagccccagcgcagcttctcttcctcctgctactctggctcccagatactactggagaaatagtgatgacgcagtctccagccaccctgtctgtcgtccccgaggggaancgccatcctctcctgcgaggccagtcagagtattacgacacctaacttgcctaggtaccaggcaacgaacctggaccagacctcccgaggcctcctcatctagtggtcgcactcccgacgcggcctacgtcgtactcccgaggcctaggttcaggtgcgtaggtcgggtcgcgggacaggtacgttacacttcgtaccactacgtacgacgtacgtacgtcgtacgactacggttcgtagtaacgtttagtttacggacgtttaagttttaacgttacgtcgttacgacgtactaacttaattaaacgttaccggtaccggtacctaccggttacgttcccgttaaccgggtttcgaaccggtaaacgggtaccaaccggtacgtaaggaacgttaaacgttaaaccggtagtacggtccgttacctcggaccttaccgtattacgttacgttactacccg

SEQ ID NO: 202988 - DNA, 775 bp, Homo sapiens
  misc_feature: GYAE6OF02IRES0.34.63.F08.1.454.CMB.1.raw
  modified_base (346)..(346): a, c, t, g, unknown or other
  misc_feature (346)..(346): n is a, c, g, or t
tcagtacacgtgatcacgaccggtgctcgatttagcgatcgtataagggggaggaactgctcagttaggacccagacggaaccatggaagccccagcgcagcttctcttcctcctgctactctggctcccagatactactggagaaatagtgatgacgcagtctccagccaccctgtctgtcgtcccagggaagagccatcctctcctcgcgagggccagtcagagttattagaccaacctaacttagccgtcggtaccagacaacgaaacctggacccagaccgtccccacggcctcctacacttcctatcggtgtcctactcccaccgacggccacgtggtacncccgaggcgaggttcgaggtggctagggtggtcgtagggacgtagacgttccacgttctaccgacctagtacgacgtcgtagttcccgttaggacgtacgttacgtaaggttaaacgtttagtttttacggtacgttttaaacgtttttaacgtttaccgttacggttacccgtaaacggttaccttaaaccgtttaaaagtttaaacggttaaaccgggttaccgggttaccctttaaccgggttaaccgtttacccgttaaccccgggttttaccgggaaaccccggttaaaagggggtacccctaacgggtaccggtttacgggtaaaccggtttaaagtttaaaaacccgggtacgtttaccgggtaggttacccgtaagacccgtttaacgtaccgtttaacgtttccggttaaccctttaccg

SEQ ID NO: 202989 - DNA, 613 bp, Homo sapiens
  misc_feature: GYAE6OF02FJA42.34.63.F08.1.454.CMB.1.raw
  modified_base (195)..(195): a, c, t, g, unknown or other
  misc_feature (195)..(195): n is a, c, g, or t
  modified_base (370)..(370): a, c, t, g, unknown or other
  misc_feature (370)..(370): n is a, c, g, or t
  modified_base (382)..(382): a, c, t, g, unknown or other
  misc_feature (382)..(382): n is a, c, g, or t
tcagtacacgtgatcacgaccggtgctcgatttagcgatcgtataagggggaggaactgctcagttaggacccagacggaaccatggaagccccagcgcagcttctcttcctcctgctactctggctcccagatactactggagaaatagtgatgacgcagtctccagccaccctgtctgtcgtcccagggaagngccatcctctcctgcgagggcctagtcagagtattacgcaaccaacttagcctggtaccagacagaaacctggccagacctccaggctcctcactctagtgtcgcactcccacgacggtccacgtcgcttacttccgacgtcgtaggtcaggtcgcgtggtcggtacgtgggacnggtactcacctntaccactactccgacgtcgacgcgtacgcgtagttcgagtaacgttcttacgcgtacttacgtttacgttacgttgtactacgtcctaagttactaaaggtacgtcgggtacggtacgttaccggtaccggaccggtaacgggtaaccgtaagggttacaaacgtaacggaaacgtacgtggtacggtcgtaccgtacgtaccgttagtacgttccttacgtacttacccg

SEQ ID NO: 202990 - DNA, 650 bp, Homo sapiens
  misc_feature: GYAE6OF02GCF1V.34.63.F08.1.454.CMB.1.raw
  modified_base (144)..(144): a, c, t, g, unknown or other
  misc_feature (144)..(144): n is a, c, g, or t
  modified_base (199)..(199): a, c, t, g, unknown or other
  misc_feature (199)..(199): n is a, c, g, or t
  modified_base (296)..(296): a, c, t, g, unknown or other
  misc_feature (296)..(296): n is a, c, g, or t
tcagtacacgtgatcacgaccggtgctcgatttagcgatcgtataagggggaggaactgctcagttaggacccagacggaaccatggaagccccagcgcagcttctcttcctcctgctactctggctcccagatactactgganaaatagtgatgacgcagtctccagccaccctgtctgtcgtccccaaggggaaagngccatcctctcctgcagggcctagtcaggagtattagccaccaacttgccctggtaccagccaaggaaaccctggcccagcctccccaggcctcctnactctatgtcgcatccgaccagggtcccacgtggactcccgaggccgtaggttacaggtcggacagggttcggggtctacggggtacaaggtacgttccaacgtcctacccgacctatccgacgtcgacgtcgtcgacgtacgtctacggtaaacgtagttttacgacgttaagttttacttacgtcgttacgacgtacgtaactaacgtaaattaccggttcgtacccgttaccgactacccgttaccgttaccggaccgtaacggaccgtaacggacgtaggtaacgttaacgttaaaccgtacgttcggacggtcctacggccctaaccgtactccgttagttccttaccg

SEQ ID NO: 202991 - DNA, 721 bp, Homo sapiens
  misc_feature: GYAE6OF02JCPKA.34.63.F08.1.454.CMB.1.raw
  modified_base (257)..(257): a, c, t, g, unknown or other
  misc_feature (257)..(257): n is a, c, g, or t
  modified_base (319)..(319): a, c, t, g, unknown or other
  misc_feature (319)..(319): n is a, c, g, or t
  modified_base (545)..(545): a, c, t, g, unknown or other
  misc_feature (545)..(545): n is a, c, g, or t
  modified_base (555)..(555): a, c, t, g, unknown or other
  misc_feature (555)..(555): n is a, c, g, or t
tcagtacacgtgatcacgaccggtgctcgatttagcgatcgtataagggggagggaacgtagctcagttaggacccagacggaaccatggaagccccagcgcagcttctcttcctcctgctactctggctcccagatactactggagaaatagtgatgacgcagtctccagccaccctgtctgtcgtccccgaaggggaaagcgtcccaccctctccctgcgacgggccagcagagtgttggcagactaacgttacncctggtaccagcaacgaaaacctggaccaggcctacccagacgttccctacacttaccttanacggtactaacctaactaccccaaccgacggtccctaacggtcacttacgttccacggaccctaggttccaggtcggacgtaggtcgggtaccgttaggggaactaaggtacgttaccacgttaccgttaccaaccgtactacgtaccggcaccgtccctagacctaccggttataaccgggaaattattacccgacgttactttaaccgttttaatacccgggtntaacccggtnacccgttaagtacttaaacgtacggtagggtccgtaggtaacccgtttcggaaaccggtaaacgggacccgtaaaggtagtaaaaccgttaaccggaaacgtaaccggttggtaacgtacccgttgaacccgtactacccgtgtttaccgttactaccttaaccgg

SEQ ID NO: 202992 - DNA, 776 bp, Homo sapiens
  misc_feature: GYAE6OF02HXWPR.34.63.F08.1.454.CMB.1.raw
tcagtacacgtgatcacgaccggtgctcgatttagcgatcgtataagggggaggaactgctcagttaggacccagacggaaccatggaagccccagcgcagcttctcttcctcctgctactctggctcccagatactactggagaaatagtgatgacgcagtctccagccaccctgtctgtcgtcccgaggggaagagccatcctctcctgcgagggccagtcaagagtattagcaacctaacttagcctaggtaccagacaagtaaaccgtcgccacgtacctccgaggccctcctcacttcgtaagtgggtacacgtactaccgaacccggacgggccctacggtacgggttacctaccccgagggtcctacggggttacctaggttccggagtacgggttgggtcgtggggaactaggtacggtttacaccgtctaccgaaccgtataccgaacgtccgtaaggttcctacgggtaacctacggttgtacggaaacgtagttcgggtacgggttacttttaacgggttttaacgttaccgttggtaccgttaaacgtaacgtttaaactttaacggttaacgtttacccgttcccgttacccgtccgttaaccgttttaaccgggttttaccggggaacggggtaacccgggttaaaccggtaacggggtttaacggtaactttaacccgggaaaacggttaccggttacggttacggtaccgttacggaccttacggttaaccttcgtaccgttttaccgtaccgttacccg

SEQ ID NO: 202993 - DNA, 780 bp, Homo sapiens
  misc_feature: GYAE6OF02JZ29I.34.63.F08.1.454.CMB.1.raw
  modified_base (104)..(104): a, c, t, g, unknown or other
  misc_feature (104)..(104): n is a, c, g, or t
  modified_base (128)..(128): a, c, t, g, unknown or other
  misc_feature (128)..(128): n is a, c, g, or t
  modified_base (193)..(193): a, c, t, g, unknown or other
  misc_feature (193)..(193): n is a, c, g, or t
  modified_base (350)..(350): a, c, t, g, unknown or other
  misc_feature (350)..(350): n is a, c, g, or t
tcagtacacgtgatcacgaccggtgctcgatttagcgatcgtataaggggaggaactgctcgagttaggacccagacggaacatggaagccccagcgcagcttntcttctcctgctactctggctccngatactactggagaaatgtgatgacgtcagtctccagtccacctgctcgtcgtcccaggggaaangtcctaatcctactccctggaccagggaccacggttcaggtacgttaattccggaactaccgtaaacgttagtaccgaggttacccaggtacctacgtaacgtcgacgtacgactacctcgactcgactaacgtactggtcgatactaacgtaccgnggaccccttggtacaaccgtcccaaattcggtacgtgtaacggacgtgaacggttcggtagacgggtaactacgttacgttaacacgttaccgtctaaccgtacgtaccgtacgtacgacggtttacgaacttacggtaaccgggtatacgttacgacgttacgggtaattactaccgttccgtttaacgaactttacggttacggtacccgttaaagacccggttaacttcggggtaaacccgttacgggtttacccgtaaccgggtaaaccggtaacgtttaagggaccgtaaaacttacccgggtaaacggtaacccgtggtttaaacccgggcgttaaccggtacgtttaaacccggtcgttaaacggtttcccgttaacggtaaccccctttaaggttccctaccccggggttaccttaaacggg

SEQ ID NO: 202994 - DNA, 863 bp, Homo sapiens
  misc_feature: GYAE6OF02IB7IR.34.63.F08.1.454.CMB.1.raw
  modified_base (212)..(212): a, c, t, g, unknown or other
  misc_feature (212)..(212): n is a, c, g, or t
tcagtacacgtgatcacgaccggtgctcgatttagcgatcgtataagggggaggaactgctcagttaggacccagacggaaccatggagccccagcgcagcttctcttcctcctgctactctggctcccagatactactggagaaatagtgatgacgcagtctccagccaccctgtctagtcgtaccccgaggggaagagccatcctctccngcagggccagtcagagtattagcaaccaacttagcctggtaccagcaacgaaacctggaccaagacctcccaggcctacctcgataccgtagtcggtagtacctaacgtaccgaaccgtacgggtcccctacgttacgggtaaccttaccccggaaggtaccgtacggttcgaaggtcggtaacgtagggttcggggtaccggtacggggaactaagggttacgttacctaccgttaccgtaccctaaccgtaacgtcctaacggtaccgttaacggttcctcggtaaccccttaggttaccgttaaggttaaacggtttacgtttttaacgggaaccgttttaaggttttttaaacgttaacccggttggttaacccgtaacgggttaacccttaaacggtttaaaacggtttaaacggtttaaacggtacccgggtttacccccgtttaaccggggtaaacttttcccccggttaaaccccgggtttaaccgggaacccggttaaaacggggtaaccccttaaacgggtaaccgggttaacgggtaaacggtaaaaccgtttaaaaccggtaaggttcccgggtttaacggacccgttacggtaaccccacgtttaacggtttccttaacggtttaccccttaacccgg

SEQ ID NO: 202995 - DNA, 911 bp, Homo sapiens
  misc_feature: GYAE6OF02F2KDK.34.63.F08.1.454.CMB.1.raw
tcagtacacgtgatcacgaccggtgctcgatttagcgatcgtataagggggaggaactgctcagttagggcccagacggaaccatggaagccccagcgcagcttctcttcctcctgctactctgctcccagatactactggagtaaatagtgatgacgcagtctccagccaccctgtctgtcgtaccccgaggggtaaagcgccactcctccgtcctgccgacgggtcctacgtccgagtacgtattaaccgactaacccgtaacttacggacccgttacggtaacccgaacgtccgaaaccgttaaaacccggccggtaaccccgaagtaaccccgtttacccgaaccgggtaccccttacccgttaacctaacctttacgttacggttacggggttcgaccccgtaaccgtttaccccgaacccggtaaaccggggtcccctaaaccgggtttcggttaacccgttacccccgggtacggtaaccggttaacggtttacccgggaaggtttaccgggtaccggttaacggggttaccggggtaaccgggttacgggggaaccgtaacggttaccggtttaccgacccgttaccgttacccgaaccgttaacgacctaccggtaaccggtcggttacccgtacggtaccgtacggttacgttaaaccgttaggtttaaccggttttaccaaccggttttgttttaaccgttagtttaccgtaacgttacgtacggttaaacttaggttaacggttaacggtacccgttcggaccgtaacgttcccgttaaccggttcccggaacggaaccgggctaacccgggtagtaacggtaacggtaccttaaacgggtccgtacggttaccgtacgtaacgtcccgtaacgtacctttaggtcctttaccgtaccc

SEQ ID NO: 202996 - DNA, 534 bp, Homo sapiens
  misc_feature: GYAE6OF01CJL67.18.36.D03.1.454.CMB.1.raw
  modified_base (526)..(526): a, c, t, g, unknown or other
  misc_feature (526)..(526): n is a, c, g, or t
tcagtacgagtatgcacgaccggtgctcgatttagctgcgtcacgatctctcttggggtctgagagaggagcccagccctgagattttcaggtgttttcacttggtgatcaggactggacagagagaactcaccatggagtttgggctgagctggctctttcttgtggcgattttaaaaggtgtcaagtgtgaggtgcagctgttggagtctgggggagccttggtacagcctggggggtccctgagactctcctgtacagtctctggattcaccgtctccacttttgccatggcctgggtcccgccgggctcccgaggggaaggcctggagtgggtctccactatcagtgacactggtaatggcgatagcaaagtggtacgcaggctccgtggaggggcggttcaccattagcaagagacaattccaagaacacggtactatactaacaaatagaacagcctagagagccgaggacgacgccctgtacttctgtgtgagagatacgtaaaacttccctttacgtnttgttacg

SEQ ID NO: 202997 - DNA, 554 bp, Homo sapiens
  misc_feature: GYAE6OF01CJCNY.18.36.D03.1.454.CMB.1.raw
  modified_base (547)..(547): a, c, t, g, unknown or other
  misc_feature (547)..(547): n is a, c, g, or t
tcagtacgagtatgcacgaccggtgctcgatttagctgcgtcacgatctctcttggggtctgagagaggagcccagccctgagattttcaggtgttttcacttggtgatcaggactggacagagagaactcaccatggagtttgggctgagcgtggctctttcgttgtggcgtattttaaaaggtgtcaagtgtgaggtgcagctgttggagtcgtgggggagccgttggtacaggccgtgggggggtccctggagactctcctgtacagtctctggattcaccgtctcctacttttgccatcggcctgggtccgccgggctccgaggggacggcctggagtgggtctccactatcagtcgacactggtaatggacgatagctaagtggtaacgcgaggccgtccggtgggacggggtcggttcgaccgattagcgagagacaattaccaagaacacggtctatactaacaaatagaacagcctagagagcgagacgacggccctgtacttctgtgtgagagtactacgtaaactttcccttacgtnttgttac

SEQ ID NO: 202998 - DNA, 562 bp, Homo sapiens
  misc_feature: GYAE6OF01APV80.18.36.D03.1.454.CMB.1.raw
  modified_base (358)..(358): a, c, t, g, unknown or other
  misc_feature (358)..(358): n is a, c, g, or t
tcagtacgagtatgcacgaccggtgctcgatttagctgcgtcacgatctctcttgggattgtctctgctaatggtgaaccgcccctccacggagccttggtacagcctggggggtccctgagactctcctgtgcaggccctgcattcatctttaatagttattggatgcactgggtccgccaggctccgggggaaggggccggagtggggtggccaacataatgcaagatggaactgaagaagaactatggtggactcgtgtgaagggccgattcaccatctccagagacaacactaagaactttactgtatctgcaaatgaacagcctcagagccgaggacacggctgtgtattacngtgcgaagagcagtggctgggacagtggacgtcgtggggccaagggaccacggtcaccgtctcctcacgccctcccaccgaacgggcccagtccggtccttcccccgtcggccgcccctgcctcccgaggacgccacccgtccgacgacgccacgacggccggccccgtcgggtcctcggacccgtgggtaccgaagggtaccc

SEQ ID NO: 202999 - DNA, 607 bp, Homo sapiens
  misc_feature: GYAE6OF01EDSU1.18.36.D03.1.454.CMB.1.raw
tcagtacgagtatgcacgaccggtgctcgatttagctgcgtcacgatctctcttgggattgtctctgctaatggtgaaccgcccctccacggagccttggtacagcctggggggtccctgagactctcctgtgcagcctctgggttcaccttcagtggctctgctatgcactgggtccgccaggcttccgggaaaggctggagtgggttgccgtattagaagcaaagctaacagttacgcgacagcatatgctgcgtcggtgaaaggcaggttcaccgtctccagaaatgattacaaagaacacggacgtatctgacaaatgaacagacctagaaaaccgaggacgacggcgtagtattactgtactagacgaggtagattaacgtagtttaggggagttagtcggacggaaacggggggtactacgtacgtactagtggacgtcgtagggaccgaacgggaccgtacggtccgtaccgtctccgtcacgccctaccgaccgacggcccagttccggtccttccccgtcggccctaccccgtccctacccgaacgacgccgtaccgtccgtcggggaccacgacggccggtcccgtgggccgtccgg

SEQ ID NO: 203000 - DNA, 531 bp, Homo sapiens
  misc_feature: GYAE6OF01DS1IE.18.36.D03.1.454.CMB.1.raw
  modified_base (482)..(482): a, c, t, g, unknown or other
  misc_feature (482)..(482): n is a, c, g, or t
tcagtacgagtatgcacgaccggtgctcgatttagctgcgtcacgatctctcttgggattgtctctgctaatggtgaaccgcccctccacggagccttggtacagcctggggggtccctgagactctcctgtacagtctctggattcaccgtctccacttttgccatggcctgggtccgccgggctccagggaagggcctggagtgggtctccactatcagtgacactggtaatggcgatagcaagtggtacgcaggctccgtggaggggcggttcaccattagcagagacaattccaagaacacggtctatctacaaatgaacagcctgagagccgaggacacggccctgtatttctgtgtgagagatcgaaaattccctttcgatgttcttgatatgtgggcaagggacaagtggtcaccgtctcctcagcctccaccaagggcccatcggtcttccccctggccgccctgcctcacggngccacctccgagagcacacgcggcccgtgggctggccctggtcaaacgg

SEQ ID NO: 203001 - DNA, 531 bp, Homo sapiens
  misc_feature: GYAE6OF01DG9MK.18.36.D03.1.454.CMB.1.raw
  modified_base (381)..(381): a, c, t, g, unknown or other
  misc_feature (381)..(381): n is a, c, g, or t
  modified_base (450)..(450): a, c, t, g, unknown or other
  misc_feature (450)..(450): n is a, c, g, or t
  modified_base (520)..(520): a, c, t, g, unknown or other
  misc_feature (520)..(520): n is a, c, g, or t
tcagtacgagtatgcacgaccggtgctcgatttagctgcgtcacgatctctcttggggtctgagagaggagcccagccctgagattttcaggtgttttcacttggtgatcaggactggacagagagaactcaccatggagtttgggctgagctggctctttcttttggcgtattttaaaaggtgtcaagtgtgaggtgcagctgttggagtcgtgggggagccttggtacagccgtggggggtccctgagactctcctgtacagtctctggattcaccgtctccacttttgccatggcctggtccgccgggctccgagggagggcctgggagtgggtctccactatcagtgacactggtaatggcatagcaagtggtacgnaggctccgtgggaggggcggttacaccgattagcaagagacaattccaagaacacggtactatactaanaatgaacagcctgacgagaccgaggacaccggcctgtattcgtgtgtgagagatacgtaaattcccttanattgttcttag

SEQ ID NO: 203002 - DNA, 574 bp, Homo sapiens
  misc_feature: GYAE6OF01BSLUV.18.36.D03.1.454.CMB.1.raw
tcagtacgagtatgcacgaccggtgctcgatttagctgcgtcacgatctctcttgggattgtctctgctaatggtgaaccgcccctccacggagccttggtacagcctggggggtccctgagactctcctgtacagtctctggattcaccgtctccacttttgccatggcctgggtccgccgggctccgagggaagggcctggagtgggtctccactatcagtgacactggtaatggcgatagcaagtggtacgcaggctccgtggaggggcggttcaccattagcagagacaattccaagaacacggtctatctacaaatgaacagcctgagagccgaggacacggccctgtatttctgtgtgagagatacgaaaatttccctttagattgttcttgattagtggtggggaccgaagggacaagtggtcaccgtctcctcacgccctccaccgacgggcccagtccggtccttcccccgtcggccgtcccctgcctccgacggacgccaccctccggacgagccacgacggcccggcccgtcgggacctcggcccgtgggtccgtaaaccggg

SEQ ID NO: 203003 - DNA, 632 bp, Homo sapiens
  misc_feature: GYAE6OF01EAPOC.18.36.D03.1.454.CMB.1.raw
tcagtacgagtatgcacgaccggtgctcgatttagctgcgtcacgatctctcttgggattgtctctgctaatggtgaaccgcccctccacggagccttggtacagcctggggggtccctgagactctcctgtacagtctctggattcaccgtctccacttttgccatggcctgggtccgccgggctccgagggaaggcctggagtgggtctccactatcagtgacactggtaatggcgatagcaagtggtacgcaggctccgtgggaggggcggttcaccattagcagagacaattccaaagaacacggtctatctaacaaatgaacagcctgagagccgagacacggcctgtattctgtgtgagagatacgaaaatttccctttgattgttcttagtattagtgggtcggggaccgaaagggactaagtcggtacctacccgtcctccctacgacgcccttacccgaacccgaaccgggccccaacgttccggttcccttaccccccgtcggtccccgtccccgtcgtcccgtacccgaggaccgacccgtacccgtaccggacggtacgaccgaaccgaccggcccggcccggtacgggtccgtcggtcccgttgggtccgtaaaccggg

SEQ ID NO: 203004 - DNA, 576 bp, Homo sapiens
  misc_feature: GYAE6OF01C0YM6.18.36.D03.1.454.CMB.1.raw
  modified_base (493)..(493): a, c, t, g, unknown or other
  misc_feature (493)..(493): n is a, c, g, or t
  modified_base (510)..(510): a, c, t, g, unknown or other
  misc_feature (510)..(510): n is a, c, g, or t
  modified_base (531)..(531): a, c, t, g, unknown or other
  misc_feature (531)..(531): n is a, c, g, or t
  modified_base (551)..(551): a, c, t, g, unknown or other
  misc_feature (551)..(551): n is a, c, g, or t
tcagtacgagtatgcacgaccggtgctcgatttagctgcgtcacgatctctcttgggattgtctctgctaaatggtgaaccgcccccccacggagccttggtacagcctggggggtcccggtcagactctcctgtacagtctctggattcaccgtctccacttttgtccatggcctgggtccggccgggctccagggaagggcctggaggtgggtctccactatcagtgacactggtaatggcgatagcaagtggtacgcaggctccgtgggagggggcggttcaccattagcagagacaattccaagaacacggtctatctacaatagacagctgagagccgaggcaccggcctgtatttctgtgtgagagatacgtaaaacttcccttttcgattcgtttcttagtatagttggtgggggaccgaagggacaagtcggtcacccgtctcctcacgcctccaccgacggccacgtcgtccctcccctggccnccctgcctccagggacnccgaccctcggacgacgcacncggccggtcccgtgggtccncgtccgtcgggtcgtaaggtaaccc

SEQ ID NO: 203005 - DNA, 658 bp, Homo sapiens
  misc_feature: GYAE6OF01BV3PS.18.36.D03.1.454.CMB.1.raw
tcagtacgagtatgcacgaccggtgctcgatttagctgcgtcacgatctctcttggggtctgagagaggagcccagccctgagattttcaggtgttttcacttggtgatcaggactggacagagagaactcaccatggagtttgggctgagctggctctttcttgtggcgtattttaaaaggtgtcaagtgtgaggtgcagctgttggagtcgtgggggagccttggtacagccgtggggggtccctgagactctcctgtacagtctctggattcaccgtctcctacttttgcctatcggccgtgggtcccgccgggctccgaggggacggccgtggagtgggtctccactatcgagtgactacgtggtaatggcgaataggacgtaaggttggtaccgcgagggtccgtccgggtggggacgggggtccggttaccgaaccgtagttacggactaaggaacgaactaaacttacccgaaagaaccgtacggtactaactactaacaaatacgaaacgacgtacctaggaacgacggacccggaacggaccgaccgggtccccgttaggttacgtttccgttaggttggttcggaaggtaaggtaacgttaaccggttaaaacttttcccccgttttacggtaacgtttggtttaacg

SEQ ID NO: 203006 - DNA, 560 bp, Homo sapiens
  misc_feature: GYAE6OF01CDNQ7.18.36.D03.1.454.CMB.1.raw
  modified_base (254)..(254): a, c, t, g, unknown or other
  misc_feature (254)..(254): n is a, c, g, or t
tcagtacgagtatgcacgaccggtgctcgatttagctgcgtcacgatctctcttgggattgtctctgctaatggtgaaccgcccctccacggagccttggtacagcctggggggtccctgagactctcctgtacagtctctggattcaccgtctccacttttgccatggcctgggtccgccgggctccagggaagggcctggagtgggtctccactatcagtgacactggtaatggcgatagcaagtggtacgnaggctccgtggaggggcggttcaccattagcagagacaattccaagaacacggtctatctacaaatgaacagcctgagagccgaggacacggccctgtatttctgtgtgagagatcgaaaatttccctttacgattgttcttgatatgtgggccaagggacaagtggtcaccgtctcctcacgcctccaccaacgggcccaagtccggtccttcccccgtggccgcccctcgcctccgacggacgccaccctccgacgacgcacgacggccggacccgtgggcctggcccgttggtcgtaaacggg

SEQ ID NO: 203007 - DNA, 669 bp, Homo sapiens
  misc_feature: GYAE6OF01AY8QI.18.36.D03.1.454.CMB.1.raw
tcagtacgagtatgcacgaccggtgctcgatttagctgcgtcacgatctctcttggggtctgagagaggagcccagccctgagtattttcaggtgttttcacttggtgatcaggactggacagagagaactcaccatggagtttgggctgagctggctctttcttttggcgtattttaaaaggtgtcaagtgtgaggtgcagctggttggagtcgtgggggagtccgttggtaccaggccggtcggggggtccctggacgactcctcctgtacagtctctggtacttccaccgtctcctacttttcgcctagtcggccgtcggggtcccggccgggcctccggaggggacggccgtgggacggtgggtcctccactatcgagtcgaacgtacgtgggtaagtcggacgtaatacggacgtaaaggtggtaccgcgagggtccgtcgggtgggacggggtcgtaccacgtagttacgcgaagaacgaacctaactaccgaaacggtaaccgtaacggttacctaactacctaaacaaagtacgaaaccgtacgaccgtaggaacgacggtacccggaaggacccgaccggtcccttaggttacttcgtggtggtagagtaacgtacgttaaccgttaaaccgttcccgtttaagtcgtttgttcgttagg

SEQ ID NO: 203008 - DNA, 572 bp, Homo sapiens
  misc_feature: GYAE6OF01BIGIJ.18.36.D03.1.454.CMB.1.raw
tcagtacgagtatgcacgaccggtgctcgatttagctgcgtcacgatctctcttgggattgtctctgctaatggtgaaccgcccctccacggagccttggtacagcctggggggtccctgagactctcctgtacagtctctggattcaccgtctccacttttgccatggcctgggtccgccgggctccagggaaggcctggagtgggtctccactatcagtgacactggtaatggcgatagcaagtggtacgcaggctccgtggaggggcggttcaccattagcagagacaattccaagaacacggtctatctacaaatgaacagcctgagagccgaggacacggccctgtatttcgtgtgtgagagatacgaaaatttcccgtttacgattcgttcttgattagtggtggggaccaagggacaagtggtcaccgtctcctcacgcctccaacaacgggcccaacgtccggtccttcccccgtggcccgtccctcgtcctccgacggtacgccaccctccgacgagccacgacgccggacccgtcgggacctggccctgggtcgtaaaccgg

SEQ ID NO: 203009 - DNA, 557 bp, Homo sapiens
  misc_feature: GYAE6OF01AX0ZO.18.36.D03.1.454.CMB.1.raw
  modified_base (477)..(477): a, c, t, g, unknown or other
  misc_feature (477)..(477): n is a, c, g, or t
tcagtacgagtatgcacgaccggtgctcgatttagctgcgtcacgatctctcttgggattgtctctgctaatggtgaaccgcccctccacggagccttggtacagcctggggggtccctgagactctcctgtacagtctctggattcaccgtctccacttttgccatggcctgggtccgccgggctccagggaagggcctggagtgggtctccactatcagtgacactggtaatggcgatagcaagtggtacgcaggctccgtggaggggcggttcaccattagcagagacaattccaagaacacggtctatctacaaatgaacagcctgagagccgaggacacggccctgtatttctgtgtgagagatacgaaaatttccctttcgatgttcttgtatatggtgggcgaagggacaatggtcaccgtctcctcagcctccaccaacgggcccagtccggtccttccccgtcggccncccgtcgcctccgaggacgccgtaccctcggacgagcaccgacggccggcccgtgggctcggcctgggtcgtaaaccggg

SEQ ID NO: 203010 - DNA, 585 bp, Homo sapiens
  misc_feature: GYAE6OF01ARAU6.18.36.D03.1.454.CMB.1.raw
tcagtacgagtatgcacgaccggtgctcgatttagctgcgtcacgatctctcttgggattgtctctgctaatggtgaaccgcccctccacggagccttggtacagcctggggggtccctgagactctcctgtacagtctctggattcaccgtctccacttttgccatggcctgggtccgccgggctccagggaagggcctggagtgggtctccactatcagtgacactggtaatggcgatagcaagtggtacgcaggctccgtggaggggcggttcaccattagcagagacaattccaagaacacggtctatctacaatgaacagcctgagagccgaggacacggccctgtatttctgtgtgagagatacgaaaattccctttcgattgttcttgatatggtgggccaagggacaagtggtcaccgtctcctcacgcctccaccgaacgggcccaagtccggtaccttcccccgtggtcccgccctcgccctccgacggtacgccgtacccgtcccggacggtacgaccgacgacggcccggaccccggtcggggccctcggtcccgtcgggtcgtaaacccggg

SEQ ID NO: 203011 - DNA, 767 bp, Homo sapiens
  misc_feature: GYAE6OF01A3TDG.18.36.D03.1.454.CMB.1.raw
tcagtacgagtatgcacgaccggtgctcgatttagctgcgtcacgatctctcttggggtctgagagaggagcccagccctgagattttcaggtgttttcacttggtgatcaggactggacagagagaactcaccatggagtttgggctgagctggcttctttcttgtggcgtaattttaaaaggtgtcaagtgtgaggtgcagcgtgttggagtcgtgggggacgtccgttggtacgacggccggtcggggggtccctggacgtactcgtcctgtacagtctctggattcaccgtctcctacttttgcctatcggccgtcggggtcccgccgggcctccgaggggaacgggccgtgggaggtcggggtcctccgtacgtactcgaagtcgactacgtaggtaagtgggacgtaagtacgacgtaaacggttcggtaaccgcgtacgggtccgttacccgggtaggggtaaccgggggtccgggtttacccgtaacccggttaagtttaacggacgtaaacggtaacggtaacccgtaaacgtttaaccccgaaaacggtaaaacccgtaacccgggttaccttaacgttaccttaaaccgtaaagttacgtaaacccgacgtacccgtaggaaacggtacggacccggtaacggaaccgacccgggtccccgttaggttacgtttccggttagttcgggttagaacggtaacgtaaacgttaccggtaaaacttttccccggtttacgtacgtttgttttaacccgg

SEQ ID NO: 203012 - DNA, 667 bp, Homo sapiens
  misc_feature: GYAE6OF01DA6WU.18.36.D03.1.454.CMB.1.raw
tcagtacgagtatgcacgaccggtgctcgatttagctgcgtcacgatctctcttgggattgtctctgctaatggtgaaccgccccctccacggagccttggtacagcctggggggtccctgagactctcctgtacagtctctggattcaccgtctcctacttttgccatcggcctgggtcccgccgggctccgagggaaggcctggagtggtctccactatcagtgacactggtaatggcgaatagcaaggtcggtaacgcacggctccggtgggacggggcggtttcaccgtattacgcaagagaactaattccgaaagaacgaccggtactatacctaacaaatcgaaacagcctgaacgagacccgaaggtacaccggtccctgttactttcgtgtgtgagagtactacgtaaaactttcccgtttgtattcgttcttagtatagttgggtacgggacgaaagggtactaaggtcggtaccgtaccgtctcccgtcacgtccctaccgaccgaaccggtaccacgtccggttcccttccccgtcggccctcccgtcggccctaccggacggacgcccgtaacccgccggtaacgaccgtcgaaccgacggccccggtcccgtacgggacccgtcggtacccggtcgggtaaccgtaaacccggg

SEQ ID NO: 203013 - DNA, 698 bp, Homo sapiens
  misc_feature: GYAE6OF01DWV6S.18.36.D03.1.454.CMB.1.raw
  modified_base (236)..(236): a, c, t, g, unknown or other
  misc_feature (236)..(236): n is a, c, g, or t
  modified_base (283)..(283): a, c, t, g, unknown or other
  misc_feature (283)..(283): n is a, c, g, or t
tcagtacgagtatgcacgaccggtgctcgatttagctgcgtcacgatctctcttgggattgtctctgctaatggtgaaccgcccctccacggagccttggtacagcctggggggtccctgagactctcctgtgcagcctctggattcagtttcagtgcctactggatgcactggatccgccaagttccagggaagagactggtgtgggtctcacgtattaaagatgagtgggggtnccacatcctacgcggactccgtgagggccgcttcaccatctcccganacaacaccaagaacacgctgtatctgacaaatgagcagtctgggagtcgaggacacggctgtctatttactgtgacgaaggaggggtaactacggtgacccgttaacgggtaggggttcggtacccggaccccggtcggggacccggtaacggggtaaccccgtacgggtacccgtacccggttccgtcccgttacccgaccggtccccgtaccccgaacccgaaccggggtacccccacgttacccggttcccgtttccccccgtaccgggccctacccccgttccctacccgaacgacggtcccgtaacccgtccggtacgggggaccaacccgtacgggcccgggtccccggtcgggtcccgtcggtcccgttacgggtacccgtaacggtacccgttaccgttaacccccg

SEQ ID NO: 203014 - DNA, 570 bp, Homo sapiens
  misc_feature: GYAE6OF01EF64L.18.36.D03.1.454.CMB.1.raw
tcagtacgagtatgcacgaccggtgctcgatttagctgcgtcacgatctctcttggggtctgagagaggagcccagccctgagattttcaggtgttttcacttggtgatcaggactggacagagagaactcaccatggagtttgggctgagctggctctttcttgtggcgattttaaaaggtgtcaagtgtgaggtgcagctgttggagtcgtgggggagccttggtacagccgtggggggtccctgagactctcctgtacagtctctggattcaccgtctccacttttcgcctagtggccgtggggtcccggccggggctccgaggggaacgggccgtgggacggttgggtctccgactatcagtgacactggtaatggcgatagcaagtggtacgcagggctccggtgggacggggcggttcaccgtagttacgctagacgacaattaccaagacacggtctaatctaacaaactgaacagacctgagacgaccgaggaccacggtaccctagttactttcgtgtacggtgagagacgtacgtaaaacttccctttagtattgttacg

SEQ ID NO: 203015 - DNA, 600 bp, Homo sapiens
  misc_feature: GYAE6OF01DMJFY.18.36.D03.1.454.CMB.1.raw
  modified_base (219)..(219): a, c, t, g, unknown or other
  misc_feature (219)..(219): n is a, c, g, or t
  modified_base (348)..(348): a, c, t, g, unknown or other
  misc_feature (348)..(348): n is a, c, g, or t
  modified_base (498)..(498): a, c, t, g, unknown or other
  misc_feature (498)..(498): n is a, c, g, or t
  modified_base (594)..(594): a, c, t, g, unknown or other
  misc_feature (594)..(594): n is a, c, g, or t
tcagtacgagtatgcacgaccggtgctcgatttagctgcgtcacgatctctcttgggattgtctctgctaatggtgaaccgcccctccacggagccttggtacagcctggggggtccctgagactctcctgtacagtctctgggttctcagtggcgactacatgagctgggtccgccaggctccgagggaaggcctggagtggatctcactttatttanagtggtggtaccacatactacacagactccgtgaagggccattcaccatctcagaagacaattccaggaacacattgtatcttacaaatgaaataacctgagagccgaaggacacggccatgtattacnggtcgtgggctatttacgttcgaccccgtgggggcccgggaaccgttggtccaccgtccctaccccgtaccctcccgaaccgaacgggcccctagtccggttcccttccccgcggtcccaccccttcccaccaagccgccaaccgttcgngggccacgacggccgccgtgggcctcggcctggacctaacggactaccgttccaactacctcggtactgggacgcgggaccttagggcaacgggcncgtaag

SEQ ID NO: 203016 - DNA, 760 bp, Homo sapiens
  misc_feature: GYAE6OF01D4F4X.18.36.D03.1.454.CMB.1.raw
tcagtacgagtatgcacgaccggtgctcgatttagctgcgtcacgatctctcttgggattgtctctgctaatgatgaaccgcccctccacggagccttggtacagcctgggggtccctgagactctcctgtacagtctctggattcaccgtctccacttttgccatggcctggctccggcgtcacggagggacgtcgtaggtaggtcgtcctacctactactacgtagtacacctacggtaagttaggcggactaagtacgaagtagggttacggacgacggacgtcccgttcgggagggggtacgggttccgtaccaacttaagtacgacgaggacaacttacctaacgaaacaacggtacgtactactacaaactagtacaagacgtacgagacgcgacggtaacgacgcccgtcgtattacttcgtggtagtagagagtacgtaaactttaacccgtttccgtaagtgtttccgtttagagttaacgtggttacgggggtccccggaaagggtaaacgaattacgggttccgtaaccccgtaccgtttccctacgtaccgacccttccccgaacccgaaacggggtaccccgaccgtttaccggttccccggtttacccccccttcccgggagggcccccccttcgtcgttaccccagggaacccggtccctaccccgttacccggaacggcggtacccgaccgtaacgggcccgggtccccgttacggggccgtccgtcccgtccgggttaaacgg

SEQ ID NO: 203017 - DNA, 761 bp, Homo sapiens
  misc_feature: GYAE6OF01ELBD8.18.36.D03.1.454.CMB.1.raw
tcagtacgagtatgcacgaccggtgctcgatttagctgcgtcacgatctctcttgggtctgagagaggagcccagccctgagtattttcaggttgttttcacttggtgatcaggactggacagagagaactcaccagtggagttgggctgagctggcttctttcttgtggcgtaattttaaaaggtgtcaagtgtgaggtgcagctggtggagtcgtgggggactccgttggtaccgaggtccggtcggggggtccctggagtacctctcctgtacagtctcgtggtacttccaccgtctcctacttttgccctagtcggccgtcgggtcccggccggctccggaggacggcgtggtgtcgggtcctcctacgtatcgagtcgaactacgtcggtaatcggcgatacgacgaaaggttcggtaccgcgacgggccttcgggaggggtacggggtccgttaccaaccgtattaacggcgaagaacgaactaacgttaaccgaaacgtaaccgacggttacttaacgtaacctaaacgaaacgttacgaaaccgtacgtacccgtaaggaacggtacggaccccggaaacgggtacccaaccccggggttaccccgttaacggtttaacgtttttacccggtttaggggttaacggtttaccggggaaagtaaacgggttaaaccgttaaaacccgggtttaaaaaaccctttttccccccgggttttttaacggttaaacggttttcggtttttaacccggg

SEQ ID NO: 203018 - DNA, 608 bp, Homo sapiens
  misc_feature: GYAE6OF01AOTHV.18.36.D03.1.454.CMB.1.raw
tcagtacgagtatgcacgaccggtgctcgatttagctgcgtcacgatctctcttgggattgtctctgctaatggtgaaccgcccctccacggagccttggtacagcctggggggtccctgagactctcctgtgcaggccctgcattcatctttaatagttattggatgcactgggtccgccaggcgtccggggaaggggctgggagtgggttggccgtaattaaaaccaaatgatgggtggacaacagactacgctgcaccgtgaaaggcagattcaccatctacaagagatgattacaaaaagcacgctgtatctgacaaatgaacagcctagacgaaccgaggacacagcgtagtacttactcgtaccacactccctagaacgcgtacaactactactactacggtatcgacctcgtcgggaccaagggaccacggtctacccgtctccacacgcctccgaaccgaccggccctacgtcccggttcccttaccccgtcggcccgtcccgtcgccctccgacggaccgcccgtacccgtaccggacggaccgaccaccgaccggacccgggccccgttaggggccgttccggtcccgttaaccgggg

SEQ ID NO: 203019 - DNA, 606 bp, Homo sapiens
  misc_feature: GYAE6OF01DMAHV.18.36.D03.1.454.CMB.1.raw
tcagtacgagtatgcacgaccggtgctcgatttagctgcgtcacgatctctcttgggattgtctctgctaatggtgaaccgcccctccacggagccttggtacagcctggggggtccctgagactctcctgtacagtctctggattcaccgtctccacttttgccatggcctgggtccgccgggctccagggaaggcctggagtgggtctccactatcagtgacactggtaatggcgatagcaagtggtacgcaggctccgtggaggggcggttcaccattagcagagaacaattccaagaacacggtctatctacaaatgaacagcctgagagccgaggacacggccctgtattctgtgtgagagatacgaaaactttccctttagattgttcttgattatggtggggaccgaaagggacaagtggtccaccgtctccctcacgccctccaacccgaacgggccccaacgttccgggttacccttcccccgtcggacccgtcccctacgcccttccgaacggacgccacccgtccggtaacgacgaccaccgaacggcccgggaccccgtcggggtcctcggcccgttgggtccgtaaaaccggg

SEQ ID NO: 203020 - DNA, 700 bp, Homo sapiens
  misc_feature: GYAE6OF01BJT6Z.18.36.D03.1.454.CMB.1.raw
  modified_base (188)..(188): a, c, t, g, unknown or other
  misc_feature (188)..(188): n is a, c, g, or t
  modified_base (226)..(226): a, c, t, g, unknown or other
  misc_feature (226)..(226): n is a, c, g, or t
  modified_base (274)..(274): a, c, t, g, unknown or other
  misc_feature (274)..(274): n is a, c, g, or t
tcagtacgagtatgcacgaccggtgctcgatttagctgcgtcacgatctctcttgggtctgagagaggagcccagccctgagattttcaggtgttttcacttggtgatcaggactggacagagagaactcaccatggagtttgggctgagcgtggtcgtctttacgtgtggacgtaagttttaaaggngtcaagtgtgaggtgcagctgttggagtcgtggggacnccgtttggtacaggccgtcggggggtccctggacgtctctcctgtacngtctctggacttcgaccgtctcctacgtttgcctagtcggccgttggtcccgccgggtcctccggacgggtaacggcccgttagggacggttcgggtcctccctaacgttacgtaccgtacggttacgaaccgtacgttagggttaaacgttcgggacgtaacgtacggtacccgtaaagggttccggtaacgccggtaacggtccgttaaccggtgggtacggggtccgttacgaacctagttacgcgtaaggacctaactaacttaccgaaacgtaactacccggtaacttactaccgtaaactaagtagtaacctaggtcctaacggacgtaacgcggtaacgaccgaccgtccctggttacttcgtgtaggtacgagacgttaagtaaccggttaactttccccgttgtcgttaccggttag

SEQ ID NO: 203021 - DNA, 649 bp, Homo sapiens
  misc_feature: GYAE6OF01DCX6C.18.36.D03.1.454.CMB.1.raw
tcagtacgagtatgcacgaccggtgctcgatttagctgcgtcacgatctctcttgggattgtctctgctaatggtgaaccgcccctccacggagcctcggtacagcctggggggtccctgagactctcctgtacagtctctggattcaccgtctccacttttgccatggcctgggtccgccgggctccgaggggaaggcctggagtgggtctccactatcagtgacactggtaatggcgatagcaaggtggacgcaggctccggtggaggggtcggttcaccattagcagagacaatccaagaacacggtctatctaacaaatcgaacagcctgagagaccggaggacacggtccctagttatttcgtgtgtagagagatacgtaaaacttcccgtttagtattgttacttagtaagttagttagggttacggggaccgaaaggggtacaaagttcgggtaccgtacccgtcttccctaccgacgtcccgtacccaaccgacgggtacccctaacgttcccggttcccttacccccgtggccccgtcccttacgcccgtaccgacggtacgaccctaccgtcccggaagaccgtaccacgaccggcccgggacccgtggggacctcggtccgtgggtccgtaaacccgg

SEQ ID NO: 203022 - DNA, 630 bp, Homo sapiens
  misc_feature: GYAE6OF01AQ3UP.18.36.D03.1.454.CMB.1.raw
  modified_base (177)..(177): a, c, t, g, unknown or other
  misc_feature (177)..(177): n is a, c, g, or t
  modified_base (229)..(229): a, c, t, g, unknown or other
  misc_feature (229)..(229): n is a, c, g, or t
  modified_base (268)..(268): a, c, t, g, unknown or other
  misc_feature (268)..(268): n is a, c, g, or t
  modified_base (298)..(298): a, c, t, g, unknown or other
  misc_feature (298)..(298): n is a, c, g, or t
  modified_base (425)..(425): a, c, t, g, unknown or other
  misc_feature (425)..(425): n is a, c, g, or t
  modified_base (541)..(541): a, c, t, g, unknown or other
  misc_feature (541)..(541): n is a, c, g, or t
  modified_base (580)..(580): a, c, t, g, unknown or other
  misc_feature (580)..(580): n is a, c, g, or t
tcagtacgagtatgcacgaccggtgctcgatttagctgcgtcacgatctctcttggggtctgagagaggagcccagccctgagattttcaggtgttttcacttggtgatcaggactggacagagagaactcaccatggagtttgggctgagcgtgctcttctgtgcgatttaaaggngtcaagtgtgaggtgcagctggttggagtcgtggggggacgccttgggtacnggccgtcgggggggtccctggacgtctctccgtcgtacngtctctggattcaccgtctcctacttttcncctagtcggtccgttcggggtcccggcccgggccgttccggaacgggggtacgggtcccgtaggggtacggtcggggtcctacccgtacgttaacgtccgaggttcgacctagttacggtaagtggngtatacggactaaaggtcggtaccgacgacggcgtcggtagggacgggcgggttacacgtatacggacagacgactaactaccaagacgacgtcgtaatacgtaacaactagaacngactagagacgacgacgacgaccgcctagttagttccgnggtacggtgagtatacgtaaccgttaacttaccgttactgttcgtttacg

SEQ ID NO: 203023 - DNA, 578 bp, Homo sapiens
  misc_feature: GYAE6OF01AT6NK.18.36.D03.1.454.CMB.1.raw
  modified_base (437)..(437): a, c, t, g, unknown or other
  misc_feature (437)..(437): n is a, c, g, or t
tcagtacgagtatgcacgaccggtgctcgatttagctgcgtcacgatctctcttgggattgtctctgctaatggtgaaccgcccctccacggagccttggtacagcctggggggtccctgagactctcctgtacagtctctggattcaccgtctccacttttgccatggcctggggtccgccgggctccgagggaagggcctggagtgggtctccactatcagtgacactggtaatggcgatagcaagtggtacgcaggctccgtggaggggcggttcaccattagcagagacaattccaagaacacggtctatctacaaatgaacagcctgagagccgaggacacggccctgtatttctgtgtgagagatcgaaaatttcccttgtatgtttcttgatagtggtggggcaagggacaagtggtcaccgtctcctcncgccctcaccaacgggcccacgtccggttcccttcccccgtcggcccgtcccgtcgcctacccgaggacgccacccgtaccggacgacgcgaccgacggcccggcccgtacgggccgtcggcccgtgggtcgtaaaccggg

SEQ ID NO: 203024 - DNA, 692 bp, Homo sapiens
  misc_feature: GYAE6OF01CWPNT.18.36.D03.1.454.CMB.1.raw
tcagtacgagtatgcacgaccggtgctcgatttagctgcgtcacgatctctcttgggattgtctctgctaatggtgaaccgcccctccacggagccttggtacagcctggggggtccctgagactctcctgtacagtctctggattcaccgtctcctacttttgccatggcctgggtccgccgggctccgagggaagggcctggagtgggtctccactatcagtgacactggtaatggcatagcaagtggacgcaggctccgtggaggggcgggttcaccattagcagagacattccaagaacacggtctatctaacaaatgaacagcctagagagccgaggacacggccctgtatttctgtgtcgagagatacgtaaaaactttccctttacgtattgtttcttagtattagtggtacggggaccgaaaggggtactaaagttcgggtaccctacccggttcctcccttaccgacggtcccctacccgaacccgaaacggggtcccctaacggttcccgggttcccctttaccccccggtcgggtccccgtaccccgttccggcccttcccggaacgggaccggacccgtacccgtacccggaacggtaccgtacccgaaccggaaccgggccccgggaccccggttcggggacccgttccggcccgttccggggtaccgtaaaacccggg

SEQ ID NO: 203025 - DNA, 816 bp, Homo sapiens
  misc_feature: GYAE6OF01CDJTT.18.36.D03.1.454.CMB.1.raw
tcagtacgagtatgcacgaccggtgctcgatttagctgcgtcacgatctctcttggggtctgagagaggagcccagccctgagattttcaggttgttttcacttggtgatcaggactggacagagagaactcaccatggagtttgggctgagctggcttctttcttggtggcgtaagttttaaaaggtgtacaagtgtgaggtgcagctgttggagtcgtggggatccttggtacaggccggtggggggtccctggacgtactcctctgtactagtctcgtgattccaccgttctcctacttttgcctatcggccgtcgggtcccgccgggtctccggaggggacgggccgtgggacggttcgggtcctccgactacgtcctaggtacgaactacgttagggtaaacgttcgggacgtaagttacggacgtaaagggtgggtaacccgcggtaaccgggtccggttcccgggttgggggtacggggggtaccgggtttacccgaaacccgttaagtttaaccggacgtaaacggtaacggtaaaccctaaacgtttaacccgaaaacggtaaaccgtaccggttaactaacgttaacctaaacgtaaaacgtaacggaaaccgtaaccggtaccgtaacgggaacggaaaccgggaccccgggaacgggaaccccggtaaccccgggtaccccgttaaggttttaccgttttaccggttacgggtttaggttagggtaaacggtaaggttaaaccgttaaacccggttaaaaaccgttttccccggttttaaaccgttaaggtttcgttttaaccg

SEQ ID NO: 203026 - DNA, 573 bp, Homo sapiens
  misc_feature: GYAE6OF01BJZ1E.18.36.D03.1.454.CMB.1.raw
tcagtacgagtatgcacgaccggtgctcgatttagctgcgtcacgatctctcttgggattgtctctgctaatggtgaaccgcccctccacggagccttggtacagcctggggggtccctgagactctcctgtacagtctctggattcaccgtctccacttttgccatggcctgggtccgccgggctccagggaagggcctggagtgggtctccactatcagtgacactggtaatggcgatagcaagtggtacgcaggctccgtggaggggcggttcaccattagcagagacaattccaagaacacggtctatctacaaatgaacagcctgagagccgaggaccacggccctgtatttctgtgtgagagatacgaaaatttcccttacgactgttcttgatatgtgggcaagggacaagtggtacaccgtctcctcacgcctccgaccaacgggcccagtccggtccttccccctggcccgtcccctcgcctacccgacggacgccaccgtcccgacggagcaccgacgccgggccccgtcggggccttaggcccgttcgggtcgtaaaccggg

SEQ ID NO: 203027 - DNA, 572 bp, Homo sapiens
  misc_feature: GYAE6OF01AWQGY.18.36.D03.1.454.CMB.1.raw
tcagtacgagtatgcacgaccggtgctcgatttagctgcgtcacgatctctcttgggattgtctctgctaatggtgaaccgcccctccacggagccttggtacagcctggggggtccctgagactctcctgtacagtctctggattcaccgtctccacttttgccatggcctggggtccgccgggctccgagggaagggcctggagtgggtctccactatcagtgacactggtaatggcgatagcaagtggtacgcaggctccgtggaggggcggttcaccattagcagagacaattccaaagaacacggtctatctaacaaatgaacagcctgagagccgaggacacggccctgtatttctgtgtgagagatacgaaaactttcccttgattgttcttgatatggtgggaccgaagggacaagtggtcaccgtctcctcacgccctaccaccaacgggcccagtccggtcccttcccccgtggccgtccctgccctcgacggacgcctacccgtccgacgacgacacgacggcccggcccgtcgggcctggcccgtggtaccgtaaacggg

SEQ ID NO: 203028 - DNA, 787 bp, Homo sapiens
  misc_feature: GYAE6OF01CS1DD.18.36.D03.1.454.CMB.1.raw
tcagtacgagtatgcacgaccggtgctcgatttagctgcgtcacgatctctcttggggtctgagagaggagcccagccctgagtattttcgaggttgttttcacttggtgatcaggactggacagagagaactcaccatggtagtttgggctgagcgtggtcttctttcttggtggtacgttaagttttaaaaggtgtacaagtgtgaggtgcagcgtggttggtagtacggtggggtacgtccgttcggtacgacggtccggtgggggtccctggacgtccgttcgtcgtgtaactagtctcgtggtacttccgaccgtcctccttactttcgcctagtcggtccgtcgggccgccggcctccggagggacggccgtgggtacggtcgggtcctaccgtacgtacgtcgacggtagaaccgtacggttaaggtaacggtcggtaacgtagttaaacgcggttaaacggttaccggaacgtccggtaacgggtccggtaaccgggggttacggggtaccggggttccgtttaaccaaccggttaagtaacgggtaaccgtaaagtaaaccggtaacttaaaacggttaacccgaaaacggtacctaacccgggtttaataaaccgttacggtaaaactaagtaacgaaaccgtacgtaccgtaaggaccgacggacccgaaggtaccgtacgttacgggtacctttacggttttacgttagggtttacgtggttaacggtagacgttaaagtaccctttaaacgtttccccgttgtaagttttaccg

SEQ ID NO: 203029 - DNA, 756 bp, Homo sapiens
  misc_feature: GYAE6OF01CJQRG.18.36.D03.1.454.CMB.1.raw
  modified_base (302)..(302): a, c, t, g, unknown or other
  misc_feature (302)..(302): n is a, c, g, or t
tcagtacgagtatgcacgaccggtgctcgatttagctgcgtcacgatctctcttgggattgtctctgctaatggtgaaccgcccctccacggagccttggtacagcctggggggtccctgagactctcctgtacagtctctggattcaccgtctcctacttttgccatggcctggggtcccgccgggctccgagggaagggcctggagtcgggtctccactatcagtgacacgtggtaagtggcatagacaaggtggacgcgacggctccggtgggacggggtcgttcacctattagcaganactactaccaagaacacggtctatactaacaatagaacagcctagaacgacgccggaggaccgaccggcccgttagttactttcgtgttgtaggaagtagtaactacgtaaaacctttcccgtttagtagttgtttctgtattagtacgggtacggggaccggaaagggtactaacggtcggtcctacccggttccttccgtacccgaccgtaccccttacccgaacccggtaaccgggtaccccgtacggttaccccggttccccccgtttaccccccggtcgggtcccccgtcccccggttacgccccgttacccgggaacggtacccgacccgtaccccgggtacccggaagggtacccggacccgtaaccgggaacccgggcccgggtacccccgggttacgggacccggttccccggtaccggttacccggggttacgtaaaacccggg

SEQ ID NO: 203030 - DNA, 878 bp, Homo sapiens
  misc_feature: GYAE6OF01BFEQX.18.36.D03.1.454.CMB.1.raw
tcagtacgagtatgcacgaccggtgctcgatttagctgcgtcacgatctctcttgggattgtctctgctaatggtgaacccgcccctccacggagccttggtacagccgtggggggtccctgagactctcctgtacagtctctggattccaccgttctcctactttttcgcccagtcggccgtcggggtcccggcccggggcctccgaaggggaacgggccgtggaggtgggtcctccatactcgaagtgaactacgttgggtaaatgggacgataggacgaaggtcgggtaaccgcgtagggccgttaccggtggggacggggtccggttacaaccgtagttagcaaggtacgaactaacttaccgaacgaaaccgtacggttactactacaaacctaaagttagaaacgacgccgtaggaagacggacggacggaaccgaccggtccgttagtttatttcgttaggtggtggaacgtaagtaacgttaaacgttaaaaccgttttcccgtttacgtaattttccgtttagtttacggtaatttacgggtacggggttaccggggtaccggtaaaggggtaaccgtaaaggtccggttaccccgtacccgttaccgttccctaccgacccgttacccctaaccccgaacccgggtaacccgggtcccctaaccggttccccgggtttaccccgttccccccgggtcgggtacccccgttccccgtacccgtccgtaacccggacgggtaaccctaccccggtaaccccgtacggaccgggtaaccgcccggtaaccggaccccgggtcccgggtccccgggtccggggtcccgttacccggggtccccggttcggggtaaacccggttaaacccccg

SEQ ID NO: 203031 - DNA, 953 bp, Homo sapiens
  misc_feature: GYAE6OF01E1DBW.18.36.D03.1.454.CMB.1.raw
tcagtacgagtatgcacgaccggtgctcgatttagctgcgtcacgatctctcttgggtctgagagaggagcccagccctgagattttcaggttgttttcacttggtgatcaggactggacagagagaactcaccagtggagtttggctgagctggcttctttcttgtggacgtaagttttaaaaggtgtacaagtgtgaggtgacagtcgtggttggagtcggtgggggacgtccgttcggtaccgacggtcccggtcggggggtccctaggacgtacctccgttccgttagtacctacgttccttcgtggtacttccgaccgttccttcctacgttttcgaccctagtcggtccgttcgggtacccggcccgggtccgttaccggaacggggtaaccgggtcccgttagggaacgggttcggggttacccttacccgtaacgttaacgtccgaaaggttacgaacccgtacggttaaggttaaacgtcgggtaaccgtaagttaaggtaacccggtaaaggttcggggtaacccgtccggtaacgggtcccgtttcccggggtacgggggtaacccgggggttcccgtttaacccgtaacccggttaaagtttaaccgggaccgtaaacgggtaaaccgtaaacccgttaaaaccgtttaacccccggaaaaacgggtaaaaccccgttacccgggtttaacctttaaacccgttaaccttaaaacgtaaaacgtaccgggtaaaacccacgggtaccccgtaaagggaaccggaccgggaaccccgggtaaacgggtaccccggtaaccccgggttcccgtttaaggttttaaccgtttttcgggttacgggtttacggttaaaggaaccgggttaaacgtaaaccgtttaaacccggtttaaaacctttttaccccgttttaccggttaagtttttcgggtttaaaccgg

SEQ ID NO: 203032 - DNA, 744 bp, Homo sapiens
  misc_feature: GYAE6OF01AWJ1T.18.36.D03.1.454.CMB.1.raw
  modified_base (255)..(255): a, c, t, g, unknown or other
  misc_feature (255)..(255): n is a, c, g, or t
tcagtacgagtatgcacgaccggtgctcgatttagctgcgtcacgatctctcttgggattgtctctgctaatggtgaaccgcccctccacggagccttggtacagcctggggggtccctgagactctcctgtacagtctctggattcaccgtctccacttttgccatggcctgggtccgccgggctccgagggaagggcctgggagtgggtctccactatcagtgacactggtaatggcgatagcaagtggtacncaggctccgtgggaggggcggttcaccattagcagagacaagttaccaagaacacggtctactctaacaaatagaacacgctagagagaccgaggaccgacggtccctgttaactttcgtagtcgtagagagtacgtacgtaaaactttccccgtttagtactttgtttcttagtaagtttacgttgggttacggggaccggtaaacgggtaacgtaaacgttcgggtacccgtaacccggttccttcccgttacctaccgtcccctaaccccgaacccgaaccggggacccctaaccggttcccggttaccccgtttccccccggtcgggtccccggtaccccttaccggtcccgttacccgacgggtaccgtaccccgaacccgttacccgggacgaccggtaccgaaccggtaccgggcccgggaccccccggtttggggcccttaccggggtacccgtttaccgggtaccggttaaaaccccggg

SEQ ID NO: 203033 - DNA, 816 bp, Homo sapiens
  misc_feature: GYAE6OF01COCAP.18.36.D03.1.454.CMB.1.raw
tcagtacgagtatgcacgaccggtgctcgatttagctgcgtcacgatctctcttgggattgtctctgctaatggtgaaccgcccctccacggagccttggtacagccgtggggggtccctgagactctcctgtacagtctctggattcaccgtctcctacttttcgccatcggccgtgggtcccgccgggctccgaggggaaggcctgggagtcgggtctccactagtcagtgaacacgtaggtaactggcgatagactaaggtggacgcgaggctccggtgggacggggtcggttacacctagttagacagaagactaacttaccaagaacacggttactactacctaaacaaagttcgaaacacgtacctagggaacgacggaccggtaacggaccgaacccgtcccgtttaggttaacttttcgtaggttaggtagaacggtaagaacgtttaaaccggtaaaaactttttccccgtttaacggaatttccggtttattacggtaactttaggttacggggtaaccggggtaacccgtaaaaggggtaaaccgttaacggttaccgggtaacccgttacccggttacccttccgtaccgtaccgtaccccgtaacccaaccgggacccggtacccttaccggttcccggtttcccccgttccccgtccggtacccgttccccgtcggtaccgaccccgaagggaccgtccctacccggaccgaacggacggaaccccacggtaaaccggtcccccgaaccggggttcgggtacccggtaccggttacggttaacccggaacggttaaacccgg

SEQ ID NO: 203034 - DNA, 859 bp, Homo sapiens
  misc_feature: GYAE6OF01CU7LL.18.36.D03.1.454.CMB.1.raw
tcagtacgagtatgcacgaccggtgctcgatttagctgcgtcacgagtctctcttgggattgtctctgctaatggtgaaccgcccctccacggagccttggtacagcctgggggtccctgagactctcctgtacagtctcgtggattccaccgtctcctacttttgccatcggcctgggtcccgccgggctccgaggggaaggtccgtggaggtcgggtcctccactatcagtgacacgtggtaagtggcgatagcaaggtcggtacgcgacggctccggtgggacggggtcggttcaaccgtagttagcaagacgtaacaacttaccgaaagaaccgaccggttactacttacctaacgaaagtacgaaacacgcctaggacgacggaccggaacggacgaccggtccgtagtttaactttcgtggtacgtagaaggacgtaacgttaacgttaaaaccgttttcccgtttagttacgttacgttttacttaggttaacttcggttacggggttaacggggtaacccggtaaaacgggtaaccgttaacggttaccggttacccgttaccccggttaccttcccgtaccgtacccggtaccccgtaaccccgtaaccggtaaacccgggtaccccgtaaccggtttcccccggggttacccccgttttcccccccgggtaccggtcccccggttccccgtaccggtccccggttaacccggacgggtaacccggaccccttaaacccgggtacccggaaacggtaccgtacccggtaacccgacccgggtaccccgggttcccggtaccggggtccgttacccgggttaccggtaccgggttaacccggtaaacccgg

SEQ ID NO: 203035 - DNA, 641 bp, Homo sapiens
  misc_feature: GYAE6OF01D9EFI.18.36.D03.1.454.CMB.1.raw
  modified_base (135)..(135): a, c, t, g, unknown or other
  misc_feature (135)..(135): n is a, c, g, or t
  modified_base (322)..(322): a, c, t, g, unknown or other
  misc_feature (322)..(322): n is a, c, g, or t
  modified_base (470)..(470): a, c, t, g, unknown or other
  misc_feature (470)..(470): n is a, c, g, or t
  modified_base (553)..(553): a, c, t, g, unknown or other
  misc_feature (553)..(553): n is a, c, g, or t
tcagtacgagtatgcacgaccggtgctcgatttagctgcgtcacgatctctcttgggattgtctctgctaatggtgaaccgcccctccacggagccttggtacagcctggggggtccctgagactctcctgtacngtctctggattcaccgtctcctacttttgccagtcggcctgggtccgtcgggctccgagggaggcctggagtgggtctccactatcagtgacacgtggaatggacatagcaaggtggtacgcaggcctccgtgggagggcggttcacagttagcagagaacattaccgaagacacggtctatctaanaaatgaacagtcctagaagcgctggaacggacgacgtcgtagttccttagttcgtggtcggacgtaacgactacggttacgtttcgggggccacttaagtacgtaacctttacctaacgtttacgtacgttaaggttcggggaaccgnggggtacctcccggtagtcccgtaccgttcctacccgtcacgtcctaccaaccggacgtcccacgttccgttcccttccccgnggtccgcccttcgccgttaccgaggacgtcccgtacccgtacggatacggacctacggcggtccggcccgtgggtccgccgtaccggg

SEQ ID NO: 203036 - DNA, 574 bp, Homo sapiens
  misc_feature: GYAE6OF01DDG8I.18.36.D03.1.454.CMB.1.raw
  modified_base (445)..(445): a, c, t, g, unknown or other
  misc_feature (445)..(445): n is a, c, g, or t
tcagtacgagtatgcacgaccggtgctcgatttagctgcgtcacgatctctcttgggattgtctctgctaatagtgaaccgcccctccacggagccttggtacagcctggggggtccctgagactctcctgtacagtctctggattcaccgtctccacttttgccatggcctgggtccgccggggctccagggaagggcctgggagtgggtctccactatcagtgacactggtaatggcgatagcaagtggtacgcaggctccggtggacggggcggttcaccattagcagagacaattccaagaacacggtactatctacaaatgaacagcctgagacgcgaggacacggccctgtatttctgtgtgagagatcgtaaaattcccttacgtattgttcttgtactagtggtgggacgaaggacaagtggtccaccgtctccctncgcctccaccaagggcccactccggtccttccccgtgccgccctcgccgtccacggacgccgtaccgtccgacggtacgaccacgacggaccggcccgtcggggctacggccgtcggtcggtaaaccgg

SEQ ID NO: 203037 - DNA, 883 bp, Homo sapiens
  misc_feature: GYAE6OF01DCCRQ.18.36.D03.1.454.CMB.1.raw
  modified_base (671)..(671): a, c, t, g, unknown or other
  misc_feature (671)..(671): n is a, c, g, or t
tcagtacgagtatgcacgaccggtgctcgatttagctgcgtcacgatctctcttggggtctgagagaggagcccagccctgagattttcaggttgttttcacttggtgatcaggactggacagagagaactcaccatggtagtttgggctgagctggcttcttttcgttttggacgttaagttttaaaagggtgttacgaaaggtggtgaggtgcagtcgtggttggagtcgtggggggacgtccgttggtacaggtccggtcggggggtccctggacgacttccgtccgtagtacctagttcctcgtacggtacttccgtacccgttccttacctaccttttcgcctagtcggccggttcggggtcccgccgggtccgtaccggaacggggtacggggtccgtaggggacggttcgggtctacccgacgttagtccaggtacgtaaccgaacgttagggtaaggttcgggaacggtaagtaacggtaccggtaaagggttacgggaaccgcggtacgggtcccgttacgggggtacggggaacggggttccggttaaccgaaccgtaagttacggacgaaggtaaccgtaaccgtaaacgtttaacccgaaaaacggtaacctacgggttaaccttacgtaacttaaaccgtaaagtaacgttaaacccngggtaaccctaagggaaccgggtacggtaaccccgggaacggtaacccggtaccccggggttacccgttaccggttttacgttttacccgttagggttaacgggttaacggtaggtaaaaaccggttaaaccgtttaaacccgggttttaaaaaaccctttttaccccggtttttaacgttaacgggttttccgtttttcggtttaaaacgg

SEQ ID NO: 203038 - DNA, 705 bp, Homo sapiens
  misc_feature: GYAE6OF01ECYVT.18.36.D03.1.454.CMB.1.raw
tcagtacgagtatgcacgaccggtgctcgatttagctgcgtcacgatctctcttgggattgtctctgctaatggtgaaccgcccctccacggagccttggtacagcctgggagtccctgagactctcctgtacagtctctggattcaccgtctccacttttgccatggcctggtccgccggctccgagggaggcctggagtggtctccatatcagtgacactggtaatggctatagacaagtggtacgcgaggcgtccggtgggacggggtcggttcaccgtagttagcagagaaccaattccgaaaagaaccgtacggtactagtactaacaaagtgaaacacgcctgaagagcgtagaacggacgacggtcttacgttctttaacgttttcgtggttacgacggtaaaggaccgtaacggtacggttttcggggggaccctcgtaaacgttacgtaacctttacctaacgttttacgtaagttacgttacggggacgaacgggtaccgtccccggttaggttacccgacccgttcccgtccgttaccgacggaccccttcccgaaaccgaaccgggtccctacgttccggttccccttacccccggtcgccccgtcccgtcgtccctaccgaacgggtaccaccgtacccgttaccgacggcgtaccgaaacgcccgggtaccgtcccggtcggtcgtcccgg

SEQ ID NO: 203039 - DNA, 713 bp, Homo sapiens
  misc_feature: GYAE6OF01CO8DI.18.36.D03.1.454.CMB.1.raw
  modified_base (98)..(98): a, c, t, g, unknown or other
  misc_feature (98)..(98): n is a, c, g, or t
  modified_base (159)..(159): a, c, t, g, unknown or other
  misc_feature (159)..(159): n is a, c, g, or t
  modified_base (184)..(184): a, c, t, g, unknown or other
  misc_feature (184)..(184): n is a, c, g, or t
  modified_base (186)..(186): a, c, t, g, unknown or other
  misc_feature (186)..(186): n is a, c, g, or t
  modified_base (193)..(193): a, c, t, g, unknown or other
  misc_feature (193)..(193): n is a, c, g, or t
  modified_base (197)..(197): a, c, t, g, unknown or other
  misc_feature (197)..(197): n is a, c, g, or t
  modified_base (249)..(249): a, c, t, g, unknown or other
  misc_feature (249)..(249): n is a, c, g, or t
  modified_base (261)..(261): a, c, t, g, unknown or other
  misc_feature (261)..(261): n is a, c, g, or t
  modified_base (631)..(631): a, c, t, g, unknown or other
  misc_feature (631)..(631): n is a, c, g, or t
tcagtacgagtatgcacgaccggtgctcgatttagctgcgtcacgatctctcttggggtctgagagaggagcccagccctgagtatttttcagggttntttttcacttggtgatcaggactggacagagagaactcaccagtggtagttggctgagcgngtcgtcttgtgtgatagttaaagtntnagtgagnggtnctagctgtgcgtggtgggagtccgttgtacgcgccggttcggggtcctgganctcgtctgtacngttcctagtgtacttccgtacctccttaccttcgtttacaccgtgtcgggtcccgtgggtccccgccggtccgtacggacggggacggtccggtaagggtcggttcggtacctacctacgttacgtgttaagacggtactacggttaggtaagtcgacgtaagttacgaccggtaaaggttcgaacgcggtaggggtaccgtacggttacggggggtacgggttacccccgttaagtaaccccggtagttaaaccggaccggtaaaggtaaccgttaactaaccgtaaaccgaaacggaaccctttaagtacttacgtaaactaactaaagaccgaactaggtacacgaggaaccgtacggacggaaccncggttacccttgtttacgtgtgttaggtaaccggtataacgttaacgttaacttaacgttcccttaggttactttggttacg

SEQ ID NO: 203040 - DNA, 788 bp, Homo sapiens
  misc_feature: GYAE6OF01A3MMW.18.36.D03.1.454.CMB.1.raw
tcagtacgagtatgcacgaccggtgctcgatttagctgcgtcacgatctctcttggggtctgagagaggagcccagccctgagtattttcaggtgttttcacttggtgatcaggactggacagagagaactcacatggagtttgggctgagcgtggtctctttacgtgtggtacgtaagttttaaaaggtgtcaaggtgtggaggtgcagtcgttggttgggagttcggtgggggacgtccgttgggtaccgacggtcccgggtcgggggggttccctaggacgtaccttccgttcctgtactacgttccttcgtggtacttccgaccgttcctacctacgtttcgacctacgtcggtccgtccgggtcccggccggtccgtaccggagggaccgggtccgtagggacggttcgggtcctaccgtacgtcgtacgagtacgtactacgtaggtaacgtggaacgtagtacggtagtaaggtcggtaacgcgtacgggtccgttacgggtaggggaccggggttccggttacgaacccgtaagttacggacgtaaggaacgtactaaacttaccgaaacgtaacgtaccggttactaacgtaacctaaacgtaaacgtacgaaaccgacgtcgtaacggaacggtaaccggacggtaaccggaacccgtacccggttaccgttaacggtttacgttccgttagggtcggttaggaaaccggtaacgttaaaccggttaaaccgtttaaacccgttttaccccggtttaagttacgtttccgttttaacg

SEQ ID NO: 203041 - DNA, 677 bp, Homo sapiens
  misc_feature: GYAE6OF01CW0IC.18.36.D03.1.454.CMB.1.raw
tcagtacgagtatgcacgaccggtgctcgatttagctgcgtcacgatctcgtcttgggattgtctctgctaatggtgaacccgcccctccacggagccttggacagccgtgggggtccctgagactctcctgtacagtctctggacttccaccgtctcctacttttgccagtcggccgtgggcccgccggctaccgagggaggcctggagtcggtcctccaatctacagtgaactacgtaggtaatggacgtatacgactaaggtcggacgcgaggtccgtccggtgggacgggtcggttacaacctagttacgacagtaacgaactaactaccgaaagaacgtacgtactatactaaacgaatagaacacgcctaggacgacggacgaacgtacgaccggtccttagttacttgtgtagagaagtaacgtacttaacgtaaactttcccgttagtattgtttctagtataggtgggtacggaccgaaaggaactagtaccggtacctaccgttcctactccgaccgtacctcccgaaccgaccgggtccctacggttccccgtacccgttccccgtcggccccgtccgtccgccgtacccggaggtacccgacctacccgacggacgaccgcaccgaccggcccgtccggtcggcctcgccggtgtaccgtaaccg

SEQ ID NO: 203042 - DNA, 754 bp, Homo sapiens
  misc_feature: GYAE6OF01C49GC.18.36.D03.1.454.CMB.1.raw
  modified_base (742)..(742): a, c, t, g, unknown or other
  misc_feature (742)..(742): n is a, c, g, or t
tcagtacgagtatgcacgaccggtgctcgatttagctgcgtcacgatctctcttgggtctgagagaggagcccagccctgagtattttcgaggttgttttcacttggtgatcaggacgtggacagagagaactcaccagtggtaggttgggctgagtcgtcggtcttcttttcgttggtggtacgttaagttttaaaaggtgtacgtaaggttggtaggaggtgcgaggtcgttgggttgggtaggttccggggtagggggacgtccggtttacggtaacgcggtccgggttcgggggtcctgacgtacctctcgtacgtactcgttctcgtacgtcttacccgaccgttctacccttactttccgaccgtgtccggtcccggttccggggtacccgggtccccggggtaccggtaccgggacgggggtaccgggtcggttagggtacgggttcggtacccttaccgtaccgttagtccgtacgtacgacgtacggtacggtaaggtcggagtaacgtacgtcgtaaacggtcggtaccacggtcggtaccggtcggggtagggtacggggtacgtactacgagttacgagaacgaacgtacaacttaccgaagtacctaagtctaactacgaacaagtaccgagtcgtactaggacgtacggaccgacgtccgccgtacctgtttacgtcgtggtacggttagacgtaaagttaccggttaaacttacccgtttacggttntcgtttgttacg

SEQ ID NO: 203043 - DNA, 692 bp, Homo sapiens
  misc_feature: GYAE6OF01B6DMH.18.36.D03.1.454.CMB.1.raw
tcagtacgagtatgcacgaccggtgctcgatttagctgcgtcacgatctctcttggggtctgagagaggagcccagccctgagattttcaggtgttttcacttggtgatcaggactggacagagagaactcaccatggagtttgggctgagctggctctttcttgtggtcgtaattttaaaaggtgtcaagtgtgaggtgcagctgtggagtcgtggggagcgttggtacagccgtggggggtccctggagacctcctcctgtacagtcttcgtggtacttccaccgtcctccttactttcgccagtcggccgtcgggtcccgccgggccgtccggaggggacggccgtgggtacggtcggtcctccactacgtcagtcgaactacgtaggtaagtcggacgtaagtacggacgtaaagggttcggtaaccggcgtagggtccgtccgggtggggtaaccgggggtccggttacgaaaccgtagttaacggacgaagaacgaactaaacgttaccaaacggtaaccgacggttactaactacctaaacaaacgtacgaacacgtaccgtaggaacgacgaccggaacgggacccgtaccggtcccttagttacgttttcgtaggttgggtacgaaggtaacgtaacttaaaccggttaaaccttttcccgtttacgtaagttttcgtttacg

SEQ ID NO: 203044 - DNA, 757 bp, Homo sapiens
  misc_feature: GYAE6OF01B6X1H.18.36.D03.1.454.CMB.1.raw
  modified_base (545)..(545): a, c, t, g, unknown or other
  misc_feature (545)..(545): n is a, c, g, or t
tcagtacgagtatgcacgaccggtgctcgatttagctgcgtcacgatctctcttgggattgtctctgctaatggtgaacccgcccctccacggagccttggtacagccgtgggggtccctgagactctcctgtgcagcctctggattcagtttcagtcgcctacgtggatgcacgtggactcccgacctaagttccgaagggaagagacgtgggtggtgggtctacgaacgttaattaaagagtaggaggtgggggtacaccacacgtaccgtacggccggaccgttccggtagggacggggccgtcgttaccgacctactaccgtacccggaacgaaccaaaccaaccgaaacgaaccacgcttacgtactctacgaacaaagtagacgacgtacggtcggtacgggagtacggaacggacgacggtcttgtacttagttacgtgtacgaagaagggacgggtacgtacggtcgacggtacgggtaggggttcggcccgacccgggtgggaccgtacgggacccgttcggacccgtaccgtccnccgtcgaccgtcccaccgacgacggcccctaggttcccgtaccccgttccccggacgtcccctacccccgttacgacccgaacggcccgaccgtacccggttcgggacggggacccaccgggacccgggccccgggtccccggttggggaccccgttcggaccccggttagggttaaacccaaccgggttacccctttaccggtaacccccg

SEQ ID NO: 203045 - DNA, 742 bp, Homo sapiens
  misc_feature: GYAE6OF01DCNX6.18.36.D03.1.454.CMB.1.raw
  modified_base (257)..(257): a, c, t, g, unknown or other
  misc_feature (257)..(257): n is a, c, g, or t
tcagtacgagtatgcacgaccggtgctcgatttagctgcgtcacgatctctcttgggattgtctctgctaatggtgaaccgcccctccacggagccttggtacagccgtggggggtccctgagactctcctgtacagtctctggattcaccgtctccacttttgccagtggcctgggtccgccgggctccgaggggaaggcctggagtggtctaccactatcagtgacatggtaatggcgatagcaaggtggtacgnaggcgtaccgtgggaggggcggtcacattagcagagacaatcaagaacacggtactagtacctaacaaatacgaacacgccgtagacggagaccggaaggaaccgaccggtaccccttaggtacttttcgtgtagggtagagaggtactacggtaaaactttcccgttttacggaaatttgttacctttagaacgtttagttacggggttagggggaccgtaaaaggggtaacctaaaggttacggggtaccttaaccccgggttcctcccgttacgacgacccttacccgaaccgaaaccgggcccctaacggtcccggttccccgtttcccccgtacggggcccctaccccggtcggtacccttaccggaaacggtaccgacccgacccgtaacccggaggaaccggtaccgaaccgaaccgggtcccgggtaaccccgttcggggacgttaccggacccgttggtacggttaaaaccccggg

SEQ ID NO: 203046 - DNA, 805 bp, Homo sapiens
  misc_feature: GYAE6OF01DI6ZZ.18.36.D03.1.454.CMB.1.raw
tcagtacgagtatgcacgaccggtgctcgatttagctgcgtcacgatctctcttgggtctgagagaggagcccagccctgagtatttttcaggttgtttttcacttggtgatcgaggactggacagagagaactcaccagtggtagtttgggctgagcgtggtcttcttttcgttggtggtacgttaagtttttaaaaggtgtacgtaagttggtggaggtgcgaggtcgttggttggtaggttcggtgggggacgttccgttagggttaccgacggtccggttccggggggttcccctaggacgtaccttccgttccgttagttaacctagtttccgtcgttacggtaacctttcccgtaacccgtttccttaccttaaccgtttttcgccccgtagttcgggtcccggtcggggtccccggccggtccgtaccggaagggggacggtccggtgggtacggtcggttaccctcccgtacgtacgtcgagttacgacctaacggttggtaagtcggactagtacgacgtaagggttcggtacgacgtacggtcgtaccgggtgggcgggttaccgttacgacttagtacgacgtaagaacctaacgtaacgttacccgaaacgtaaccgtaacgttactaacgttacctaaactaaagtacgaacgtacgtcccgtaaggaacggaccggaccgtaaccggaccgtacccggtcgttttacgttacgtttcgtaggttaggtcggaacgtaagttaaacgttaaccctttaaaccgttttccccgtttagtcgttttgtttacgg

SEQ ID NO: 203047 - DNA, 846 bp, Homo sapiens
  misc_feature: GYAE6OF01CIXXR.18.36.D03.1.454.CMB.1.raw
  modified_base (532)..(532): a, c, t, g, unknown or other
  misc_feature (532)..(532): n is a, c, g, or t
  modified_base (565)..(565): a, c, t, g, unknown or other
  misc_feature (565)..(565): n is a, c, g, or t
tcagtacgagtatgcacgaccggtgctcgatttagctgcgtcacgatctctcttggggtctgagagaggagcccagccctgagtattttcgaggttgttttcacgttggtgatcaggactggacagagagaactcaccagtggtagttgggctgagcgtggtcttcgttttcgttggtggtacgtaagttttaaaaggtgtacgaaggtgtggaggtgcgacgtcgttggttggtagttcggtgggggacgtccgttggtaacgcggtcccgggttcggggggtcccctaggaccgtaccttccgtccttggttaaccgtcggttcccgttcggtttacgggttaccgttaccccgtacccggttcccttaccgtttaccgtttccgaaccgttcggtcccggtccgggttccgggtccccggggtacccggtaccggaacggggaccggggtaccgggttcgggtacgggttcgggtccgttacccgaccgttacgtactacggtacgtacgacgttacggtaagtacggngtaacgtaacgtaggacggtacggtcggaccgnggtaccggtcgggtcggtagggggtacccggttaccgtaccgtaacgttacgttaacggaccgtaaagtaacccgtaaagtaaacccgtaacggtaaaccgtaaccggtaaccgttaacttaactaaaccgtaaacggttaaccggaaacctaacggtaaccccgtaggtaacggaacgtaccgggaaccgacgtaacccggtcccggttacgttcggtttaacgtcggtaacgtaggtacgtaagtactaacgttaaacttcgttactgttgttgtaacg

SEQ ID NO: 203048 - DNA, 846 bp, Homo sapiens
  misc_feature: GYAE6OF01AIBLF.18.36.D03.1.454.CMB.1.raw
tcagtacgagtatgcacgaccggtgctcgatttagctgcgtcacgatctctcttggggtctgagagaggagcccagccctgagtatttttcaggttgttttcacttggtcgatcaggactggacagagagaactcaccagtggtagtttggctgagcgtcggtcttctttcgttggtggtacgttaaagttttaaaaggtgtacgtaaggttggtaggtacggttagcgtacgtcgttggttgggacggttcgggtgggggtacgtccggttaggtaccgacgggtcccggggttaccggggggtccctaggtacgtaccctccgttaccgtacgtacgtcgttcgtcggttacgttacttcccgtccttccttcttacgtttcgaccgtcggtccggtccggtccgggtcccggtccggtacggtaccgggacggggtacgggtccggtagggtcggttacggtaccctacgtacgtacgtacgtacgtacgtacgtacggtaggtacgtacgtacgtaagtacgtacggtacgggtacggtaccgacggtacgggtaccgggtcggggtacggggtaccgggtaccgtaaccgtacgttagtacggaacgtaacggtaacttaaccgtaacgtaaccgaaacggtaaccgttaccgttaacttaactaaccggttaaactacggtaacggtaaccgtaccgggtaacggtacgggaccggaaccggtaccggaaccggtacccgttccggttacgtttacggttacgtttggtaacggtagtacggaaacgttacgttaaacccgttacgtttacccgtttaccgttaggtttgttacgttagg

SEQ ID NO: 203049 - DNA, 962 bp, Homo sapiens
  misc_feature: GYAE6OF01B9AQI.18.36.D03.1.454.CMB.1.raw
  modified_base (298)..(298): a, c, t, g, unknown or other
  misc_feature (298)..(298): n is a, c, g, or t
tcagtacgagtatgcacgaccggtgctcgatttagctgcgtcacgatctctcttgggattgtctctgctaatggtgaacccgcccctccgacggagccttggtacagccgtgggggtccctgagactctcctgtacagtctctggtacttccaccgtcctacctacgttttcgcctagtcgggtccgtcggggtcccggcccggggtctccggaagggggaacgggtccgtagggacgggttcgggttcctacccaacgttactacgaaggttacgaacctacggttagggttaaagngggaacgtagttacggacgtaaggttcggaaccggtacgacggtccgtccgggtggggacgggggtaccgttccgaacctaagttacggaccgaaggtaacgaaccgtaaaacttaacccgaaacggtaaaccgtaccgggtttactaaacgtacctaaaaccgtaataacgaaaccgtacggtaccgttaacgggaaacggtaccggaccggaacgggacccgtaacccggggtccctttaggtttaacttttcggtacgttgggttacggaaaggtaacgttaacgtaacccgtttaaaaacttttccccgtttaggtaacgttttcggtttacgttggttaaacggtttcggttaagggggtccggggtaaccggtaaacgggaccgttaaggttccggttaacccgtacccgtttacccttcccttaaccccgaccgttaccgtacccccggttaaccgaccccgggtaaccccttcggttacccccggtttcccgttaacccccggtccggtacccgttcccgtaccggtcccgaacggtaccgggtaccaccccgggtacccgaacgcccggtaaccgtaaccggaccggtaccggtccccgggtcccggtacgggttcccggtaccggtacccggttgtaaaccgggttaacccggg

SEQ ID NO: 203050 - DNA, 846 bp, Homo sapiens
  misc_feature: GYAE6OF01A4OSP.18.36.D03.1.454.CMB.1.raw
  modified_base (756)..(756): a, c, t, g, unknown or other
  misc_feature (756)..(756): n is a, c, g, or t
tcagtacgagtatgcacgaccggtgctcgatttagctgcgtcacgatctctcttgggattgtctctgctaatggtgaaccgcccctcacggagccttggtacagccgtggggggtccctgacgactctcctgtacagtctcgtggacttccaccgtctccgtacttttcgcctagtcggtccgtggggtcccgccgggctccgaaggggaacggccgtaggtggtgggtcctaccatatcagtgaccacgtggtaaagtggacgagtacggactaaggttggtaaccgcgtacgggtccgttccgggtagggggacggggtccggttaccaaccgttaagttacggacaaacggaacgaactaacgttaccgaaaacgtaaccgtaaccggttcttaacgtaacctaaaccgaaaagttaccgaaacgtaccgtccgttaagggaaggaccgaccgggaaacggacccgtaaccccgggtcccgttagtttaacgtttcgtaggtgtagaaggtacgtaacgttacgtaaaacttttcccgtaggtactttgttacgttagacgttaggtcgggtacgggtaaccggtaaaggaacgtacggttcgaccccgttaacccggtccttaccgtaccgaacccggttcccgtaaaccccgaaacccgggtaccggtaccccgtaaccggttccccggttccccgttccccggttaccggcccggtttcccctacgtccccgtacggacgggttaacccncccgacccgggtacgacccgtaggacccgttacaccgggacccggtccgtaccggggcccttgggacccggtaggtaacccgtaaaccgg

SEQ ID NO: 203051 - DNA, 723 bp, Homo sapiens
  misc_feature: GYAE6OF01A71OY.18.36.D03.1.454.CMB.1.raw
  modified_base (254)..(254): a, c, t, g, unknown or other
  misc_feature (254)..(254): n is a, c, g, or t
  modified_base (392)..(392): a, c, t, g, unknown or other
  misc_feature (392)..(392): n is a, c, g, or t
  modified_base (557)..(557): a, c, t, g, unknown or other
  misc_feature (557)..(557): n is a, c, g, or t
  modified_base (651)..(651): a, c, t, g, unknown or other
  misc_feature (651)..(651): n is a, c, g, or t
  modified_base (675)..(675): a, c, t, g, unknown or other
  misc_feature (675)..(675): n is a, c, g, or t
tcagtacgagtatgcacgaccggtgctcgatttagctgcgtcacgatctctcttgggattgtctctgctaatggtgaacccgcccctccacggagccttggtacagccgtggggggtccctgagactctcctgtacagtctctggattccaccgtctcctacttttcgccatcggccgtggggtcccggcccgggctccgaggggaagggccgtggaggtcgggtcctccgactatcagtgacacgtaggtagnggagatagacgtaaggtcggtacgcgacggcgttccggtaggggacggggtacggttaccaaccgtaagttacgacaaggaacgtaactaaacttaccgaaagaaccgtacggtactaactactaacgaatacgaacncgccgtagacgacgaccggacgaccgaccgccgttgttacttcgtgtgtaggagagtaactaaccgttaaacctttccgttacgtagttcggtttcttagtagttacgtcgggtacgggaacggtaagggactaaggttcgtccgaccgttcctacctacgaccncccgtaccgaacccggtaccggccgtacggttcccggttccccgttaccccgggtccggtcccgcccgttaccgtcccgaccggaccgggaccncccacccgtacgaacggccaaccncggaccggcccggtccgggtcgccgtcgtccggtcggaacgtaacccg

SEQ ID NO: 203052 - DNA, 954 bp, Homo sapiens
  misc_feature: GYAE6OF01CMO4O.18.36.D03.1.454.CMB.1.raw
tcagtacgagtatgcacgaccggtgctcgatttagctgcgtcacgatctctcttgggattgtctctgctaatggtgaaccgcccctccacggagcccttggtaccagccgtgggggtccctgagactctcctgtacagtctctggattccaccgtctcctacttttcgccagtcggcctgggtcccgccgggctccgaggggaacggtcctgggacggtcgggtcctccaacgtatcgagtgaccagtaggtaatggacgtatacgactaaaggttcggtaacgccgtaacggtccgttacccgggttaggggtaacgggggtaccgggtttaccaaacccgtaacgtttaaccgaacgtacggaaacggtaacctaaacgttacccgaaaagtaaaccgaaccgggttacttaactaccgtaaactaaaatcggaaaactacggtacctacgggaacgacggaccggaacggaaccgtaaccgggtcccgtagtttaacgtttccgtaggttagtacggttaaacggaacggtaacttaaaccggttaaaaaccttttcccgtttaacgtacgtttacgtttccttaaggtacgttacgttacgggtacggggtaaaccccggtaaaagggaaccgttaaaggttaccgggtaccgttacccggttacccgtacccgtttaccgaacccgttacccccgtaacccggtaaccccggtaaaccgggtcccccgttaaaccggtttccccgggtttaccccccgtttacccccgttccggggttaccccttaccccggttaccgtacccggtacccggtaacgggtacccgaccccggtaacccgtaaccggtaacgggaccgacccggtaacccggtaaaccgggtccccggtacccggttccggggttaacccgtccggttaaccggttccgggtaacccggttaaaacccgg

SEQ ID NO: 203053 - DNA, 819 bp, Homo sapiens
  misc_feature: GYAE6OF01E49HT.18.36.D03.1.454.CMB.1.raw
tcagtacgagtatgcacgaccggtgctcgatttagctgcgtcacgatctctcttgggattgtctctgctaatggtgaacccgcccctccacggagccttggtacaggccgtggggggtccctgagactctctgtacagtctcgtgggttcgtcaggtggacgactacagtgacgtcgtcgggtcccgccgagggcctaccggaaggggaacgggtccgtagggtaggtggtactctactactttatttagtaggtggtacgtaccactagtaactacacagaccgtcgtacggacggccgtatccaccgtatcgacgaagaacgaactaacgtccgtaacggaactacctagttacggtacttaccgttaacaaaatacgtaaacctaaccggtggaacgtaccggaccggaggaaccacgggcctagttacgtacgttcgtggtagggtacggtactttagtttacccggtccggtacccggggtccgggggacccggtaaccgtcggtaccctccccggtcccctacccccgaccccgtaccgacccgaccggtccctaccggttcccgttccccttccccggtccgccccgttaccccgtccctacccgtaacggccgtcccgtaccgggtccggtaccgggggacctaaccgggccgggtccccgggtaccggtccggtacgtcccggtccggtacggtaaccggtaaccggtaccctacccggttaccctaccggttacccgttaccgggtcggttaccgggaccgggtcccgggtacggtaccgggtaaccggacggggtacctggtaacggg

SEQ ID NO: 203054 - DNA, 846 bp, Homo sapiens
  misc_feature: GYAE6OF01AN8LR.18.36.D03.1.454.CMB.1.raw
  modified_base (137)..(137): a, c, t, g, unknown or other
  misc_feature (137)..(137): n is a, c, g, or t
tcagtacgagtatgcacgaccggtgctcgatttagctgcgtcacgatctctcttgggattgtctctgctaatggtgaaccgcccctccacggagccttggtacaggccgtgggggtccctgagactcgtcctgtacngtctctggattcaccgtcctcctattttgccatggccgtgggtccgcgggctccgagggaggcctggagtggtcctcgactatcgagtgacacgtgtaagtggcgagtagcgtaagtgacgtcgcgacggtcctccggtggggacggggtccgttacaccgtagttacgacctaggacgaacctaacgttacccgaaacgtaaccgtccggttactaacttactaacgaaaagtcgaaaccgagccgtacgaggaccggaccggacggaccgacccggtccgttgtttactttcggttagttggtaggtacgtaagtaaccgttaaccggttaaaacttttcccgttttaacgttacgtttacggtttaacgtttgggtaaacctttagggtttacggggtacgggggaaacccgaacggggtaactaacgggtttaccggtaccccggttaaccccgtttcccgttaccccgtacgtaacccccggttaccccgtaccccgaaaccccgggtaaccggtccccccgtaacgggtttcccccggtttcccccgttccccccgggttccgggcccccgtccccgtaccggtacccgtaccggacgggtaccctacccgaccccggtacggccggaaccgccccgaacgggcccgggaccccgtaccccggggttggtaccccgtccggtaccgggttcggtaaacccggg

SEQ ID NO: 203055 - DNA, 778 bp, Homo sapiens
  misc_feature: GYAE6OF01BRAKP.18.36.D03.1.454.CMB.1.raw
tcagtacgagtatgcacgaccggtgctcgatttagctgcgtcacgatctctcttgggattgtcctctgctaatggtgaaccgcccctccacggagccttggtacagccgtggggggtccctgagactctcctgtacagtctcgtggattccaccgtctcctacttttgcccagtcggcctgggtccgccggctccgagggaggccgtggagtcggtctccactatcagtgacacgtggtaactggacgagtacgactaaagggtcggtaccggctagggccgttaccgggtggggaacggggtccgggtttacccaaccgtaagtttagccgtaaaggaacgaactaaacgttacccaaaaggtaaccgtacggtttactaacttactaaacgtaaatcgaaacacgtccgtaggaaggacggaccggaacgggaacccgaaccggtccgtttagttacgttttcgttaggtgttaacggaagtaacgtaacgttaaccgtaaaacttttccgtttacgtaatttcgtttagttagtagttagtcgggtacgggaaaccgtaacgggtaaactaacggtcggttaccacccgtcctcccgtacacccgtccctaacccggaacccgaaccggtccctaccgttccgttaccccgttccccggtcggcccgtcccctggccctaccggtacggacctaccctaccgtacccggagtacccgacgtaacccggccgcccggtcccggtgtccgggtactccggtaacggcggtaacccgg

SEQ ID NO: 203056 - DNA, 830 bp, Homo sapiens
  misc_feature: GYAE6OF01AZDV7.18.36.D03.1.454.CMB.1.raw
  modified_base (107)..(107): a, c, t, g, unknown or other
  misc_feature (107)..(107): n is a, c, g, or t
  modified_base (758)..(758): a, c, t, g, unknown or other
  misc_feature (758)..(758): n is a, c, g, or t
tcagtacgagtatgcacgaccggtgctcgatttagctgcgtcacgatctctcttgggattgtctctgctaatggtgaacccgcccctccgacggagccttggtaacngccgtggggggtccctgagactctcctgtacagtctcgtggttcaccttcagtgctctgctagtgacacgtcggtccgccgaggcgttaccgggaaaggcgtggaggtgggttcgtacgtatagaagactaaagtacctaacgtagttacgcgactacgctatagtgcgtaggtcggtacgggtagaaacggcgtaggttccgaccgtacctaccgaaggtaatggtaacttaacgaaacgacgacggtacgtacttcgagaactaaagtacgaaccgtaggtaccaacggaaaaccgtagggaccaccgggtaccgtagttacgttacgtcgtaacgtagacggtagtacgtattacgttagggttacgggtattaggtaccggtaagggtaaccggggtaactacgtacgtacgtaggtcggtacgttacggcggggtaacccgaacgggtacccgacggttaccgtccgtacctcccgtaccgacgtccccgtaaccggtaacccggtaacccggtacccgtaccgggttaccccgttaccccgttcccccggtacccggtacccccttacccccgtaccccgtaaaccgttaccggaaccccggtacccgttaacccggggtccccggggttacggggtaacccccncccggggtaaacccgggttccccccgggttaacccggcccggggttaccctcccggggtttaaccccggggg

SEQ ID NO: 203057 - DNA, 523 bp, Homo sapiens
  misc_feature: GYAE6OF02I116R.18.36.D03.1.454.CMB.1.raw
tcagtacgagtatgcacgaccggtgctcgatttagctgcgtcacgatctctcttggggtctgagagaggagcccagccctgagattttcaggtgttttcacttggtgatcaggactggacagagagaactcaccatggagtttgggctgagctggctctttcttgtggcgattttaaaaggtgtcaagtgtgaggtgcagctgttggagtctgggggagccttggtacagcctggggggtccctgagactctcctgtacagtctctggattcaccgtctccacttttgccatggcctgggtccgccgggctccgagggaagggcctggagtgggtctccactatcagtgacactggtaatggcgatagcaagtggtacgcaggctccgtggaggggcggttcaccattagcagagacaattccaagaacacggtctatctaacaaatgaacagcctagagagccgaggacaccggccctgtacttctgtgtgagagatacgaaattcccttacgtactgttcg

SEQ ID NO: 203058 - DNA, 523 bp, Homo sapiens
  misc_feature: GYAE6OF02ILS31.18.36.D03.1.454.CMB.1.raw
  modified_base (462)..(462): a, c, t, g, unknown or other
  misc_feature (462)..(462): n is a, c, g, or t
  modified_base (478)..(478): a, c, t, g, unknown or other
  misc_feature (478)..(478): n is a, c, g, or t
tcagtacgagtatgcacgaccggtgctcgatttagctgcgtcacgatctctcttgggattgtctctgctaatggtgaaccgcccctccacggagccttggtacagcctggggggtccctgagactctcctgtacagtctctggattcaccgtctccacttttgccatggcctgggtccgccgggctccagggaagggcctggagtgggtctccactatcagtgacactggtaatggcgatagcaagtggtacgcaggctccgtggaggggcggttcaccattagcagagacaattccaagaacacggtctatctacaaatgaacagcctgagagccgaggacacggccctgatttctgtgtgagagatcgaaaattccctttcgatgttcttgatatgtggggccaagggacaatggtcaccgtctcctcagcctccaccaagggcccatcggtcttccccnggcgccctgctccagngcactccgagacgcacagcggccctgggcctggcctggtcaacgg

SEQ ID NO: 203059 - DNA, 550 bp, Homo sapiens
  misc_feature: GYAE6OF02G9YXD.18.36.D03.1.454.CMB.1.raw
  modified_base (179)..(179): a, c, t, g, unknown or other
  misc_feature (179)..(179): n is a, c, g, or t
  modified_base (196)..(196): a, c, t, g, unknown or other
  misc_feature (196)..(196): n is a, c, g, or t
  modified_base (200)..(200): a, c, t, g, unknown or other
  misc_feature (200)..(200): n is a, c, g, or t
  modified_base (204)..(204): a, c, t, g, unknown or other
  misc_feature (204)..(204): n is a, c, g, or t
  modified_base (207)..(207): a, c, t, g, unknown or other
  misc_feature (207)..(207): n is a, c, g, or t
  modified_base (214)..(214): a, c, t, g, unknown or other
  misc_feature (214)..(214): n is a, c, g, or t
  modified_base (224)..(224): a, c, t, g, unknown or other
  misc_feature (224)..(224): n is a, c, g, or t
  modified_base (226)..(226): a, c, t, g, unknown or other
  misc_feature (226)..(226): n is a, c, g, or t
  modified_base (235)..(236): a, c, t, g, unknown or other
  misc_feature (235)..(236): n is a, c, g, or t
  modified_base (244)..(244): a, c, t, g, unknown or other
  misc_feature (244)..(244): n is a, c, g, or t
  modified_base (247)..(247): a, c, t, g, unknown or other
  misc_feature (247)..(247): n is a, c, g, or t
  modified_base (262)..(262): a, c, t, g, unknown or other
  misc_feature (262)..(262): n is a, c, g, or t
tcagtacgagtatgcacgaccggtgctcgatttagctgcgtcacgatctctcttgggtctgagagaggagcccagccctgagattttcaggtgttttcacttggtgatcaggactggacagagagaactcaccatggagtttgggctgagcggcgtggctaaggtcgcgatagttaagngcagtgtgagtgcagcngtgngtgnggngcgtgtngcgtggtcgngngctctctgnngtctctgntcncgtctctcttcgctntgcgtcggtccgccggcgcgacggacggcgtggcggtcggtcgtcgtactactcgtagtcgacacgtagtagtagacgagtagacgagtagtacgtacgacgtcgtcgtggtacgggtcggtcgtacgtagtacgtacgacgacgacgtaacgtacgtaacgaacgacgtactactactaactaacgtacgaacgacgacgtagacgacgacgacgacgaccgtacgtcgtacgttcgtcgtcgtagtagagtacgtacgtaacgttaccgtttacgtacgttgttcg

SEQ ID NO: 203060 - DNA, 626 bp, Homo sapiens
  misc_feature: GYAE6OF02JC8JH.18.36.D03.1.454.CMB.1.raw
  modified_base (252)..(252): a, c, t, g, unknown or other
  misc_feature (252)..(252): n is a, c, g, or t
  modified_base (356)..(356): a, c, t, g, unknown or other
  misc_feature (356)..(356): n is a, c, g, or t
tcagtacgagtatgcacgaccggtgctcgatttagctgcgtcacgatctctcttgggattgtctctgctaatggtgaaccgcccctccacggagccttggtacagcctgggggtccctgagactctcctgtacagtctctggattcaccgtctccacttttgccatggcctgggtccgccgggctccagggaagggcctggagtgggtctccactatcagtgacactggtaatggcgatagcaagtggtacncaggctccgtggagggcggttcaccattagcagagacaattccaagaacacggtctatctacaaatgaacagcctgagagccgaggacacggccctgtatttcngtgtgagagatacgtaaacttcccttacgattcgtttcttagattaagtgggttcggggacctaaaggggacaaagttcgggtacccgtaacccgttccttccctacgaccgtaccctcccgaaaccgaacggggccctaacgttccggtccctttccccgtggcccctccgtcgcctaccgacggacgccctacccgccggtaacggacgaccgtaccgacggtccccggccgtcgggtcctcgggtcccgttaggtaccgaaaccggg

SEQ ID NO: 203061 - DNA, 551 bp, Homo sapiens
  misc_feature: GYAE6OF02GHH2Q.18.36.D03.1.454.CMB.1.raw
tcagtacgagtatgcacgaccggtgctcgatttagctgcgtcacgatctctcttggggtctgagagaggagcccagccctgagattttcaggtgttttcacttggtgatcaggactggacagagagaactcaccatggagtttgggctgagcgtggcgtctttcttgtggcgtattttaaaaggtgtcaagtgtgaggtgcagctgttggagtctggggggagccttggtacagccgtggggggtcccctgagactctcctgtacagtctctggattcaccgtctccacttttgccatggccttggggtccgccggggctcccgaggggaacgggccgtgggacggtgggtcctccactatcagtgacacgtggtaatggcatagcaagtggtacgcaggctcgtgggaggggcggttcaccattacgcagagacaattccaagaacacggtctatcaacaaatgaacagctgagacgccgaggacacggccctgtacttcgtgtgtacgagagtactacgtaaactttcccgttacgtacgttgtttacg

SEQ ID NO: 203062 - DNA, 628 bp, Homo sapiens
  misc_feature: GYAE6OF02G2959.18.36.D03.1.454.CMB.1.raw
  modified_base (187)..(187): a, c, t, g, unknown or other
  misc_feature (187)..(187): n is a, c, g, or t
  modified_base (190)..(190): a, c, t, g, unknown or other
  misc_feature (190)..(190): n is a, c, g, or t
  modified_base (213)..(213): a, c, t, g, unknown or other
  misc_feature (213)..(213): n is a, c, g, or t
  modified_base (621)..(621): a, c, t, g, unknown or other
  misc_feature (621)..(621): n is a, c, g, or t
tcagtacgagtatgcacgaccggtgctcgatttagctgcgtcacgatctctcttggggtctgagagaggagcccagccctgagattttcaggtgttttcacttggtgatcaggactggacagagagaactcaccatggagttttgggctggagcggtcgtcgtcttagtgtcgagttaagttaagtntanagtgtgagtgcagcgttgtaggngtcggtggggactcgttggacgcgtccggtcgggggtcctggactctcctccttgtacctgtctcgtggtacttccgacctcctcttctttcgacctagtcggcgtcggtccggccggctcggagggacggtcgtaggcggtcggttccacctactactcgtagtacgacctagtaggtaagtcggacgagtacgacgtaaggtacggtacgcgacggtccgtccgggtagggacggggtcgtaccacgtagtagacgagagaacttactaccgaaacgacgcgtactatactaaacaagtacaacgtcgactagacgacgacggacgaccgtacgtcccttagttacgtttcaggttgacgaaggtagttaacgtaaccgttaaaccttttccctaggttacgtttntttacgg

SEQ ID NO: 203063 - DNA, 547 bp, Homo sapiens
  misc_feature: GYAE6OF02FRD25.18.36.D03.1.454.CMB.1.raw
tcagtacgagtatgcacgaccggtgctcgatttagctgcgtcacgatctctcttgggattgtctctgctaatggtgaaccgcccctccacggagccttggtacagcctggggggtccctgagactctcctgtacagtctctggattcaccgtctccacttttgccatggcctgggtccgccgggctccagggaagggcctggagtgggtctccactatcagtgacactggtaatggcgatagcaagtggtacgcaggctccgtggaggggcggttcaccattagcagagacaattccaagaacacggtctatctacaaatgaacagcctgagagccgaggacacggccctgtatttctgtgtgagagatcgaaaattccctttcgatgttcttgatatgtgggcaagggacaatggtcaccgtcttcctcagcctccaccaacgggcccaagtccggtcctttcccctggccgccctgctccaggacgccaccgtcccgaggacgcaaccacgccggcccgtgggcctcggccctgggtcaaaccgg

SEQ ID NO: 203064 - DNA, 528 bp, Homo sapiens
  misc_feature: GYAE6OF02G4CZ5.18.36.D03.1.454.CMB.1.raw
  modified_base (277)..(277): a, c, t, g, unknown or other
  misc_feature (277)..(277): n is a, c, g, or t
tcagtacgagtatgcacgaccggtgctcgatttagctgcgtcacgatctctcttgggattgtctctgctaatggtgaaccgcccctccacggagccttggtacagcctggggggtccctgagactctcctgtacagtctctggattcaccgtctccacttttgccatggcctgggtccgccgggctccagggaagggcctgggagtgggtctccactatcagtgacactggtaatggcgatagcaagtggtacgcaggctccgtggaggggcggttnacccattagcagagacaattccaagaacacggtctatctacaaatgaacagcctgagagccgaggacacggccctgtatttctgtgtgagagatcgaaaattccctttacgatgttcttgatatgtggggcaagggacaatggtcaccgtctcctcagcctcaccagggcccatcggtcttcccctggccgccctgctccaggagcacctccgagacgcacacgcggccctgggcctggcctggtcaacgg

SEQ ID NO: 203065 - DNA, 578 bp, Homo sapiens
  misc_feature: GYAE6OF02H2OXA.18.36.D03.1.454.CMB.1.raw
  modified_base (222)..(222): a, c, t, g, unknown or other
  misc_feature (222)..(222): n is a, c, g, or t
  modified_base (258)..(258): a, c, t, g, unknown or other
  misc_feature (258)..(258): n is a, c, g, or t
  modified_base (367)..(367): a, c, t, g, unknown or other
  misc_feature (367)..(367): n is a, c, g, or t
  modified_base (459)..(459): a, c, t, g, unknown or other
  misc_feature (459)..(459): n is a, c, g, or t
  modified_base (497)..(497): a, c, t, g, unknown or other
  misc_feature (497)..(497): n is a, c, g, or t
  modified_base (503)..(503): a, c, t, g, unknown or other
  misc_feature (503)..(503): n is a, c, g, or t
  modified_base (539)..(539): a, c, t, g, unknown or other
  misc_feature (539)..(539): n is a, c, g, or t
tcagtacgagtatgcacgaccggtgctcgatttagctgcgtcacgagtctctcttgggattgtctctgctaatggtgaaccgcccctccacggagccttggtacagcctgggggtccctgagctctcctgtaacagtctctggattccaccgtctccacttttgccatggcctgggccgcgggctccgagggaaggccgtggagtgggtctccactatcagngacacgttgggaatcggcgatacgcaaggtggtacncaggctccgtgggagggcggttcaccgaattgcgagagtacaattccaaagaactaggtcaatcaacaaatgaacagtcagagtagcgaggacaggccctttagatttngtgtacgaggtacaagtactaaaattccctttagattgttcttgataatggtaccgggcgaaagggactaagtagggctaacgtctccgtanagccctaacactaaacgggcacgttccgtcgttccccnggcccncccgagtctacgacgtacgcctaccgacgaggccanaccgcgttcggccgtcggcctggtcctaggtacctaagg

SEQ ID NO: 203066 - DNA, 528 bp, Homo sapiens
  misc_feature: GYAE6OF02HOOOZ.18.36.D03.1.454.CMB.1.raw
tcagtacgagtatgcacgaccggtgctcgatttagctgcgtcacgatctctcttgggattgtctctgctaatggtgaaccgcccctccacggagccttggtacagcctggggggtccctgagactctcctgtacagtctctggattcaccgtctccacttttgccatggcctgggtccgccgggctccagggaagggcctggagtgggtctccactatcagtgacactggtaatggcgatagcaagtggtacgcaggctccgtggaggggcggttcaccattagcagagacaattccaagaacacggtctatctacaaatgaacagcctgagagccgaggacacggccctgtatttctgtgtgagagatcgaaaattccctttgatgttcttgatatgtggggccaagggacaatggtcaccgtctcctcacgcctccaccaacgggcccatccggtcttccccgtggccgccctgctccaggcgcacctccgagcgcacagcggccctgggcctgcctggtcaacgg

SEQ ID NO: 203067 - DNA, 529 bp, Homo sapiens
  misc_feature: GYAE6OF02FRVWW.18.36.D03.1.454.CMB.1.raw
  modified_base (468)..(468): a, c, t, g, unknown or other
  misc_feature (468)..(468): n is a, c, g, or t
tcagtacgagtatgcacgaccggtgctcgatttagctgcgtcacgatctctcttgggattgtctctgctaatggtgaaccgcccctccacggagccttggtacagcctgggggtccctgagactctcctgtacagtctctggattcaccgtctccacttttgccatggcctgggtccgccgggctccagggaagggcctggagtgggtctccactatcagtgacactggtaatggcgatagcaagtggtacgcaggctccgtggaggggcggttcaccattagcagagacaattccaagaacacggtctatctacaaatgaacagcctgagagccgaggacacggccctgtatttctgtgtgagagatcgaaaattccctttcgatgttcttgatatgtggggccaagggacaatggtcaccgtctcctcagcctccaccaagggcccatcggtcttccccctggccnccctgctccaggagccacctccgagagccacagccggccctgggcctggcctggtcaacgg

SEQ ID NO: 203068 - DNA, 679 bp, Homo sapiens
  misc_feature: GYAE6OF02HDLO5.18.36.D03.1.454.CMB.1.raw
  modified_base (264)..(264): a, c, t, g, unknown or other
  misc_feature (264)..(264): n is a, c, g, or t
tcagtacgagtatgcacgaccggtgctcgatttagctgcgtcacgatctctcttggggtctgagagaggagcccagccctgagattttcaggtgttttcacttggtgatcaggactggacagagagaactcaccatggagtttgggctgagcgtggctctttcttgtggcgtatttaaaggtgtcaagtgtgaggtgcagctggttggagtcgtgggggagccttggtacaggccgtggggggtccctgagactctcctgtacngtctctggattcaccgtctcctactttgccatcggcctcgggtccgccgggctccggagggaacggccgtggacgtgggtcctccgactactcagtcgaaccgtacgttgggtaaattcgggacgtaagtacgacgtaaggtcgggtacgcgaggtccgtccggtggggacgggtcggttaccaccgtagttacgcgaaggacgaacgtaacttaccgaaagtaaccgtaccggttacttaacgtacctaaacgtaaactacgaaaccgtacgaccgtagacggtaccgaccggaaacggtacccgacccggtacccgttaggtttaccgtttcgtaggtacggttacgaacggtaggtaaccttaaccgggtaaaaccttttccccggtttaaggtacgtttacgtttaaccgg

SEQ ID NO: 203069 - DNA, 557 bp, Homo sapiens
  misc_feature: GYAE6OF02HAG8Y.18.36.D03.1.454.CMB.1.raw
  modified_base (364)..(364): a, c, t, g, unknown or other
  misc_feature (364)..(364): n is a, c, g, or t
tcagtacgagtatgcacgaccggtgctcgatttagctgcgtcacgatctctcttgggattgtctctgctaatggtgaaccgcccctccacggagccttggtacagcctggggggtccctgagactctcctgtacagtctctggattcaccgtctccacttttgccatggcctgggtccgccgggctccagggaaggcctggagtgggtctccactatcagtgacactggtaatggcgatagcaagtggtacgcaggctccgtggaggggcggttcaccattagcagagacaattccaagaacacggtctatctacaaatgaacagcctgagagcgaggacacggcctgtatttctgtgtgaganatacgaaattccctttgattgttcttgatatggtgggacgaagggacaagtggtcaccgtctcctcacgcctccaccgaacggcccagttccggtcccttccccgtaggtccgccctgccctaccgagggacgccacccgtacgacgcgaccacgacggccgcccgtcgggcctcgccgttggtacgtaacgg

SEQ ID NO: 203070 - DNA, 662 bp, Homo sapiens
  misc_feature: GYAE6OF02I2XIL.18.36.D03.1.454.CMB.1.raw
tcagtacgagtatgcacgaccggtgctcgatttagctgcgtcacgatctctcttgggattgtctctgctaatggtgaaccgcccctccacggagccttggtacagcctggggggtccctgagactctcctgtacagtctctggattcaccgtctccacttttgccatggcctgggtccgccgggctccagggaagggcctggagtgggtctccactatccagtgacacgtggtaatggcgatacgcaaggtggtacgcgaggcctccggtgggaggggtcggttcaccattagcagagacaattccaaagaacacggtctatctaacaatgaacagcctagagacgcgagacgaccgcctgtactttctgtgtgagagtatacgtaaaactttccctttacgatttgttctttgtattatgggtacggggaccgaaagggactaaagttcgggtaccacccgttccttcctacgaccgtcccttaccccaaccggtaaccgggacccctaacgttcccggttaccccgtttcccccgtcgggccccgtcccgtcggtcccttaccgacggacgtccacccgttaccggaggacgtccgaaacgccgggcccggacccggtcggggtaccgtccggtcccggttacgggtacgtaaacccggg

SEQ ID NO: 203071 - DNA, 589 bp, Homo sapiens
  misc_feature: GYAE6OF02HY7UH.18.36.D03.1.454.CMB.1.raw
  modified_base (477)..(477): a, c, t, g, unknown or other
  misc_feature (477)..(477): n is a, c, g, or t
tcagtacgagtatgcacgaccggtgctcgatttagctgcgtcacgatctctcttgggattgtctctgctaatggtgaaccgcccctccacggagccttggtacagcctggggggtccctgagactctcctgtacagtctctggattcaccgtctccacttttgccatggcctgggtccgccgggctccgagggaagggcctggagtgggttggccgtattagaagcaaagctaacagttacgcgacagcatatgctgcgtcggtgaaaggcaggttcaccgtctccagaaatgattcaaagaacacggcgtatctgcaaatgaacagcctagaaaaccgaggacacggccgtgtattactgtactagactaggtgaattacagtttgggggatttagtcggacgaaacgggggggtactacgtacgctagtggacgtcgtgggaccgaagggaccacggtcaccgtctcctcagccnccaccaacggcccactccggtccttcccctcggccaccctcctaccacgacgccgaccgtccgtcggggacctacgacgccgggcccgtcgggacctcggcccgtggtaccg

SEQ ID NO: 203072 - DNA, 688 bp, Homo sapiens
  misc_feature: GYAE6OF02IO3JN.18.36.D03.1.454.CMB.1.raw
  modified_base (213)..(213): a, c, t, g, unknown or other
  misc_feature (213)..(213): n is a, c, g, or t
tcagtacgagtatgcacgaccggtgctcgatttagctgcgtcacgatctctcttggggtctgagagaggagcccagccctgagattttcaggtgttttcacttggtgatcaggactggacagagagaactcaccatggagtttgggctgagcggtgtcgtcttagtcgtgacgtaagtttaaagtgtcaagtgtgagtgcagctgttggagtntgggggagccgttggtacagccgtggggggtccctgagactctcctgtacagtctctggattcaccgtctccacttttgcctatggcctgggtccgccgggctccgagggaggcctggagtgggtctcgactatcagtgacactgaatggcgatagcaaggtgtacgcgaggtctaccggtgggaacggggtccgggtttacaacccgtagtttacgaccggtaaggaacggtaacaaacggtttaccccaaaagggaaacccgtaaccgggttacttaacgtaccttaaacaaaacgttacgaaaccgtaacgtcccgtaaggtaccgggaaacggaccggaacgggaaccgtaacccggggcccctttagggtttaaccgtttttcggtacggttgggttaaccggaaggtaacgtacgttaaccgggttaaaaaccttttcccccgttttagtaacggtttcgtttaaccgg

SEQ ID NO: 203073 - DNA, 537 bp, Homo sapiens
  misc_feature: GYAE6OF02FK1Q8.18.36.D03.1.454.CMB.1.raw
tcagtacgagtatgcacgaccggtgctcgatttagctgcgtcacgatctctcttgggattgtctctgctaatggtgaaccgcccctccacggagccttggtacagcctgggggtccctgagactctcctgtacagtctctggattcaccgtctccacttttgccatggcctgggtccgccgggctccagggaagggccctggagtgggtctccactatcagtgacactggtaatggcgatagcaagtggtacgcaggctccgtggagggcggttcaccattagcagagacaattccaagaacacggtctatctacaatgaacagcctgagagccgaggacacggccctgtatttctgtgtgagagatcgaaacttcccttcgatgtctgatatgtgggcaagggcaatggtcaccgtctcctcagccctcacccagggcccatccggtcttcccaccgttggccgccctgcctccgacggacgccacccgccggagacgccacgacggccggcccgtgggcctcggccctggtaccg

SEQ ID NO: 203074 - DNA, 651 bp, Homo sapiens
  misc_feature: GYAE6OF02J07R3.18.36.D03.1.454.CMB.1.raw
  modified_base (283)..(283): a, c, t, g, unknown or other
  misc_feature (283)..(283): n is a, c, g, or t
  modified_base (291)..(291): a, c, t, g, unknown or other
  misc_feature (291)..(291): n is a, c, g, or t
tcagtacgagtatgcacgaccggtgctcgatttagctgcgtcacgatctctcttgggtctgagagaggagcccagccctcgagattttcaggtgttttcacttggtgatcaggactggacagagagaactcaccatggagtttgggctgagcgtggcgtcttcgttgtggcgtatttaaaaggtgtcaagtgtgaggtgcagctgttggagtcgtgggggagccgttggtacaggccgttggggggtcccctgaggactcgtcctgtacagtctctggattcnccgtctcncttttgccatggctgggtccgccggctccgagggacggccttcggagtcgggtcctcgactatcagtgaccagtggtaatgggctagtacgacgaaggtcggtaacgcgaggtccgtccggtgggacggggccggtttccaaccgtagttaacgcgagacggaactaagttacccgaagaaacaccggttactacgtaccttaaacgaaagtacgaaacctacggcctaggaaacgtacggaccggtaaccgggaaccgacccgggtacccgttacgttacgttttcgtacgttagggtcgtaacggagggtactttaaccggaaacgttttcccctttaacggtacgtttaccgtttag

SEQ ID NO: 203075 - DNA, 586 bp, Homo sapiens
  misc_feature: GYAE6OF02GDCJP.18.36.D03.1.454.CMB.1.raw
  modified_base (219)..(219): a, c, t, g, unknown or other
  misc_feature (219)..(219): n is a, c, g, or t
  modified_base (396)..(396): a, c, t, g, unknown or other
  misc_feature (396)..(396): n is a, c, g, or t
tcagtacgagtatgcacgaccggtgctcgatttagctgcgtcacgatctctcttggggtctgagagaggagcccagccctgagattttcaggtgttttcacttggtgatcaggactggacagagagaactcaccatggagtttgggctgagctggctctttcttttggcgattttaaaaggtgtcaagtgtgaggtgcagctgttggagtctggggganccttggtacagccgtggggggtccctgagactctcctgtacagtctctggattcaccgtctccacttttgccatcggcctggggtccgccgggctccgaggggacggcctgggagtgggtcctccactatcagtgacacgtggtaatggcgatagcaagtggtacgcgaggctcggnggaggggcgttcaccgtatagcagagacatccaagacacgtctatctaacaaatgaacagtaccgtagacgacgacccggaggaacccgaccggcccgttagttacgttttcgtggttgtagggaacgtacggtaagttaaccggtaaaacttttccccgtttacggtaacttttcggttacctttaagg

SEQ ID NO: 203076 - DNA, 582 bp, Homo sapiens
  misc_feature: GYAE6OF02H43YL.18.36.D03.1.454.CMB.1.raw
  modified_base (355)..(355): a, c, t, g, unknown or other
  misc_feature (355)..(355): n is a, c, g, or t
tcagtacgagtatgcacgaccggtgctcgatttagctgcgtcacgatctctcttgggattgtctctgctaatggtgaaccgcccctccacggagccttggtacagcctggggggtccctgagactctcctgtacagtctctggattcaccgtctccacttttgccatggcctgggtccgccgggctccagggaggcctggagtgggtctccactatcagtgacactggtaatggcgatagcaagtggtacgcaggctccgtggaggggcggttcaccattagcagagacaattccaagaacacggtctatctacaaatgaacagcctgagagccgaggacacggcctgtatttcngtgtgagagatacgaaaattccctttagattgtttctttagattagtggtcggggcaagggacaagtggtcaccgtctcctcacgcctccaccgaacgggcccacgtccggttccttcccccgtggccgtcccgtcgcctacccgacggacgccacccgtccgaacggcgaccaaccgacggaccggcccgtcggggccttcggcccgttgggtaccgtaaaccggg

SEQ ID NO: 203077 - DNA, 565 bp, Homo sapiens
  misc_feature: GYAE6OF02HHEGT.18.36.D03.1.454.CMB.1.raw
tcagtacgagtatgcacgaccggtgctcgatttagctgcgtcacgatctctcttgggattgtctctgctaatggtgaaccgcccctccacggagccttggtacagcctggggggtccctgagactctcctgtacagtctctggattcaccgtctccacttttgccatggcctgggtccaccgggctccagggaagggcctggagtgggtctccactatcagtgacactggtaatggcgatagcaagtcggtacgcaggctccgtggaggggcggttcaccattagcagagacaattccaagaacacggtctatctacaaatgaacagcctgagagccgaggacacggccctgtatttctgtgtgagagatacgaaaattcccttagattgttcttgatatgtgggaccaagggacaagtggtcaccgtctcctcacgtcctccaccacggcccagtaccggtccttcccccgtggcccgcccgtcgcctccgacgggacgcgacctcccggaagacgccaccgacggccggcccgtcgggccgtcggccgtcggtactaaccggg

SEQ ID NO: 203078 - DNA, 611 bp, Homo sapiens
  misc_feature: GYAE6OF02FZZKL.18.36.D03.1.454.CMB.1.raw
  modified_base (220)..(220): a, c, t, g, unknown or other
  misc_feature (220)..(220): n is a, c, g, or t
  modified_base (512)..(512): a, c, t, g, unknown or other
  misc_feature (512)..(512): n is a, c, g, or t
  modified_base (608)..(608): a, c, t, g, unknown or other
  misc_feature (608)..(608): n is a, c, g, or t
tcagtacgagtatgcacgaccggtgctcgatttagctgcgtcacgatctctcttggggtctgagagaggagcccagccctgagattttcaggtgttttcacttggtgatcaggactggacagagagaactcaccatggagttgggctgagctggctctttctttggcgtattttaaaggtgtcaagtgtgaggtgcagctggttggagtcgtgggggganccttgggtacaggccgtggggggtccctgagtactctcctgtacagtctctggattcaccgtctcctactttgccagtcggccgtcgggtccgccgggccgtccgaggggaacgggtccgtagggaggtcgggtccgtaccgtacgtaactcgagtacgactacgtaggtaatgggtcgaagtacgacgaaggtcggtacgcgacggtcgtcgggtgggacggggtcggttaccacgtagttacgacgagagactaacttacgaaacgacgtacggtaccttaagtactaanaagtacgaacagtacctagacgagaccgaggaccgacgtccctgtactttcgtgtgtagtagagtagtacgtaacttcccgttagtacgttcgttntag

SEQ ID NO: 203079 - DNA, 590 bp, Homo sapiens
  misc_feature: GYAE6OF02F4T70.18.36.D03.1.454.CMB.1.raw
  modified_base (356)..(356): a, c, t, g, unknown or other
  misc_feature (356)..(356): n is a, c, g, or t
tcagtacgagtatgcacgaccggtgctcgatttagctgcgtcacgatctctcttgggattgtctctgctaatggtgaaccgcccctccacggagccttggtacagcctggggggtccctgagactctcctgtacagtctctggattcaccgtctccacttttgccatggcctgggtccgccgggctccagggaaggcctggagtgggtctcactatcagtgacactggtaatggcgatagcaagtggtacgcaggctccgtggaggggcggttcaccattagcagagacaattccaagaacacggtctatctacaaatgaacagcctgagagccgagacaccggccctgtatttcngtgtgagagatacgaaaatttcccttacgactgtttcttgtactagtggttcggggcaagggacaagtggtccaccgtctctcagccctcaccacggcccatacccggtccttcccccgtggtcccgtccccgtagccttaccgaggaccgtacgacccgtccggaacgacgccaaccgacggcccggtaccccggtcggggtaccctgggcccgttggtaccgtaaacccggg

SEQ ID NO: 203080 - DNA, 536 bp, Homo sapiens
  misc_feature: GYAE6OF02HQ9F9.18.36.D03.1.454.CMB.1.raw
  modified_base (360)..(360): a, c, t, g, unknown or other
  misc_feature (360)..(360): n is a, c, g, or t
  modified_base (390)..(390): a, c, t, g, unknown or other
  misc_feature (390)..(390): n is a, c, g, or t
  modified_base (398)..(398): a, c, t, g, unknown or other
  misc_feature (398)..(398): n is a, c, g, or t
  modified_base (401)..(401): a, c, t, g, unknown or other
  misc_feature (401)..(401): n is a, c, g, or t
tcagtacgagtatgcacgaccggtgctcgatttagctgcgtcacgatctctcttggggtctgagagaggagcccagccctgagattttcaggtgttttcacttggtgatcaggactggacagagagaactcaccatggagtttgggctgagctggctctttcttgtggcgaattttaaaaggtgtcaagtgtgaggtgcagctgttggagtcgtgggggagccttggtacaggccgtggggggtccctggacgacctctcctgtacagtctctggattcaccgtctccacttttgcccatcggcctgggtccgccgggctccgagggaacgggcctgggagtgggtctccactatcagtnacactggtaatggcgatagcaagtgtacgnaggctcgnggngggcgttcacattagcagagacaattaccaagaacacggtctatactaacaaatagaacacgcctagagacgacgacgacgaccgcctgtacttctgtgtgagagactacgtaaacttcccttacgtatgttacg

SEQ ID NO: 203081 - DNA, 701 bp, Homo sapiens
  misc_feature: GYAE6OF02JEJX3.18.36.D03.1.454.CMB.1.raw
  modified_base (356)..(356): a, c, t, g, unknown or other
  misc_feature (356)..(356): n is a, c, g, or t
tcagtacgagtatgcacgaccggtgctcgatttagctgcgtcacgatctctcttgggattgtctctgctaatggtgaaccgcccctccacggagccttggtacagcctggggggtccctgagactctcctgtacagtctctggattcaccgtctccacttttgccatggcctggtccgccgggctccagggaaggcctggagtggtctccactatcagtgacactggtaatggcgatagcaagtggtacgcaggctccggtggaggggcggttcaccattagcagagacaattccaaagaacgacggtctatactacaaatacgaacagcctgagagccgaggacacgccctagtntttactggtgtagagagtatacgtaaaacttccctttacgtattgtttacttacgtattagtggttcggggtaccgaagggtactaaagtcggttaccgtacccggttaccttccgtaccgtacgtaccccgtacccgaacccgtaaccgggtaccccgtaacgttcccgggttccccgtttaccccccgttccggtaccccgtcccgttccgcccgttacccgacggggaccgtcccgaaccccggttaccggaaccggtaccggacccgtaaccggaaccgcccgggttcccccgggtacgggtccccggttcgtacccggttcgggtacccgtaaacccggg

SEQ ID NO: 203082 - DNA, 683 bp, Homo sapiens
  misc_feature: GYAE6OF02JK77U.18.36.D03.1.454.CMB.1.raw
  modified_base (287)..(287): a, c, t, g, unknown or other
  misc_feature (287)..(287): n is a, c, g, or t
  modified_base (306)..(306): a, c, t, g, unknown or other
  misc_feature (306)..(306): n is a, c, g, or t
  modified_base (331)..(331): a, c, t, g, unknown or other
  misc_feature (331)..(331): n is a, c, g, or t
  modified_base (349)..(349): a, c, t, g, unknown or other
  misc_feature (349)..(349): n is a, c, g, or t
  modified_base (362)..(362): a, c, t, g, unknown or other
  misc_feature (362)..(362): n is a, c, g, or t
  modified_base (374)..(374): a, c, t, g, unknown or other
  misc_feature (374)..(374): n is a, c, g, or t
tcagtacgagtatgcacgaccggtgctcgatttagctgcgtcacgatctctcttgggattgtctctgctaatggtgaaccgcccctccacggagccttggtacagccgtggggggtccctgagactctcctgtgcaggccctgcattcatctttaatagttattggatgcactgggtccgccaggctccgggggaaggggccggagtgggtgccaacataatgcaagatggaactgaagaagaactatggtggactctggtgaaggggccattcaccatcctcaganacaacactaagaacttacngtatctagacaaatgaacagcctanagacgccgagaccacggntagtgtaattacngtcgacgaaagngacagggtcggctagggactagtcggacgtcggtcggggaccaacgggaccacgggtccacccgtcctcctaccgacgccctacccgaaccgaacgggcccctacggttcccgggttaccccttcccccggtcgggtccccgtccccgttacgtcccgttacccggaacgggtacccgacccgtacccgttacccgggaaacggtacccggacctaacccgggaccggtacccccggggtccccggttaccgggggtcccttcccggggtaccccggtttccggggtaaccgaacccgggttaaccccg

SEQ ID NO: 203083 - DNA, 578 bp, Homo sapiens
  misc_feature: GYAE6OF02GKT9C.18.36.D03.1.454.CMB.1.raw
  modified_base (362)..(362): a, c, t, g, unknown or other
  misc_feature (362)..(362): n is a, c, g, or t
tcagtacgagtatgcacgaccggtgctcgatttagctgcgtcacgatctctcttgggattgtctctgctaatggtgaaccgcccctccacggagccttggtacagcctggggggtccctgagactctcctgtgcaggccctgcattcatctttaatagttattggatgcactgggtccgccaggctccgggggaaggggccggagtgggtggccaacataatgcaagatggaactgagaagaactatgtgactctgtgaaggctgattcacatctcagagacaacactaagaacttactgtatctgacaaatgaacagcctcagacgccgaggacacgggctgtgtattactgtgacgaagngcaggtggctgggacagtggacgtcgtcggggaccaacgggaccacgggtcacccggtcctcccgtcgacgccctacccgaccgaacgggcccacgttccggttcccttcccccgtcggcccgtcccgttcgcctaccgacggacgccgacccgtccggaacggacgccaacgacggccggcccgtcgggcctcggcccgttggtaccgtaaccgg

SEQ ID NO: 203084 - DNA, 776 bp, Homo sapiens
  misc_feature: GYAE6OF02JBJGA.18.36.D03.1.454.CMB.1.raw
tcagtacgagtatgcacgaccggtgctcgatttagctgcgtcacgatctctcttgggattgtctctgctaatggtgaaccgcccctccacggagccttggtacagcctgggggtccctgagactctcctgtgcaggccctgcattcatctttaatagttattggatgcacgtgggtccgccagggccgtccgggggaaggggccggagtgggtggccaacataagtgcaagatggaactgaagaagaactatgtcggactcgtggtcggaagggcccgtattccgaacccattcctccgaagagaccaacacttaagtaacctttacgtgttaactcgtacgaacaaattcggaaacacggcccctagacggacggtacccgaagggacctacccgggcttgggttacttacgttacctggttacgggaccgtaaaggcgtcgaaagggttcgggaccgtttagggggaaaccgacgttacggtaaccggtcggtacgggggacccgtaaacgggacccgtaacgggtaccgtacccgtccgttacccgttacgaccggtcccgtaacccgaaccggaaacccgggccctaaccgttcccgggttacccgtttccccccggtcgggtccccgtacccggttcgtccgtcccggtaacgggtaccgaccgtacccttacccggacggtaaccggaccgaaccgaccgggttacccggcccggttacggggtccggtaccggttcccggtacgggttacccggaaccgggttaacccg

SEQ ID NO: 203085 - DNA, 776 bp, Homo sapiens
  misc_feature: GYAE6OF02HTNY1.18.36.D03.1.454.CMB.1.raw
tcagtacgagtatgcacgaccggtgctcgatttagctgcgtcacgatctctcttggggtctgagagaggagcccagccctgagattttcaggtgttttcacttggtgatcaggactggacagagagaactcaccatggagttttgggctgagctggctcttttcttgtggtcgtattttaaaggtgtcaagtgtgaggtgcagctgttggagtcgtgggggatccgttggtacgaggcccggttcggggggtccctggacgtcctcttccgtgtaccagttctcgtggtacttccaccgttctcctacttttgccctagtcggccgtcggggtcccggccgggcctccggagggacggccgtgggaggttcgggtcctccgtaacttactcgagtcgacctacgttaggtaagtcgggacgtaagttacgacgaagggttacgggtaccgacgtaaccgggtccggttaccggggtaggggtaacggggggtcccggtttacgacccgttaggttaacggacctaagggaacgtaaacctaaccgttaacccgaaacgtaaacgtaccggttaactaacttaacctaaacaaacgttaacgaaacctaacggtccgtaaggaacgtaaccgggaacccggtaacgggaacccgtaacccgggtcccgttaacggtttaccgttttacgtacgggttaggttacggaacggttaagttaaccgttaaccggttaaaaccgtttttcccccggtttaagttacggtttagttttaccg

SEQ ID NO: 203086 - DNA, 638 bp, Homo sapiens
  misc_feature: GYAE6OF02J0ID1.18.36.D03.1.454.CMB.1.raw
  modified_base (359)..(359): a, c, t, g, unknown or other
  misc_feature (359)..(359): n is a, c, g, or t
  modified_base (370)..(370): a, c, t, g, unknown or other
  misc_feature (370)..(370): n is a, c, g, or t
tcagtacgagtatgcacgaccggtgctcgatttagctgcgtcacgatctctcttgggattgtctctgctaatggtgaaccgcccctccacggagccttggtacagccgtggggggtccctgagactctcctgtacagtctctggattcaccgtctccacttttgccatggcctgggtccgccgggctccagggaaggcctggagtgggtctccactatcagtgacactggtaatggcgatagcaagtggtacgcaggctccgtggagggtcggttcacctatagcagagacaatccaagaacacggtctatactacaaatgaacagcctagagagccgagacgacgcctgtactttcgngtagtgaacgngtaatacgtaaaactttccccgttagatttcggttactagtactagtggtacggggaccaaggactaagtggtaccaccgtctaccgtcgacggtccctacgtaaccgaacgggtaccctacgttacccggtcccttaccccgtcggtacccgtcccgtccggtcctacccggaggtacccgccaacccgtccggaacggaccgccgaaccgtaccggcccggtacccggtgggccgttccggccggttaccggaccggtaaacccgg

SEQ ID NO: 203087 - DNA, 746 bp, Homo sapiens
  misc_feature: GYAE6OF02H3LWZ.18.36.D03.1.454.CMB.1.raw
tcagtacgagtatgcacgaccggtgctcgatttagctgcgtcacgatctctcttggggtctgagagaggagcccagccctgagattttcaggttgttttcacttggtgatcaggactggacagagagaactcaccatggagtttgggctgagcgtggcttctttacgttgtggcgtaattttaaaggtgtacaagtgtgaggtgcagcgtggttggaggtcgtggggggacgtccgttggtacgaggtccggtcggggggtccctggacgactctcctgtacagtctcgtggacttcaccgtctcctacttttcgcctagtcggtccgtcggggtcccgccgggtccgtaccggaggggacgggtccgtgggacggttcgggtacctccgacttataccgacgtcgaactacggttaggtaagtcgggacgtaatacggacgtaaagggttcggtaacggcgtaacgggtccgtaccgggtggggtaacgggggtccgtttaccgaaccgtacgttaacggacgtaggaacggtaactaaacgttaacccgaaagtaaccgtaccgggttaactactaaccgttaacaaacgtacgtaaacgacgtacgtaacggaacgacggtacccggaacggaaccgtacccggtacccgttagttacgtttccgtaggtttcgtaagggtaacgaaggttacgttaaccgtaaaacccgttttcccgttaacgttacgttacgttttaacgg

SEQ ID NO: 203088 - DNA, 565 bp, Homo sapiens
  misc_feature: GYAE6OF02FW8ZK.18.36.D03.1.454.CMB.1.raw
  modified_base (329)..(329): a, c, t, g, unknown or other
  misc_feature (329)..(329): n is a, c, g, or t
  modified_base (396)..(396): a, c, t, g, unknown or other
  misc_feature (396)..(396): n is a, c, g, or t
tcagtacgagtatgcacgaccggtgctcgatttagctgcgtcacgatctctcttgggattgtctctgctaatggtgaaccgcccctccacggagccttggtacagcctggggggtccctgagactctcctgtgcaggccctgcattcatctttaatagttattggatgcactgggtccgccaggctccggggaaggggccggagtgggtggccaacataatgcaagatggaactgagaagaactatgtggactctgtgaagggccgattcaccatctaccagagaacaacactaagaacttactgtatctgacaaaatgaaacagcctnagagccgaaggacacggcttggtgtaattactgtgacgaaagagcagtggctgggacatggacgtgnggggccaagggaccacggtcaaccgtctcctcacgcctccaaccaacggacccagtccgtccttaccccgtggccgtcccgtcgcctccgaggacgacctaccgtaccgacggacgaccgaacgacggccggacccgtcgggcctcggacctcgggtacaaggtaaccc

SEQ ID NO: 203089 - DNA, 616 bp, Homo sapiens
  misc_feature: GYAE6OF02GD48B.18.36.D03.1.454.CMB.1.raw
  modified_base (399)..(399): a, c, t, g, unknown or other
  misc_feature (399)..(399): n is a, c, g, or t
tcagtacgagtatgcacgaccggtgctcgatttagctgcgtcacgatctctcttgggattgtctctgctaatggtgaaccgcccctccacggagccttggtacagcctggggggtccctgagactctcctgtacagtctctggattcaccgtctccacttttgccatggcctgggtcctccgggctccgagggaagggcctggagtgggtctccactatcagtgacactggtaatggcgatagcaagtggtacgcaggctccgtgggaggggcggttcaccattagcagagacaattaccaaagaacacggtctatcctaacaaatgaacacgcctagagagccgaggacaccggccctgtactttctgttgtgagagactacgtaaacttccctttanagttcgttcttgtatagtggtggggacgaaagggtacaagtcggtacctaccggtcctcctcacgtccctaccacccgaacgggccctaacgtcccggttacccttcccccgtcggcccgtcccgtgccctccgacggcgaccacccgtccggaacggacgaccgtaacgaccggcccggcccgtcgggtcctcggtacccgtcggtacctaaccgg

SEQ ID NO: 203090 - DNA, 766 bp, Homo sapiens
  misc_feature: GYAE6OF02ITBF5.18.36.D03.1.454.CMB.1.raw
tcagtacgagtatgcacgaccggtgctcgatttagctgcgtcacgatctctcttggggtctgagagaggagcccagccctgagattttcaggtgttttcacttggtgatcaggactggacagagagaactcaccatggagtttgggctgagctggctctttcttgtggcgtaattttaaaaggtgtcaagtgtgaggtgcagcgtgttggagtcgtgggggacgtccgttggtacaggccgtggggggtccctggacgactctcctgtacagtctctggatcaccgtctcctactttgccatcggccgtcgggtccgccgggctccgaggggaacggccgtgggacggtcgggtctccacgtatcgagtcgacacgtaggtaatggacgatacggactaaaggtcggtacgcgacgggtccgtaccgggtggggaacgggggtccgggtttaccgaacccgtaagtttacggaccgaaggtaacgtaaaccgtaaacgttaacccaaaacggtaaacccggtaacccgggtttaacctaaagttaaccccttaaaacgtaaaaacgttaaccggaaaacgtaacccggtaaccgttaacgggaacggaaccgggtaccggaaacgggtaacccgaccccgggttaccccgtttagggtttaaccgttttacccgttggggttaacggtacggttaacggaaagttaacgttaacccggttaaaaaccttttcccccggttttaaggtaacgttttcggtttaaccg

SEQ ID NO: 203091 - DNA, 124 bp, Homo sapiens
  misc_feature: GYAE6OF02HT6U4.18.36.D03.1.454.CMB.1.raw
  modified_base (120)..(124): a, c, t, g, unknown or other
  misc_feature (120)..(124): n is a, c, g, or t
tcagtacgagtatgcacgaccggtgctcgatttagctgcgtcacgatctctcttgggattgtctctgctaatggtgaacccgcccctccacggagccttggtacagcctgggggtccctnnnnn

SEQ ID NO: 203092 - DNA, 780 bp, Homo sapiens
  misc_feature: GYAE6OF02HGO6C.18.36.D03.1.454.CMB.1.raw
tcagtacgagtatgcacgaccggtgctcgatttagctgcgtcacgatctctcttgggtctgagagaggagcccagccctgagattttcaggtgttttcacttggtgatcaggactggacagagagaactcaccatggagtttgggctgagcgtggctctttcgttgtggcgtaagttttaaaaggtgtacaagtgtgaggtgcagctgttggagtcgtgggggacgtccgttggtacaggtccggtcggggggtccctgacgtacctcgtcctgtacgacgtccttctggtacttctacgtttcgaaggtaacggccgtaggtatacggaaccgtcgggtcccgaccgacggccgtaccggaagggggacggggcgtgggtaggttcggggttacggtaccgttaaacttaaaaaccgaaaacgttggaacggttagggtacggaacaaacgacgtaacgtaaccggtctaccggacccgtaacccggtaggaaacggcgtaacggtaactttaccgaaccctactacccgtaacgaaaggtacgtagtaacgtaaacttaaacgaaaaaacgtccaacggttacttacgtacttaccgtaacgaaaccgtaaagtacgaaaccgacgtaccgtaacggaaaccggaaacccggaaggtaacccgacggaccgttacggttaacgttaacggttaaccttaccggtaaccctaaccgttaccccgttaacccgtaacggaaccgttaccccgtaaccttaacccttaaccgttaaacccg

SEQ ID NO: 203093 - DNA, 571 bp, Homo sapiens
  misc_feature: GYAE6OF02FJUDF.18.36.D03.1.454.CMB.1.raw
  modified_base (263)..(263): a, c, t, g, unknown or other
  misc_feature (263)..(263): n is a, c, g, or t
tcagtacgagtatgcacgaccggtgctcgatttagctgcgtcacgatctctcttgggattgtctctgctaatggtgaaccgcccctccacggagccttggtacagcctggggggtccctgagactctcctgtacagtctctggattcaccgtctccacttttgccatggcctgggtccgccgggctccagggaagggcctggagtgggtctccactatcagtgacactggtaatggcgatagcaagtggtacgcaggctccgnggaggggcggttcaccattagcagagacaattccaagaacacggtctatctaacaaatgaacagcctgagagccgaggacacggccctgtactttctgtgtgagagatacgtaaaattcccttcgatgttcttgtatatgtgggccgaagggactaagtggtcaccgttctcctcacgcctccaccgacgggcccagtccggttcccttcccctggcccgtcccgtcgcctccgagacgcacccgtccggacgacgcctaacgacgccggcccgtcgggcctcggtcccgttcggtaccgtaaccggg

SEQ ID NO: 203094 - DNA, 734 bp, Homo sapiens
  misc_feature: GYAE6OF02F40H7.18.36.D03.1.454.CMB.1.raw
tcagtacgagtatgcacgaccggtgctcgatttagctgcgtcacgatctctcttgggattgtctctgctaatggtgaaccgcccctccacggagccttggtacagcctggggggtccctgagactctcctgtacagtctctggattcaccgtctccacttttgccatggcctgggtccgccgggctccagggaagggcctggagtgggtctccactatcagtgacactggtaatggcgatagcaagtggtacgcaggctccgtggaggggcggttcaccattagcagagacaattccaagaacacggtctatctacaaatgaaacagcctgagagccgaggacaccggccctggtatttctgtgtgagagatacgtaaaactttccctttacgactttgttcgttagtaattagttgggttacgggggtaccaaacggggaactaagttacgggtaccgtaacccgttccttcccgttaccacggtccccttaacccgaaccccggtaaacgggggtcccccctaacggttccccgggtttccccgtttcccccccggttccgggtcccccggtcccccgttccggttaccccttccccgtaacggggaccgtacccgtaccccggttacccggaacgggaccggaacccgtaacccgaaccggggccccgggtcccggttccgggggtcccgttaccggtcccccggttacggggtacccggtaaaccccggg

SEQ ID NO: 203095 - DNA, 619 bp, Homo sapiens
  misc_feature: GYAE6OF02HDMYB.18.36.D03.1.454.CMB.1.raw
  modified_base (505)..(505): a, c, t, g, unknown or other
  misc_feature (505)..(505): n is a, c, g, or t
tcagtacgagtatgcacgaccggtgctcgatttagctgcgtcacgatctctcttgggttgtctctgctaatggtgaaccgcccctccacggagccttggtacagcctggggggtccctgagactctcctgtacagtctctggattcaccgtctccacttttgccatggcctgggtccgccgggctccaggggaacgggcccggagtgggtctccactatcagtgacactggtaatggcgatagcaagtggtacgcaggctccggtggaggggcgttcacctattagcagagacaattccaagacacggtctatctacaaatgaacagcctgagagccgaggacacggcctgtactttctgtgtgagagatacgtaaactttcccctttagattgtttcttgattagtgggtcggggaccgaaagggtactaagttggtacctaccgttctcctcacgtcctacccaaccgaacggccctagtccgttcccttccccgtcggcccncccgtcgtcctacccgaggaccgccgtacccgtccgacgacggccaccgaccgggccggtccccggtgggtcccgtcggcccgttacgggtaccggtacggtacccttaacccg

SEQ ID NO: 203096 - DNA, 645 bp, Homo sapiens
  misc_feature: GYAE6OF02IIEQ1.18.36.D03.1.454.CMB.1.raw
  modified_base (370)..(370): a, c, t, g, unknown or other
  misc_feature (370)..(370): n is a, c, g, or t
tcagtacgagtatgcacgaccggtgctcgatttagctgcgtcacgatctctcttgggattgtctctgctaatggtgaaccgcccctccacggagccttggtacagcctggggggtccctgagactctcctgtacagtctctggattcaccgtctccacttttgccatggcctgggtccgccgggctccgagggaagggcctgggagtgggtctccactatcagtgacacgtggtaatggcgatagcaaggtggtacgcaggctccggtgggaggggcggttcaccgattagcagaggacaattccaaagaacacggtctatactaacaaatagaacagtcctgagagcgaggactacggcctgtatttcngtgtgagagataacgaaaacttcccttacgattgtttcgttagtattagtggtcggggtacgaacgggtaactaagtacggtcgtaacccgttccgttcctcgtacgaccctcccgaaccgaaccgggtcccaacgttccggttacccgttcccccgttggcccgtcccgtcgtccgtccgacgggtcgaccctaccgtccgaacggaccgccgaaccgaccggccggtccccggtcgggtccctcgggtacccgttacgggaccgtaaaccggg

SEQ ID NO: 203097 - DNA, 601 bp, Homo sapiens
  misc_feature: GYAE6OF02G5S4Y.18.36.D03.1.454.CMB.1.raw
  modified_base (505)..(505): a, c, t, g, unknown or other
  misc_feature (505)..(505): n is a, c, g, or t
tcagtacgagtatgcacgaccggtgctcgatttagctgcgtcacgatctctcttgggattgtctctgctaatggtgaaccgcccctccacggagccttggtacagcctggggggtccctgagactctcctgtacagtctctggattcaccgtctccacttttgccatggcctgggtccgccgggctccagggaagggcctggagtgggtctccactatcagtgacactggtaatggcgatagcaagtggtacgcaggcctcgtgggaggggcggttccaccattagcagagacaattccaagaacacggtctagtctaacaatgaacagcctgagagccgaggacaccggcctgtatttcgtgtgtgaggagatacgaaaactttccctttagattgttctagacttagtggtcgggaccgtaaagggactaagttcggtctaacccgtcttacctccgactccctaccaccgaaccgggccctagtcccggtacccttccccgnggcccgtacctcgcctaccgagtcgaccacccgtccggacgacgaccgacgtaccggccggtcccgtgggcctccggccgttacggacgtaaccgg

SEQ ID NO: 203098 - DNA, 604 bp, Homo sapiens
  misc_feature: GYAE6OF02JZ2NE.18.36.D03.1.454.CMB.1.raw
  modified_base (263)..(263): a, c, t, g, unknown or other
  misc_feature (263)..(263): n is a, c, g, or t
  modified_base (278)..(278): a, c, t, g, unknown or other
  misc_feature (278)..(278): n is a, c, g, or t
  modified_base (298)..(298): a, c, t, g, unknown or other
  misc_feature (298)..(298): n is a, c, g, or t
  modified_base (304)..(304): a, c, t, g, unknown or other
  misc_feature (304)..(304): n is a, c, g, or t
tcagtacgagtatgcacgaccggtgctcgatttagctgcgtcacgatctctcttgggattgtctctgctaatggtgaaccgcccctccacggagccttggtacagcctgggggtccctgagactctcctgtacagtctctggattcaccgtctccacttttgccatggcctgggtccgccgggctccagggaagggcctggagtgggtctccgactatcagtgacactggtaatggcaatagcaagtggtacgcaggctccgnggagggcggttcacntagcagagacatccaagacnggtcanctacaatgaacagcctagagagaccgagacaccggccctgtaactttctgtgtcgagagataccgtaaaattccccgtttagactgtttctgtatacgtgttcgggacctaagggactaagtggtactaccggtccttaccgtacacggcccttccaacggaccgggtcccaacgtcccggtaccttacccccgtggcccggtccctacgtcgtacccagggtaccctcgacccttccggaacgtcgccgaacctacggcccgcccgttacgggcctggtcccggtacggtacgaaccgg

SEQ ID NO: 203099 - DNA, 710 bp, Homo sapiens
  misc_feature: GYAE6OF02I4SXL.18.36.D03.1.454.CMB.1.raw
  modified_base (380)..(380): a, c, t, g, unknown or other
  misc_feature (380)..(380): n is a, c, g, or t
tcagtacgagtatgcacgaccggtgctcgatttagctgcgtcacgatctctcttgggattgtctctgctaatggtgaaccgcccctccacggagccttggtacagcctggggggtccctgagactctcctgtacagtctctggattcaccgtctccacttttgccatgggctgggtccgccgggctccagggaagggcctggagtgggtctccacgtatcagtgacactggtaatggcgatagcaagtggtacgcaggctccggtggagggcggttcaccattagcgagacgacaaattccaagtaacaacggtctatctaacgaaatgaaactaggcctgagacgccggtaaggaccaacggcccttagtagttttacngttagtgtaagagacgttaacgtaaaactttcccgttgaacgtttgtttactgtaattagtcggttaggggaccctaaaggggtaacaaagttgggtaccctaccggttccttaccgtaccgtacggtcccctacccgtaacccggtaacgggacccctaaacggttacccggtttccctccccccggtggtcccccggtaacccgttccggtcccgttacccgagggtacccgtaccgtacccggtaacccggcgggaactacccgaaccgaccgggttcccgggacccgttcggggtccctagggccccgttaggtcccgtaaccggg

SEQ ID NO: 203100 - DNA, 668 bp, Homo sapiens
  misc_feature: GYAE6OF02JOC28.18.36.D03.1.454.CMB.1.raw
  modified_base (270)..(270): a, c, t, g, unknown or other
  misc_feature (270)..(270): n is a, c, g, or t
  modified_base (285)..(285): a, c, t, g, unknown or other
  misc_feature (285)..(285): n is a, c, g, or t
  modified_base (293)..(293): a, c, t, g, unknown or other
  misc_feature (293)..(293): n is a, c, g, or t
  modified_base (309)..(309): a, c, t, g, unknown or other
  misc_feature (309)..(309): n is a, c, g, or t
  modified_base (329)..(329): a, c, t, g, unknown or other
  misc_feature (329)..(329): n is a, c, g, or t
tcagtacgagtatgcacgaccggtgctcgatttagctgcgtcacgatctctcttgggattgtctctgctaatggtgaaccgcccctccacggagccttggtacagccgtgggggtccctgagactctcctgtacagtctctggattcaccgtctccacttttgcccatggcctgggtcccgccgggctccgaggggaagggccagggtgtgggtcctccactatcagtgacactgggtaatggcgatagcaaggtggtacgcaggctcgngggagggcgttcacntagcaganacaattaccaaggacncggtctaagtccgtaaactnaaactagaacgaagacgtacgacgacgaccgacggaccgacggtaccgttcgtagttcgttgtagtgtagtagtaacgtacgtaaacgttaccttcgtacgtagttacttgtagtagtagtagggtacgtaaggtacgtaacgtacggtcgtaccgtacgtccgtaccgtaccgaccgtaccgtacccgacggtacccgtacccgtcccggtccgttccccgtccgtccgtcccgtccggtaccgtccgaccggtaccgtaccgtaccgtacccgtaccggacggaccgaccgaccggaccggccggtcccgggtccggtcggtaccggtacggtacgg

SEQ ID NO: 203101 - DNA, 830 bp, Homo sapiens
  misc_feature: GYAE6OF02IDPVZ.18.36.D03.1.454.CMB.1.raw
tcagtacgagtatgcacgaccggtgctcgatttagctgcgtcacgatctctcttgggattgtctctgctaatggtgaaccgcccctccacggagccttggtacagccgtggggggtccctgagactctcctgtacagtctctggattccaccgtctcctacttttgccatggcctgggtccgccgggctccgaggggaaggcctgggaggttgggtcggaccaaacataatgacaaagataggaaccttggaagaaagaacttaagtcggtagggtaaccttcgtaggttacggaacggggtaccccgtagtttaccaacccgtaacttcctaacccgaaggaacggaactaaaaccgtaaacttaaaaccgtaaacttttacccgtaaggtttaacctttacgttaggaacctaaaacgttacggaaaccgtaccgtacccgtacgaaacgggaacccggaaccgggaacgggaacccgtaacggggtaccgtttacgggtttaaggtttaaacgtttaaccgttcgggtacggaacggtaaacgtagggaacctaggggtcggtacggtacggggaactaggtacgggtacgtacggtaccggggacgaacgggaccgacggtaccgtacccgtacgtcctacgacctcccgtaaccaaccgaaccgggccaaccggttccgttcccgttcccggtacgtcccgtcccgcgtccgtaccgagacccgaccgtacccgtacgaacggtacgaccacggaccggtcccgggtaccgtccgggaccgtcggacccggttacggtacccgtaaccgggttaccttaaccccg

SEQ ID NO: 203102 - DNA, 709 bp, Homo sapiens
  misc_feature: GYAE6OF02FZXW0.18.36.D03.1.454.CMB.1.raw
tcagtacgagtatgcacgaccggtgctcgatttagctgcgtcacgatctctcttggggtctgagagaggagcccagccctgagattttcaggtgttttcacttggtgatcaggactggacagagagaactcaccatggagtttgggctgagctggcttctttcttgtggcgtaattttaaaggtgtcaagtgtgaggtgcagctgttggagtcgtgggggagccttggtacacgccgtggggggtccctgacgactctcctgtacagtctctggattccaccgtctcctacttttcgcctagtcggccgtcggggtcccgccgggcctccggaggggaacgggcccgtgggacggttcgggtcctacctacgttatccgtaggtcgactacgtggtaagtgggacgataggtacgaaggttcggtaccgcgacgggtccgtccgggtgggtacggggtccggtaccgtaaccggtattacggccgtagaacggtaaccgtaacttacccgaaagaaaccgtaccgggtaccttaacgtacctaaacctaaagtaacgaaccgaacgtcccgtagaacggaacgtcccggaaggacccgaccgggtaccccttaggttaaccttttcgtagggttacgtaggaaggtaacggtacgttaacccggttaaaaccgttttccccgttttaacggtacgttttcggtttaccg

SEQ ID NO: 203103 - DNA, 888 bp, Homo sapiens
  misc_feature: GYAE6OF02JSBT6.18.36.D03.1.454.CMB.1.raw
  modified_base (335)..(335): a, c, t, g, unknown or other
  misc_feature (335)..(335): n is a, c, g, or t
  modified_base (398)..(398): a, c, t, g, unknown or other
  misc_feature (398)..(398): n is a, c, g, or t
  modified_base (723)..(723): a, c, t, g, unknown or other
  misc_feature (723)..(723): n is a, c, g, or t
tcagtacgagtatgcacgaccggtgctcgatttagctgcgtcacgatctctcttgggattgtctctgctaatggtgaaccgcccctccacggagccttggtacagccgtgggggggtccccctagacgtcctcctcgtacgtacgtcgttcctcggtagtacctacccgtcccgttcctaaccttttacggtttccaaccgtgggtccgggtccgggttcccggggtccccgggcccggttcccgaacggggaaacggggaccggtcggtaagggtggggttccgtccctacctaacttctacgtaggtacaaccgtaggttagtacggcggtanaagtcgaacgtaggtaccggaccagcggtccgttgggaggggtccggttcctaccattacggngacggagtaccaacttaaccgaacgaaaagtacccgggtcttactactaaaccgaaataacggtaaaccacgtacccgtcgggaagaaacgggtaccggaccggtaaacggacccggtccccggttaccgttttaggtttaaccttttcggtaggggtacgttaacgaaagggtacttaaaccggttaaaacccttttacccggtttccgttaacggtagtttttccgtttagtaagtacgttagggtcggggaaccggtaacgacgtaagtccgggtatcccgttaccgcttccctagcccgtccctaccgaacggtaccccgnttacccgttccccggttcccctacccggggtccgaccccgttcgtccgtacccggtaagggaccctaccggtaccccctacgggtacgacggaccacgtacccgggcccggtacccgggtcggttccggtcgttaccccgggtcggtacccggaaccggttacgg

SEQ ID NO: 203104 - DNA, 812 bp, Homo sapiens
  misc_feature: GYAE6OF02JJ1IS.18.36.D03.1.454.CMB.1.raw
  modified_base (217)..(217): a, c, t, g, unknown or other
  misc_feature (217)..(217): n is a, c, g, or t
tcagtacgagtatgcacgaccggtgctcgatttagctgcgtcacgatctctcttggggtctgagagaggagcccagccctgagattttcaggtgttttcacttggtgatcaggactggacagagagaactcaccatggagtttgggctgagctggctctttcttgtggcgatttaaaggtgtcaagtgtgagtgcagcgtgttggagtcgtgggganccgttggtacagccgtgggggtccctgagactcgtcctgtacagtctctggtacttaccaccgttctcctacttttcgccctagtcggtcccgtcggggttcccggcccgggtaccgttcccgacggggggtaacggggtcccttaggggtacggttcggggttcctaccgtaccgttaacgtcgtaggtcggtaacctacgttacggggttaaacttcggggaccgtaaagttaacggacgttaaacgggttaggtaacccgggtacgacggggtaccgttcccggggtacgggggtaacggggggtaccggtttccgtaacccgtaacgttaacggaccgaaggtaaccgaccgttaacgttaacccgaaacggtaacctacgggttacttaacgtaacgttaaacaaagtaccgtaaaactacggtacccgttaagggacgtaaacgggacccggaagggtaaacccgtacccgggtcccccgttaaggttaaccgttttacggtacggttagtaaccgggaggtaacgtaacgtttaaccgggttaaacctttttacccccggtttaggtaaccgttttcggtttaaaccg

SEQ ID NO: 203105 - DNA, 603 bp, Homo sapiens
  misc_feature: GYAE6OF02I3LZF.18.36.D03.1.454.CMB.1.raw
  modified_base (344)..(344): a, c, t, g, unknown or other
  misc_feature (344)..(344): n is a, c, g, or t
  modified_base (562)..(562): a, c, t, g, unknown or other
  misc_feature (562)..(562): n is a, c, g, or t
  modified_base (565)..(565): a, c, t, g, unknown or other
  misc_feature (565)..(565): n is a, c, g, or t
tcagtacgagtatgcacgaccggtgctcgatttagctgcgtcacgatctctcttgggattgtctctgctaatggtgaaccgcccctccacggagccttggtacagcctggggggtccctgagactctcctgtacagtctctggattcaccgtctcctacttttgccatcggcctgggtccgccgggctccgagggaggcctggagtggtctccactatcagtgacactgtaagtggacgatagctaaggtcggtacgcgaggctccggtagggagggggtccgttcaacctagttacgcaagagactaacttaccaagaacacggtctatactaacaatgaacngcctgaagcgccgaggaccacggccctggttaactttcgtagtgtacgaggactataaccgtaaatttcccttgactttgtttctgtatagtgtggggaccaagggtacaagtggtaccctaccgtcctacctcaccgtccctacccacccgaacggccctagtccgttacccttcccggtcgcccgtcccgctcgcccgagcgtacccacgtccganacncaacgcgtccgccgtagggcgtcgacgtgtacgaacgg

SEQ ID NO: 203106 - DNA, 726 bp, Homo sapiens
  misc_feature: GYAE6OF02JTWN2.18.36.D03.1.454.CMB.1.raw
tcagtacgagtatgcacgaccggtgctcgatttagctgcgtcacgatctctcttgggattgtctctgctaatggtgaaccgcccctccacggagccttggtacagcctgggggtccctgaaactctcctgtgcagcctctgggttcaccttcagtgctctgctatgcacgtgggtccgccaggcttaccgggaaaggctggagtgggttggccgtattagaagacaaagctaacagttacgacgactagcatatgcgtgcgtcggtagaaaggctaggttccgaccgtctccgaagaactgattacaaagtaacgacggacgtatactagacaaagtagaacgacgaccgtaacgaaaaccggtacgaccgtaccggtacgttagttaacttaacgtacgtaacgtacgtaacggtaagggtaggtaacgttaacgtaaggtttagggggtaagtttaacggtaccgggtaacggggtaaaaccggggggttaactacggttaaccggtacgtacggtacgggtacgttaccgggtacgggaccggaacgggtaccgacggtaccgaccgttacctcccgtcacgtcccgaccgaccggtacgacccgtacgtccgtacccgttcccggaccgtaccgtacccgtccgtacctaacggtcgacccgtaccggtccggtacgggacctaccgacggacccggtccggtcggtaccgtacggtcccgg

SEQ ID NO: 203107 - DNA, 628 bp, Homo sapiens
  misc_feature: GYAE6OF02GBL75.18.36.D03.1.454.CMB.1.raw
  modified_base (533)..(533): a, c, t, g, unknown or other
  misc_feature (533)..(533): n is a, c, g, or t
tcagtacgagtatgcacgaccggtgctcgatttagctgcgtcacgatctctcttggggtctgagagaggagcccagccctgagattttcaggtgttttcacttggtgatcaggactggacagagagaactcaccatggagtttggctgagctggcttctttcttgtggtcgtaattttaaaaggtgtcaagtgtgaggtgcagctgttggagtcgtgggggagtccgttggtacaggccgtcggggggtccctgacgactctcctgtacagtctcgtcggattccaccgtctcctacttttcgcctagtcggccgttcgggtcccggaccgggcctaccggaggggaacgggtcccgtagggtacggtcgggtcctccgtactatcgagtcgactacgtaggtaacgtggcgtatagacgtaagttgggtaccgcgacggtcgtccgggtggggacggggtaccgttcgaaccgtagttacgcaagagtaactaacttacgaaacgtacgtacggtactatacaacaaagtanaacgacgtcgtagacgtacgaccgaggaccaccgtcctagtacttcgtgtgtagagtagtacgttacgtaaacgtttccttagtacttgtttacg

SEQ ID NO: 203108 - DNA, 798 bp, Homo sapiens
  misc_feature: GYAE6OF02GY7R1.18.36.D03.1.454.CMB.1.raw
  modified_base (394)..(394): a, c, t, g, unknown or other
  misc_feature (394)..(394): n is a, c, g, or t
tcagtacgagtatgcacgaccggtgctcgatttagctgcgtcacgatctctcttgggattgtctctgctaatggtgaaccgcccctccacggagccttggtacagcctggggggtccctgagactctcctgtacagtctcgtggattcaccgtctcctacttttcgccagtcggcctgggtcccgccgggtcctccgaggggaacggccgtggaggtgggtcctccgatagtcgagtgacacgtggtaactggacaagtagacgaaggtcggtaacgcgaggtccgtccggtggggacggggtccgttcaacctagttaggctaggaacgactaaacttacccgaaagtaacgaccggttacttaacgtaccttaaacaaaagttacgaaaacncggtacccgtaggaacggaccggaccggaaacggtaccgacccggtacccgttgttacttttccgtggtggtacgagaacgtacgttaaccgtaaaacttttccccgttaggtactttcggtttacttacgtagttagtagggttacgggaacccggtaaagggtaactacggtacgggttacccgtaacccgttcctacccgttacgtacccgtccctacccgtaaacccgggaccggtaccccgtacggtttaccccggttccccgtttaccccgggtcggacccccgttcccgtccggtacccgtaccggaacggacctacccgtaaccggtacggaacggacctaccgaccgacgggtcccgtcggtcgggtacctcggtccggttaggacccgtaacgg

SEQ ID NO: 203109 - DNA, 669 bp, Homo sapiens
  misc_feature: GYAE6OF02H67BC.18.36.D03.1.454.CMB.1.raw
  modified_base (592)..(592): a, c, t, g, unknown or other
  misc_feature (592)..(592): n is a, c, g, or t
  modified_base (601)..(601): a, c, t, g, unknown or other
  misc_feature (601)..(601): n is a, c, g, or t
tcagtacgagtatgcacgaccggtgctcgatttagctgcgtcacgatctctcttgggattgtctctgctaatggtgaaccgcccctccacggagccttggtacagcctgggggtccctgagactctcctgtacagtctctggattcaccgtctcctacttttgccatggcctgggtccgccgggctccgagggaacggcctggagtcggtctccatatcagtgacactaggtaatggcatagacgtaagtcggtacgcgaggctccggtagggagggggtcggtttccaccgtaattagaccagaacgacaattccaaagaccgacggtctatactactaaactagacacgcctgagacgccggtacgacgtaccggacccgtgttacttttacgtgtcggtagaacgtagtactacttaaaacgtttccctttcgtaactttcgttcgtttagtactaagtttggaacgggggtcccgaaaagggtacgaagtcggtccgtaccggtaccttctaccgatccccgtactaacccgaacgggaccctaccgtacggttccccgtttaccccgtcggcccgtacccgccgttncccgtacgngaccctccggtaccgaggcctacgaccaggcccggtacgtcgggcctccgcgttaccgagtaacccgg

SEQ ID NO: 203110 - DNA, 869 bp, Homo sapiens
  misc_feature: GYAE6OF02JOUVC.18.36.D03.1.454.CMB.1.raw
tcagtacgagtatgcacgaccggtgctcgatttagctgcgtcacgatctctcttgggattgtctctgctaatggtgaaccgcccctccacggagccttggtacagcctggggggtccctgagactctcctgtacagtctctggattcacgtctcctacttttgccatggcctgggtccgccgggctaccgagggaagggcctggaggtgggtcctccactatcagtcgacactagggtaatcggacgaattacggactaaggtgggtaaccgctaggctacccggtgggacggggcggttaccaccgtaagttacggaccgaaggactaaaccgtaacgtttccccgaaaaggaaaccgtaaccgggttacctaaagttaccgtaaaccgtaaaaacttacgggaaaaccacggtaccgttagggtaaacgacggtaaccccggggaaagaccgggaaacccgggttccctacgggtttaacctttttgttcggggttaaccggttgggtaacggaaacggtaaccgtttaaaaccggggtaaaaaaccctttttccccggtttaaaccgtacggtttttaggtttaccgtttaaggttaacgtttaacgtttacggggttaaccggggtaaccggtaaacggggtaacgtaaacggttagggtacccgtacccggttaccttcccgttaccgaaccttacccgtacccgtaacccgaacggggtaccctaaacggttcccggtacccgttttccccgacggtacccgtcccgtcgaccgtcccgaggtaccgacctaccggaccgtaacgggactaccgacgaccgaccggccgtacggtccgttggcccggttagtaccggaaccgg

SEQ ID NO: 203111 - DNA, 642 bp, Homo sapiens
  misc_feature: GYAE6OF02GGFV3.18.36.D03.1.454.CMB.1.raw
tcagtacgagtatgcacgaccggtgctcgatttagctgcgtcacgatctctcttgggattgtctctgctaatggtgaaccgcccctccacggagccttggtacagcctggggggtccctgagactctcctgtacagtctctggattcaccttcagtggctctgctatgcactgggtccgccaggcttccgggaaagggctggagtgggttggccgtattagaagcaaagctaacagttacgcgacagcatatgctgcgtcggtgaaggcaggttcaccgtctccagaatgattcaaagaacacggcgtatcagacaaatgaacacgctagaaaaccgagacacggcgtgtattactgtactagacgagtgattacgagtttggggagttagtcggtacggtaaacgggggggtactacgtacggtagtagtcgggacggtacgtcggggaccgtaaacgggacccgtacggtaccgtaccgtcctaccgtcgacgtccctacccgaccgaaacgggtcccgtacgttcccggttcccgttaccccgtcggtccctaccccttccctaccggaacgtaccgcctaacccgtccgggtacggggactaccggacgggtcccggtcccggtcgggtactcccggg

SEQ ID NO: 203112 - DNA, 744 bp, Homo sapiens
  misc_feature: GYAE6OF02H4XY4.18.36.D03.1.454.CMB.1.raw
  modified_base (683)..(683): a, c, t, g, unknown or other
  misc_feature (683)..(683): n is a, c, g, or t
tcagtacgagtatgcacgaccggtgctcgatttagctgcgtcacgatctctcttgggattgtctctgctaatggtgaaccgcccctccacggagccttggtacagccgtggggggtccctgagactctcctgtacagtctctggattcaccgtctcctactttgccatcggcctgggtccggccggctccgagggacggctggagtcggtctaccactatcgagtcgacacgtaggtaatgggcgatacgacgaagtcggtacgacgaggcctcgggtgggacggggtccgttacaccgtaagttacgacgaaggacgaactaacttaccgaaaagaaccgtacggtctaactactaaacgaaatacgaacgacgacctaggacgacggaccgggtaacggaccgacccggttcccttaggttaacttttcggagtaggtagaagtaacgtataaaccgtaaacttttccgtttacgagtttcgttttacttaggtaacttaggtacgggtacgggtaccgaaagggttacaacggttcggtaccctaccgttactccctagaccgtccctaaccaaccgggaacggtcccgttaacgttcccggtaccccgttccccgttacgggcccttcccctacggtacccttaacgggacgtacccgacgttacccgacgtacggacnccgaacggtcccggtaaccgcccggttacgggccgtacgtccggttagggacttaacccgg

SEQ ID NO: 203113 - DNA, 647 bp, Homo sapiens
  misc_feature: GYAE6OF02I1OQ1.18.36.D03.1.454.CMB.1.raw
  modified_base (379)..(379): a, c, t, g, unknown or other
  misc_feature (379)..(379): n is a, c, g, or t
  modified_base (427)..(427): a, c, t, g, unknown or other
  misc_feature (427)..(427): n is a, c, g, or t
  modified_base (474)..(474): a, c, t, g, unknown or other
  misc_feature (474)..(474): n is a, c, g, or t
  modified_base (622)..(622): a, c, t, g, unknown or other
  misc_feature (622)..(622): n is a, c, g, or t
tcagtacgagtatgcacgaccggtgctcgatttagctgcgtcacgatctctcttgggattgtctctgctaatggtgaaccgcccctccacggagccttggtacagccgtggggggtccctgagactctcctgtgcaggccctgcattcatcttttaatagttattggatgcacgtgggtccgccaggcgtccggggaagggccggagtgggtggaccaaacataatgcaagatggaactggaagaagaactatgtgactctgtagaaggggtccaattccaaccatctaccagagaaccaacgaacttaagaactttctagttatctagacaaaagtcgaacacgtccctagaagacggtcccgaaggtaccacgggtntggtagttactacgtgtcgacgaaagcgacaggtcgcgtgggaccagnggtacgtgcggggacaaggaccgaccggtacacccgtctaccgtacncgtcccgtacccaaccgaacggacccctacgttccggttcccctttaccccgcggtcccgtcccgtaccgacctacccgaacggtaccgaccgtaccccggtacccggaggaccgacccaggtacccgaccgggtcccacgggtaccnccggtctacgggtacgaacgtaacc

SEQ ID NO: 203114 - DNA, 697 bp, Homo sapiens
  misc_feature: GYAE6OF02H2A3Y.18.36.D03.1.454.CMB.1.raw
tcagtacgagtatgcacgaccggtgctcgatttagctgcgtcacgatctctcttgggattgtctctgctaatggtgaaccgccccctccacggagccttggtacagcctggggggtccctgagactctcctgtacagtctctggattcaccgtctcctacttttgccatggcctgggtccgccgggctccgaggggaagggcctggagtgggtctccactatcagtgactacgtggtaatggcgaatagcaagtggtacgcgaggctcgtgggaggggcgttcaccattagcagagacaattaccaaagaacacggtactatactacaaaatgaacacgacctagagacgaccggaggacaccggcctgttactttctagtgtagacgagataacggtaaaactttcccttagattgtttactttagaattagtgggttaggggaccgtaaagggactaaagtcgggtacctaccgttacctccgttacaccgtacccttacccgaaacccgtaaccgggccctaaacggttccggttccccgtttacccccgtcgggtccccgtacccgtcgtacccgttacccgacgggtacgtacccgacccgtaccggtaacgaccggtaccgaaccgacggccccggtaccccggtacggggtccctaaccggtcccggttcgggtaaccggtaaaacccgg

SEQ ID NO: 203115 - DNA, 662 bp, Homo sapiens
  misc_feature: GYAE6OF02JO0AE.18.36.D03.1.454.CMB.1.raw
  modified_base (253)..(253): a, c, t, g, unknown or other
  misc_feature (253)..(253): n is a, c, g, or t
  modified_base (286)..(286): a, c, t, g, unknown or other
  misc_feature (286)..(286): n is a, c, g, or t
  modified_base (315)..(315): a, c, t, g, unknown or other
  misc_feature (315)..(315): n is a, c, g, or t
  modified_base (383)..(383): a, c, t, g, unknown or other
  misc_feature (383)..(383): n is a, c, g, or t
tcagtacgagtatgcacgaccggtgctcgatttagctgcgtcacgatctctcttgggattgtctctgctaatggtgaaccgcccctccacggagccttggtacagcctggggggtccctgagactctcctgtacagtctctggattcacgtctccacttttgccatggcctgggtccgccgggctccgagggaaggcctggagtgggtctccgactatcagtgacacgtggtaatggcatagcaagtgtacgnaggctcgtggagggcggttcacattcgcagganacaattcccaagacacggtctagtacaanaaatgaacacgccgtagacggacgccggaacgaccgaccggcctagtactttcgtagtgtagaggtanacgtacgtaaaacgtttcccttaggtattacggtttccttaggacttaagttgggtacgggacgtaaaacgggtctaaacgtcgggtactacccgttcgtacccgtacgtacgtcccgtaaccctaaccgggaaccggtaccctaaggttcccggttccccgttccccgtggggtccctcccgtacgtaccctaccgggacgtacgtcccaaccggtccgaagtaccgacgtacgaccggccgtcccggtggtcctaccggtccgtcggtacgaaccgg

SEQ ID NO: 203116 - DNA, 767 bp, Homo sapiens
  misc_feature: GYAE6OF02HCPE4.18.36.D03.1.454.CMB.1.raw
tcagtacgagtatgcacgaccggtgctcgatttagctgcgtcacgatctctcttgggattgtctctgctaatggtgaacccgcccctccacggagccttggtacagccgtggggggtccctgagactctcctgtacagtctctggattcaccgtctcctacttttgccatggcctgggtccgccgggctccgagggaaggcctggagtggtactccactatcagtgacacgtaggtaatgggacgatagacgtaagtggtacgcgacggcgtccgtgggaggggcggttcaccattagcagagaacaattaccaagaacacggtactatctaacaaatagaacacgacctaggaagaggccgaaggaccgaaccggccctagtaactttcgtgttgtaggagtaagagtaactaaaaagtttcccgtttacgtaagtttgtttacttacggtaattaacgttgggtacggggggtaacccgaaaaggggtaaacctaaaggttacggtacccgttaacccggttcccgttacccgtttaccaacgggtaccccttaaccccgaaacccggaaaaccggggtccccgaaaccggttcccgggtttacccccgtttacccccccgttacgggcccccgttaccccgttccggtaccctaacccggtaccggtaacggccctaacccggtacccgaacggtaccgaacgtaaccgtaaccggcccggtacccggtcgggcccttacggccctcggggtacctaaaccggg

SEQ ID NO: 203117 - DNA, 880 bp, Homo sapiens
  misc_feature: GYAE6OF02G96GO.18.36.D03.1.454.CMB.1.raw
tcagtacgagtatgcacgaccggtgctcgatttagctgcgtcacgatctctcttgggattgtctctgctaatggtgaaccgcccctccacggagccttggtacagcctggggggtccctgagactctcctgtacagtctctggattcaccgtctcctacttttgccatggcctgggtccgccgggctccgagggaaggcctggagtgggtctccatatcagtgactactggtaatcggacgatagactaagtcggtacgcaggcctccggtggggacgggtcggttcacctagttacgcgagtagactaacttaccgaaacgtaaccgacgggttacttaactacctaaactaaaacgtacggaaaacctacggtacccgtagaacggaaccggacccggaacgggaacccgtaaacccgggccctttaacgggtttaacttttcggtttacggttagggtttacgggaacggtaaggtaaacgtttaaccgggttaaaaaactttttccccccgtttacggtaacgttttaccggttttacgttttacggttaacgtttaacggtttacggggttacggggggtaacccgggtaaacggggtaaaccggtaaacgtacggggttacccgtaacccggttccgttacccgttccgtaacccgtcccgttaaacccgacccgtaaaccggggacccctaccggttaacccggttcccgtttcccccggtacggtccccgtccccgtcggtaccctacccggtacgaccggttacccgtaacccggtaccggtaacggtaccggtaacccacggaaccggtcccggtaacccggttccgggtcccgtaccggtaccggttacgggttaccgtaaaccccggg

SEQ ID NO: 203118 - DNA, 733 bp, Homo sapiens
  misc_feature: GYAE6OF02G9X9C.18.36.D03.1.454.CMB.1.raw
tcagtacgagtatgcacgaccggtgctcgatttagctgcgtcacgatctctcttggggtctgagagaggagcccagccctgagtattttcaggtgttttcacttggtgatcaggactggacagagagaactcaccatggagtttgggctgagctggcttctttcttggtggacgtaattttaaaaggtgtacgtaagtggtggaggtgcagtctggttggagtcggtgggggacgtccgttggtacgacggtcccggttcgggggtccctggtacgtactcctccgtgtactgtctcgtagtacttcctacccgttcctccttacgtttcgctacgtcggtccgtcgggtcccggccgggccgtccggaaggggaccgggtccgtgggtcggtacggtcctaccgacgttactacgacggtacgaacgtacgttaggtaagtcggacgtagtagaacgtaaggttacggtacggcggtacggccggttccggggtggggtaccggggtccgtaccgtaccgtaagttacgacgaaggaacgtaactaacgttaaccgaaacgtaaccgtacgttaactacctaactaactaaacgtacgaaacgacgtaccgtacggaacgacccggaccgggaaccgaccgtacccggtaccgtttagtttacgttcgtaggtcggtaaggtaagtaagtacgttaaccgtaccgttttacccgtagttacttgtttaacgg

SEQ ID NO: 203119 - DNA, 713 bp, Homo sapiens
  misc_feature: GYAE6OF02I3PIZ.18.36.D03.1.454.CMB.1.raw
  modified_base (141)..(141): a, c, t, g, unknown or other
  misc_feature (141)..(141): n is a, c, g, or t
  modified_base (372)..(372): a, c, t, g, unknown or other
  misc_feature (372)..(372): n is a, c, g, or t
tcagtacgagtatgcacgaccggtgctcgatttagctgcgtcacgatctctcttgggattgtctctgctaatggtgaaccgcccctccacggagccttggtacagcctggggggtccctgagactctcctgtacagtctcnggattcaccgtctcctactttgccatcggcctgggtccgccgggctccgaggggaaggcctggagtgggtctccaacgtatcgagtgacacgttaggtaactcggcgaatacggctaaaggtggtacgcaggcctaccggtgggaggggtcggttccacctagttacgcagagaacaattccaagaacacggtctatcaacaatgaaccagtcctgagacgacgacggacnccggtaccctgtatttccgtgtcgtagacgagtatacgaaactttcccgttagactcgtttcgttagtaattaggtcggtcgggtacgtaaggacaacgttcggtaccgtacccgttctccgtacgaccgtcctacccgtaccgaccgggtaccctacggtttaccgttccccggtttacccccgtcgggtcccgccccgtttagtccccgttaacgacggggacccgtaccggacccgttacccggtaacggaaccgcccggtaaaccgtcccgggacccggtaccccggtggggtaaccccgtcgggttccccggttacggggtaaccttaaacccggg

SEQ ID NO: 203120 - DNA, 948 bp, Homo sapiens
  misc_feature: GYAE6OF02FW6MZ.18.36.D03.1.454.CMB.1.raw
tcagtacgagtatgcacgaccggtgctcgatttagctgcgtcacgatctctcttgggattgtctctgctaatggtgaacccgcccctccacggagccttggtacagccgtgggggtccctgagactctcctgtacagtctctggtattcaccgtctcctacttttcgccagtcggccgttggggtcccgccggggcctaccggaaggggaacgggcctgggaggttcgggtcctccgactactcaggtcgacacgttggtaatcggacgtatagacgtaaggtcggtaccgcgacggtccgttccggtgggacgggggtccggttaccaaccgtaagtttacgaccgaaggaacgaaacgtaacgtttacccgaaacgaaaccgtaccgggttacttaacgttaccgttaaacgtaaaacgtacggtaaaaccgacgtacccgttaggaacggacggaccggaacgggtaaccgacccggtacccgttaggtttaacgtttttacctagggttcggtaggtaaggacgtaaacgtacggttaaaaaccttttcccgttttacgtacgtttgttttaccccccgtttaggttaacgttacggttacgggttacggggtaaccggtaaacggggtaaaccgtaaacggttacggttacccggtacccggttaccgtttaccccgttacccgtaccgttaccccgtacccgtaacccggaaacccgggtacccgtaccggttacccggtttcccccgtttacccccggttcccgggtccccggttccccgtccggtacccgttacccggtaccgggtaccgtacccgtaacccgtacccggtaaccggaaccggaacccgtaacccggtaacccgggtaccccgggtaccccgggttccggggttacccggttccggtacccggttaccgggtacccggttaaaccccggg

SEQ ID NO: 203121 - DNA, 789 bp, Homo sapiens
  misc_feature: GYAE6OF02GQFU9.18.36.D03.1.454.CMB.1.raw
tcagtacgagtatgcacgaccggtgctcgatttagctgcgtcacgatctctcttggggtctgagagaggagcccagccctgagattttcaggtgttttcacttggtgatcaggactggacagagagaactcaccatggagtttgggctgagctggctctttcttgtggcgattttaaaaggtgtcaagtgtgaggtgcagctgttggagtcgtgggggagtccgttgggtaccagcccgttgggggggtcccctggacggactcctccgtgttacagtctctggattccaccgtctccacttttgcctatcggcctcgggtcccgccgggctccgagggacgggccgtggacgtgggtctccactatccagtgacacgtggtaatgggacgagtagcgaaggtacgggtacgcgacgggcgtccggtagggagggggtccggttcgaacccgtagtttaacggacgtaaggaacgaacccgtaaaacgtttacccgaaaacggtaaacccgtaacccgggttaaccttaaacgtttaccgttaaaaccttaaaaacggttacggtaaaaccctaacgggtaaccccgttaagggaaacgggtaaacgggaccccgggaaaggggtaaccccgtaacccggggtacccccgtttaccggtttaacggttttttaccggttacgggtttacgggttaacgggtacggttaaacggtaacggttaaaccggtttaaaaaccgtttttaccccccgtttttaacgggtaacgttttaccgggtttttaaccgg

SEQ ID NO: 203122 - DNA, 656 bp, Homo sapiens
  misc_feature: GYAE6OF02FMF8J.18.36.D03.1.454.CMB.1.raw
tcagtacgagtatgcacgaccggtgctcgatttagctgcgtcacgatctctcttgggattgtctctgctaatggtgaaccgcccctccacggagccttggtacagcctggggggtccctgagactctcctgtacagtctctggattcaccgtctccacttttgccatggcctggggtccgccgggctccaggggtaagggcctggagtgggtctccactatcagtgacatggtaatggcgatgcaagtggtacgcaggctccgcggaggggcgttcaccattagcagagaccaattccaagaacaggtctatactaacaaatgaacacgcctgaagagccgaggacacggcctgtactttctgtgtgagagtatacggtaaaaacttcccgtttacggaactttgtttactttgtaattaaggttcggtacggggggtcccgaaaggggtaactaaacggttcggttaccaacccggttcgttaaccctcgaacggtcccctacccgacccgaacggggaccctacgttccggttaccctttcccccgtaggcccgtccctcgcttacccgaggacgtaccaccgccggtaagaccgacgtaccgaacggccgggtcccgtgggtacctcggtaccgttacggtacgtaaaccggg

SEQ ID NO: 203123 - DNA, 837 bp, Homo sapiens
  misc_feature: GYAE6OF02FVVQC.18.36.D03.1.454.CMB.1.raw
  modified_base (707)..(707): a, c, t, g, unknown or other
  misc_feature (707)..(707): n is a, c, g, or t
tcagtacgagtatgcacgaccggtgctcgatttagctgcgtcacgaatctctcttgggattgtctctgctaatagtgaaccgcccctccacggagccttggtacagcctgggggtcccttgagactctcctgtacagtctcgtggattcacccgtctccacttttgccatggcctgggtccgccggctccgagggaggtcctggagtgggtctccacgtatcagtgactactggtaatggcgaatacgcgtaagtggtaccgcacggtcgtccgtgggacggggcgtttcaaccgtattagccgtaagacgtaacaacttacgaaaggtaactacgggtactagtactacaaaactcgaaacacgtaccgtaggacggaacgccggaacggaacggtaacccggtacccgttacggtttacgttttaccggttagtacgggttacgaaaggtacggtaaaccgttaaccgtaaaaaaccgtttttcccccggtttaagttaacgtttacgtttacccgtttacggtaagtttaacggttcgggttaccgggtaaaccggtaaacgggttaacgtaaacggttcggtacccgtaccgttacccgttcccgttaccgtaccggttaccccgaacccgtaacccggaacggtaccccgttaacgttccccggtttacccgtttcccgtacgggtcccctcccggttaccncccggttacgaccggtaccgtacccgtacccggttaccggaaccgaccggtaacccgtacccggtaccgggcccggttacccggttcgggtaccgttcccggtccggttaccgggacgtttaaccccggg

SEQ ID NO: 203124 - DNA, 699 bp, Homo sapiens
  misc_feature: GYAE6OF02HLY0T.18.36.D03.1.454.CMB.1.raw
  modified_base (216)..(216): a, c, t, g, unknown or other
  misc_feature (216)..(216): n is a, c, g, or t
  modified_base (642)..(642): a, c, t, g, unknown or other
  misc_feature (642)..(642): n is a, c, g, or t
tcagtacgagtatgcacgaccggtgctcgatttagctgcgtcacgatctctcttggggtctgagagaggagcccagccctgagattttccaggtgttttcacttggtgatcaggactggacagagagaactcaccatggagtttggctgagctggcttctttcttgtgtcgtaagtttaaaggtgtcaagtgtgaggtgcagctgttggagttcgngggggacgtccgttggtaccaggccggtcgggggtaccctgacgtccttctccgtagtacgtgtactcgtgacttccgtacccgtcctacccttacttttcgcctagtacggccgttcgggtcccggccggtccgtaccggtaagggaacggtccgtgggtacgtcgggtcctccgtaagtactcgagtcgactacgttagtaagtcggtaacgagtaagaacgttaaggtacggtaccgtcgacggtcgtcccgggtagggacggggtaccggttacccgtaccgtaagttcggacgaacggtaactaacgtaacgttaaccgaaagttaaacccgtcgttaactaaccgttactaaacgaaattacgaaacgtcgtaccgtagacgacggaaccgaagacagttccgacgttagttactttcgnggttagtacggagtacgtaacgttaccgttaaacctttcccgttacgttactttacg

SEQ ID NO: 203125 - DNA, 804 bp, Homo sapiens
  misc_feature: GYAE6OF02G8VM1.18.36.D03.1.454.CMB.1.raw
  modified_base (220)..(220): a, c, t, g, unknown or other
  misc_feature (220)..(220): n is a, c, g, or t
  modified_base (303)..(303): a, c, t, g, unknown or other
  misc_feature (303)..(303): n is a, c, g, or t
  modified_base (371)..(371): a, c, t, g, unknown or other
  misc_feature (371)..(371): n is a, c, g, or t
  modified_base (615)..(615): a, c, t, g, unknown or other
  misc_feature (615)..(615): n is a, c, g, or t
tcagtacgagtatgcacgaccggtgctcgatttagctgcgtcacgatctctctgggattgtctctgctaatggtgaacccgcccctccacggagtccgttggtacagccgtgggggtccctgagactctcctgtacacgtctctggtattcaccgtctcctactttcgccagtcggccgtagggtcccgccgggcctaccggaggggaacggccgtaggngtggtcaccactatcgagtcgacacgtagtaacgtggactagtagacgtaaggtcggtacgacgaggccgtccggtacggggnggggtcgttaccgaacctagtagcaaggacaaacgtacttaacgaaacgaaccgtacggtaccttaanaccgtaaacaaagtacgaacacggtaccttaaggagaccggtcggaacggaccgtaccgtaccgttgttaactttcggtcggttagtacggaggtaactaacgttaaacgtaaaacccttttcccgtaggtatttcgtttataccgtaaggtttcggtcggggtacggggtaaccgaacgggttaaacgtaacggttacggtactaaccccggttccgttaacccgtccgtacccggtaacccnccgtaaaacccggccggtaaccctcggttaccccggttccccgttacccgccgggttcccgtcccgttacgtacccgtacggaacggccgtaccgttaccccgtaacgggtacacccgtaacggacccgtaccggacccgggttccggtcggaccctttcggacccggtttaccggacgttaaacccgg

SEQ ID NO: 203126 - DNA, 521 bp, Homo sapiens
  misc_feature: GYAE6OF01C5HJH.41.65.F10.1.454.CMB.1.raw
  modified_base (366)..(366): a, c, t, g, unknown or other
  misc_feature (366)..(366): n is a, c, g, or t
  modified_base (371)..(371): a, c, t, g, unknown or other
  misc_feature (371)..(371): n is a, c, g, or t
tcagtctatactatcacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctccaggggaaagagccaccctctcctgcagggccagtcagagtgttagcagcaacttagcctcgtaccagcagaaatctggccaggctccaggctcctcatctatggtgcatccaccgacgggccacgtggtactcccagccaggttcagtggcaggtgggtcgtgggacagagttcactcncaccntcagcagcctgcagtctagaagtatttgactagtttattactgtcagctagtataatgtactcggtcccttcccgttcggaccgaggaccacgtacgtaggagtaagttaaacgattggtcggctcgactaccattcttcgtcttctacc

SEQ ID NO: 203127 - DNA, 744 bp, Homo sapiens
  misc_feature: GYAE6OF01DM8F9.41.65.F10.1.454.CMB.1.raw
  modified_base (197)..(197): a, c, t, g, unknown or other
  misc_feature (197)..(197): n is a, c, g, or t
tcagtctatactatcacgaccggtgctcgatttagctacgctctaagggggaggaactgctcagttaggacccagacggaaccatggaagccccagcgcagcttctcttcctcctgctactctggctcccagataccactggagaaatagtgatgacgcagtctccagccaccctgtctgtgtctccgaggggaaancgcccaccctctcctgcgagggccagtcagagtgtaccagcaacttgcctggtaccacaagaacctgggcaggcctcccgagctcctcatctatcggaactctcccaccgacgggccctacgtcggtacctccccaaccgtagggttcaggtcggccgtagggtcggggtaccgggacaggtacggtttccaaccgtttcctaccaacctagtccgaacgggtcccgggcccttacggacgtacgggttccgttagggtaacgggtttaatttttcggtaccttaaggttttttaacgttaacgtttacgttaccgtacggtacttaacggtttaataaacgtttaaccgtcgggtccctttaccgttacgttaccgggtttccgggggaccggggggtaacgtaaggggtgggtaacgtacgttaacgaaaccggtaacgttcgggtacgggtccgttacggaaccctaccgttacgttcgttaccggttactttacccgtaccgtttaccccgttacccccggtacccttacgttaccgttaacg

SEQ ID NO: 203128 - DNA, 756 bp, Homo sapiens
  misc_feature: GYAE6OF01CF24P.41.65.F10.1.454.CMB.1.raw
  modified_base (203)..(203): a, c, t, g, unknown or other
  misc_feature (203)..(203): n is a, c, g, or t
  modified_base (701)..(701): a, c, t, g, unknown or other
  misc_feature (701)..(701): n is a, c, g, or t
tcagtctatactatcacgaccggtgctcgatttagctacgctctaagggggctctggggaggaactgctcagttaggacccagacggaaccatggaagccccagcgcagcttctcttcctcctgctactctggctcccagataccactggagaaatagtgatgacgcagtctccagccaccctgtctttgcgtccggggaacncgccacctctctgcacgggccgcagctgtgacgacgtactacgcctaggtaaccaagacgaacgccgtcggccaagggtccctacccgaagtaccctcctactataccgtaagtcggtaacttaccgttcgtaacgggtacgggtccctttacggtacggtacctaaccgttaccccggacgtccccggttactttacccggaggttccgggaccgttaaggggttccggggttcgtacggggaacctacggttacccttaccgtaacgttcccgtaacaacctacgacccgtaacccgtaacgtcccgtaacggtacgtacccgttaaggtaacgtttagttttcgacttaaggttttactacgtacgttaaccgtaacgtaacgttaaggaccgtacgtcctaacttaatacgttaccgtaccgtttccggaccgttacggtaacctacgggttacgaacttacgtaaaccgtaaacgtacgttcgacggttaccncggtaaccctacgttacgttccgtacttacgtacccttacgttcccgttaacccg

SEQ ID NO: 203129 - DNA, 591 bp, Homo sapiens
  misc_feature: GYAE6OF01DIXHA.41.65.F10.1.454.CMB.1.raw
  modified_base (198)..(198): a, c, t, g, unknown or other
  misc_feature (198)..(198): n is a, c, g, or t
  modified_base (295)..(295): a, c, t, g, unknown or other
  misc_feature (295)..(295): n is a, c, g, or t
  modified_base (347)..(347): a, c, t, g, unknown or other
  misc_feature (347)..(347): n is a, c, g, or t
  modified_base (371)..(371): a, c, t, g, unknown or other
  misc_feature (371)..(371): n is a, c, g, or t
  modified_base (426)..(426): a, c, t, g, unknown or other
  misc_feature (426)..(426): n is a, c, g, or t
  modified_base (540)..(540): a, c, t, g, unknown or other
  misc_feature (540)..(540): n is a, c, g, or t
  modified_base (550)..(550): a, c, t, g, unknown or other
  misc_feature (550)..(550): n is a, c, g, or t
tcagtctatactatcacgaccggtgctcgatttagctacgctctaagggggaggaactgctcagttaggacccagacggaaccatggaagccccagcgcagcttctcttcctcctgctactctggctcccagataccactggagaaatagtgatgacgcagtctccagccaccctgtctgtgtctccgaaggggaagngcccaccctctcctgcgagggccagtcagagtcgttaaccagcaacttcgcctcggtaccaaccaaggaaacctgggcaggcctcccgaggcctccncatctatggaacactccaccgaggccactggtactccccaaccgtaggttcngtcggctagggtcgggtccggganagtacgttcgactcctaccgactatcgacgtccggctcgactgtctaggaggttnttttgacttagtttattacttgtactagctaagttaactaattaacgtcgccttctacgtacggttcggggaccgggggtagagggtggagaacgtacaagtacgtggcggtcncgtactacgnttcgttcttcttacgtcttacccttccgacctgttctaacg

SEQ ID NO: 203130 - DNA, 698 bp, Homo sapiens
  misc_feature: GYAE6OF01CGHMR.41.65.F10.1.454.CMB.1.raw
  modified_base (197)..(197): a, c, t, g, unknown or other
  misc_feature (197)..(197): n is a, c, g, or t
tcagtctatactatcacgaccggtgctcgatttagctacgctctaagggggaggaactgctcagttaggacccagacggaaccatggaagccccagcgcagcttctcttcctcctgctactctggctcccagataccactggagaaatgtgatgacgcagtctccagccaccctgtctgtgtctccgaaggggaaancgcccaccctctcctgcagggccagtcagagtgtaccagctaacttagcctggtacccacagaaacctggcaggctcccaggctcctcatctatggaacactccaccgacgggccactcggtactccccacctaggttcaggtggctaggtcggggtccggacaggtacgttccaccttctaccacctactccgacggccggcccttggaccgtaggttcctagggtaagggttatttttacggactttaaggttttaacttacgttagttaccgtaagtacgtaaagttaaacttaaacgttaaccgttccgggtaccctttccgttaccgttaccgggttttaccgggggggacccggggggtaacctaaggggtacgggtaaacgtaacgtaaccggaaaacggtacggttagggtccggtacctcggtacccgaacttacgttccttacgttcctttaccgttaccttccccgttaccccgacttacgttcgtaacg

SEQ ID NO: 203131 - DNA, 703 bp, Homo sapiens
  misc_feature: GYAE6OF01BIKW8.41.65.F10.1.454.CMB.1.raw
  modified_base (197)..(197): a, c, t, g, unknown or other
  misc_feature (197)..(197): n is a, c, g, or t
  modified_base (303)..(303): a, c, t, g, unknown or other
  misc_feature (303)..(303): n is a, c, g, or t
tcagtctatactatcacgaccggtgctcgatttagctacgctctaagggggaggaactgctcagttaggacccagacggaaccatggaagccccagcgcagcttctcttcctcctgctactctggctcccagataccactggaagaaatagtgatgacgcggtctccagccacctgtctgtgtctccgaggggaaancgccaccctctcctgcagggccagtcagagtgttagcagcaacttgcctcgtacagacagaatctaggccaggcctcccgaggccttcctactacgtctagtggtncaactcccgaccgacgggccctaacgttggtaacctcccgagtccgtaggttccaggtcggaccgtaggttggggttaccgaggggactacgggtacgttccaaccgttcctaccaacccgtatccaacggacctacggtccctagaccgtaggttaccgtaaggtaacgtttacgtttttacggaccgttttaagtttttaacttaccgtttacgttacgtaacgtaacgttaacgttaagttacgtacggtaccgttccggtacccccgtttacccggttacggaacccggtaacgggtaccctaacgggtacgtaggtaaacgtaacgttaaaaccggtagttagggtacgtccgtacgacccgtaactacttaccgttacgttcccttcgtacccg

SEQ ID NO: 203132 - DNA, 666 bp, Homo sapiens
  misc_feature: GYAE6OF01BTS5F.41.65.F10.1.454.CMB.1.raw
  modified_base (195)..(195): a, c, t, g, unknown or other
  misc_feature (195)..(195): n is a, c, g, or t
  modified_base (266)..(266): a, c, t, g, unknown or other
  misc_feature (266)..(266): n is a, c, g, or t
tcagtctatactatcacgaccggtgctcgatttagctacgctctaaggggggaggaactgctcagttaggacccagacggaaccatggaagccccaggcgcagcttctcttcctcctgctactctggctcccagataccactggagaaatgtgatgacgcggtctccagccacctgtctgtgtctcgaggggaancgccacctctcctgcgacgggccagtcaggagttgttagcagctaacttcgcctcgtacagcaagaatcgnggccaggcctaccgaggtcctcctacgtattctagtggtcacctactcccgaaccggtcgggacctacggtcggttaccctcccgaacgtcccgtaaggttcgagggttcggacgtaggggttggggtccgtaggggaactaggtcgtacacttccgtacacctatcgacgtctacggccttagaccgtagtcgtaaggttaattacgtttagactttaaggttttactcgttcgtacgtaagtacgttagttaactcgtacgttaccgtccggtacccttaccggtacggtacccggaaaggtacccgtacggtacgtaagggaaacgttaacgttaaacgtacgttcggtacgtacgtaccgaccgtaactacggttactcggttacttacttcccgg

SEQ ID NO: 203133 - DNA, 615 bp, Homo sapiens
  misc_feature: GYAE6OF02I48O4.41.65.F10.1.454.CMB.1.raw
  modified_base (195)..(195): a, c, t, g, unknown or other
  misc_feature (195)..(195): n is a, c, g, or t
  modified_base (595)..(595): a, c, t, g, unknown or other
  misc_feature (595)..(595): n is a, c, g, or t
  modified_base (608)..(608): a, c, t, g, unknown or other
  misc_feature (608)..(608): n is a, c, g, or t
tcagtctatactatcacgaccggtgctcgatttagctacgctctaagggggaggaactgctcagttaggacccagacggaaccatggaagccccagcgcagcttctcttcctcctgctactctggctcccagataccactggagaaatagtgatgacgcagtctccagccaccctgtctctgtctccaggggaanagccacctctcctgcagggccagtcagagtgttggcagcagcgtagcctggttccagcagaaccgcgacgactaccgcgacgtcctcactctactaccaccactaccaccacggaccggacctacggtacgtacccacgaccgacgtaacgtctacgacggtcgaccttgggtacggtacggacggacgtaggtactactaccgtactacccactcgacgacgcgtaccgtcacgtacgtacgtcgaagttactttcgttacgacgtttatttacttacgtacgtagactagtaagtacgttagtacgttacgtccgttaccgtttccgtaaccgtttccggtaccgtccggtaccgtactacggtacgtacgttacctaacgaactcgttggtcgtacncgtaccacgttcncgttccg

SEQ ID NO: 203134 - DNA, 517 bp, Homo sapiens
  misc_feature: GYAE6OF02HAAXW.41.65.F10.1.454.CMB.1.raw
  modified_base (364)..(364): a, c, t, g, unknown or other
  misc_feature (364)..(364): n is a, c, g, or t
tcagtctatactatcacgaccggtgctcgatttagctacgctctaagggggaggaactgctcagttaggacccagagggaaccatggaagccccagctcagcttctcttcctcctgctactctggctcccagagatcaccggagatattgtgttgacacagtctccaggcaccctgtctttgtctccaggggagagagccaccctctcctgtagggccagtcggagtgttgctaagtacctagcctggtaccaacagaaacctggccaggcctcccaggctcctcatctatgatgcatccaacagggtcactggtactccagccaggttcagtggcaggtggctgggacaggacgtttcactcncaccatcagcagcctgcagtctagaagtatttgctagtttatactgtacagtacatatatgactgtaccctccgttcggaccgaacggacacgtacgtgagtacttaacgacgtgtcggctgaccacgatctcgtcttcacttcctccgtacc

SEQ ID NO: 203135 - DNA, 514 bp, Homo sapiens
  misc_feature: GYAE6OF02G6A1R.41.65.F10.1.454.CMB.1.raw
  modified_base (197)..(197): a, c, t, g, unknown or other
  misc_feature (197)..(197): n is a, c, g, or t
  modified_base (379)..(379): a, c, t, g, unknown or other
  misc_feature (379)..(379): n is a, c, g, or t
  modified_base (503)..(503): a, c, t, g, unknown or other
  misc_feature (503)..(503): n is a, c, g, or t
tcagtctatactatcacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctttgtctccgaggggaaanagccaccctctcctgcagggccagtcagagtgttagcagctacttagcctggtaccaacagaaacctggccaggctcccaggcctcctcatctatggtgcatccaacgacgggcccactcggccactccccagcctagggttcaggtcggcaggtgggtctgggacagacttcactctcacntcagcagcctagacgctagaagttatttgctagtttatgtacttgtacagctagtcgtagcaacgtggccatccaccgttcgaccgaaggcacgatggataagtaacgactgtgctgacacgtntctgtctctac

SEQ ID NO: 203136 - DNA, 637 bp, Homo sapiens
  misc_feature: GYAE6OF02JDE7V.41.65.F10.1.454.CMB.1.raw
  modified_base (197)..(197): a, c, t, g, unknown or other
  misc_feature (197)..(197): n is a, c, g, or t
  modified_base (294)..(294): a, c, t, g, unknown or other
  misc_feature (294)..(294): n is a, c, g, or t
tcagtctatactatcacgaccggtgctcgatttagctacgctctaagggggaggaactgctcagttaggacccagacggaaccatggaaaccccagcgcagcttctcttcctcctgctactctggctcccagataccactggagaaatagtgatgacgcagtctccagccaccctgtctgtgtctccgaggggaaangccaccctctcctgcagggccagtcagagtgttaccagcaacttagcctggtaccaccagaaacctggcagcctccaggcctctcatctagcgaacnctccacgacgggcctacgtggacctcccaccgtaggttcaggtgacgtaggtcgggtaccggacaggtacgttaccacttcgtaccgaaccctagtaccgaagtcccacgtcccgtgacctagtccgtagtaacgttatttcggtcttaagtttacttacttgtctagtacgtaatagttaaggtcacgtcggtccccttaccggttcggaaccgtaacgggtaccgtaaccgtacgtacggaacgtaaacgtttaaaaccggattggtacgtacgtcgaacctacgtacgtcgttacgttaccttctaccgttaccgttcccctacggttacttccggtacg

SEQ ID NO: 203137 - DNA, 738 bp, Homo sapiens
  misc_feature: GYAE6OF02IT99D.41.65.F10.1.454.CMB.1.raw
  modified_base (184)..(184): a, c, t, g, unknown or other
  misc_feature (184)..(184): n is a, c, g, or t
  modified_base (198)..(198): a, c, t, g, unknown or other
  misc_feature (198)..(198): n is a, c, g, or t
  modified_base (225)..(225): a, c, t, g, unknown or other
  misc_feature (225)..(225): n is a, c, g, or t
  modified_base (228)..(228): a, c, t, g, unknown or other
  misc_feature (228)..(228): n is a, c, g, or t
  modified_base (232)..(232): a, c, t, g, unknown or other
  misc_feature (232)..(232): n is a, c, g, or t
  modified_base (271)..(271): a, c, t, g, unknown or other
  misc_feature (271)..(271): n is a, c, g, or t
  modified_base (278)..(278): a, c, t, g, unknown or other
  misc_feature (278)..(278): n is a, c, g, or t
tcagtctatactatcacgaccggtgctcgatttagctacgctctaagggggaggaactgctcagttaggacccagacggaaccatggaagccccagcgcagcttctcttcctcctgctactctggcctcccagataccactggagaaatagtggatgacgcagtctccagccaccctgtctgtntctcgaaggggaancgccacctctcctgcaggcagtcaagngtntacngacaattgcctgtaccacaagaacctggacagctaccgngcctacnatctagtagacagtaccacgaggccacgtcggtacacccgtacgtagttcgacgtggacgtacggtgggacccggaatacggtcgtttaccactactacgtaactcgaacgtacggtccggctacggacgtacgtacgttacggtaaacggttcgttttacgtacgttaagtttaaacgtttacgttggtacgtagttacgttaaactttaaagttaaacgttaaccgttacggttaccctttaccggtttaacccgttacggggtttaacccgggggtaccgggggtaaaccggtaaacgggtaacgggttaaacgaaaccggttaaaccgaaaaacgggttacgttacggtacgggtccttaacggtaacccgttaacgttacgttaacgttacccgtttacgttaccgttaacccgtacccgttttaccccggaacgtttaacggtctttaaaccgg

SEQ ID NO: 203138 - DNA, 735 bp, Homo sapiens
  misc_feature: GYAE6OF02F8ECY.41.65.F10.1.454.CMB.1.raw
  modified_base (197)..(197): a, c, t, g, unknown or other
  misc_feature (197)..(197): n is a, c, g, or t
  modified_base (306)..(306): a, c, t, g, unknown or other
  misc_feature (306)..(306): n is a, c, g, or t
tcagtctatactatcacgaccggtgctcgatttagctacgctctaagggggaggaactgctcagttaggacccagacggaaccatggaagccccagcgcagcttctcttcctcctgctactctggctcccagataccactggagaaatagtgatgacgcggtctccagccaccctgtctgtgtctccgaggggaagngcccacctctcctgcagggccagtcagagtgtacgcagcaacttagcctcgtaccagcaagaaactctcggaccagggcctcccgaggcctcctcattctattgggtcncatacccaccgaggccacgtggtacctcccacggccaggttcgagtggcgtaggtgggtcgtcgggacaggtacgtacctaccttcctacctacccacttacgacgtccgtaacggtccctacgggactacggttactacgggttaaaacggttacgtttttcggagtttaacggttttttaactttaccgtttacggttacgaacgtactaacggttaaatttaacgtacggtaccgtttccgggtaccccctttaccccggttaccggggaaacccgtaaaaccggggccgttaaacccgggtaacgttaccgggggaaaactttaaccgggtttaaaaacccgggacgtttaccgggggttacgggtaccgtttacccggaccgtaaccttacgtaccgttttacggttacccgttacttacccgg

SEQ ID NO: 203139 - DNA, 863 bp, Homo sapiens
  misc_feature: GYAE6OF02F5SRP.41.65.F10.1.454.CMB.1.raw
  modified_base (181)..(181): a, c, t, g, unknown or other
  misc_feature (181)..(181): n is a, c, g, or t
  modified_base (195)..(195): a, c, t, g, unknown or other
  misc_feature (195)..(195): n is a, c, g, or t
tcagtctatactatcacgaccggtgctcgatttagctacgctctaagggggaggaactgctcagttaggacccagacggaaccatggaagccccagcgcagcttctctcctcctgctactctggctcccagataccactggagaaatagtgatgacgcagtctccagccaccctgtctgtntctccgaggggaancgccaccctctcctgccgaggccagtcagagtcgttaccagactaacttacgccgttaggtacccaacgacgtaaaccgtgggaccacgggacctaccccgacggtcctccctactacttaccgtaagtcggaaaccctcgtacccccgaacggtacggggtaccccaaggttaccgggttaacctacccccgtaacccgttagggttaccgtaaacggtcgggggtacctaaggggtttccgggggacccgggtaacgtaacgggtaccgtttaccgaacccgttttcaacccggtacctacgtacccgtaacggcccggttcccttaggccgtaacggtttccgtaaggttaaccggggtttactttttacggacggtttacgttttacgtttaacccgttagtacgaccgttataaacggtttacttaaaccggtacgttacccggttaccgttacccgttacggtttaccgggttacccggggggtaacccgggtaaccggttaacgggggttaccggaaacggtttaacgtacccggttaaaaacggtcccgttagggggttacccgcgttaacccggtactaaccccggtttggtttacccgtacggtttaacctttaccgtacgtttacccctacccggtttacgtaccttacgggtttac

SEQ ID NO: 203140 - DNA, 413 bp, Homo sapiens
  misc_feature: GYAE6OF01A6K5D.8.36.D03.1.454.CMB.1.raw
  modified_base (400)..(400): a, c, t, g, unknown or other
  misc_feature (400)..(400): n is a, c, g, or t
  modified_base (406)..(413): a, c, t, g, unknown or other
  misc_feature (406)..(413): n is a, c, g, or t
tcagctcgcgtgtccacgaccggtgctcgatttagctgcgtcacgatctctcttgggaacagctccaacatcgggactttttatgatgcacactggtaccggcaccttccaggaacagcccccagcctcctcatctataataataacattcggccctcaggggtcccctgaccgcttctctggctccaagtctggctcctcagcctccctggccatcactgggctccaggctgacgatggaggctgattattactgccagtcatatgacagcagcctgtcgttttgggtgttcggcggaggaccaagctgaccgtctgcgtcacgcccaaggctcgcccccgtcggtcactctcgttccccaccctccctcgacaccgcgagtgagcgggctggcaggcncatagnnnnnnnn

SEQ ID NO: 203141 - DNA, 410 bp, Homo sapiens
  misc_feature: GYAE6OF01CSLZL.8.36.D03.1.454.CMB.1.raw
  modified_base (404)..(410): a, c, t, g, unknown or other
  misc_feature (404)..(410): n is a, c, g, or t
tcagctcgcgtgtccacgaccggtgctcgatttagctgcgtcacgatctctcttgggaacagctccaacatcgggactttttatgatgcacactggtaccggcaccttccaggaacagcccccagcctcctcatctataataataacattcggccctcaggggtccctgaccgcttctctggctccaagtctggctcctcagcctccctggccatcactgggctccaggctgacgatgaggctgattattactgccagtcatatgacagcagcctgcggtttttgggtgttcggcggagggaccaagctgaccgtctgcgtcagcccaggctcgccccctcggtcactctcgttcccaccctcctcgacgcgagctgacgcgggctgggcaagggcgacatagnnnnnnn

SEQ ID NO: 203142 - DNA, 546 bp, Homo sapiens
  misc_feature: GYAE6OF01BG1KV.8.36.D03.1.454.CMB.1.raw
  modified_base (86)..(86): a, c, t, g, unknown or other
  misc_feature (86)..(86): n is a, c, g, or t
  modified_base (503)..(503): a, c, t, g, unknown or other
  misc_feature (503)..(503): n is a, c, g, or t
  modified_base (508)..(508): a, c, t, g, unknown or other
  misc_feature (508)..(508): n is a, c, g, or t
  modified_base (513)..(546): a, c, t, g, unknown or other
  misc_feature (513)..(546): n is a, c, g, or t
tcagctcgcgtgtccacgaccggtgctcgatttagctgcgtcacgatcgtctcgttgggaacagctccaacatcgggactttttangatgcacactggtaccggcaccttccaggaacagcccccagcctcctcatctataataataacattcggccctcgtaggggtccctgaccgtctttactctcggctccaagtcgtggctcctcaggtccctcccgtgggccattcgaccgtggggcctccaggcctgacgagtgaggctagattatacgtgccagtcatatgacaggcagcctgtcggtttttgggcgttcggcggacgggaccgaaggctcggaccgtcgtcggccggtctacggacccaacggtcctcccggccccccgtcgggtccaacccgttccttaccgtttcccccaacccgttcccttacacccgtaccggccgacgtccgtacgacgggtccgggacgtcgggaccgaacgggcgaccgtaagtcgancagancgatnnnnnnnnnnnnnnnnnnnnnnnnnnnnnnnnnn

SEQ ID NO: 203143 - DNA, 425 bp, Homo sapiens
  misc_feature: GYAE6OF01CE1OB.8.36.D03.1.454.CMB.1.raw
  modified_base (416)..(425): a, c, t, g, unknown or other
  misc_feature (416)..(425): n is a, c, g, or t
tcagctcgcgtgtccacgaccggtgctcgatttagctgcgtcacgatctctcttgggaacagctccaacatcgggactttttatgatgcacactggtaccggcaccttccaggaacagcccccagcctcctcatctataataataacattcggccctcaggggtccctgaccgcttctctggctccaagtctggctcctcagcctcctggccatcactgggctccaggctgacgatgaggctgattattactgccagtcatatgacagcagcctggtcgttttgggtgttcggcggaggaccagctgaccgtctgcgtcacgcccaggcctcgcccctcggtcactctcgtccccaccctcctccgacaccgcgagcgtggacggccgggacgtcgggacaagggccacgagtagnnnnnnnnnn

SEQ ID NO: 203144 - DNA, 483 bp, Homo sapiens
  misc_feature: GYAE6OF01EAUTW.8.36.D03.1.454.CMB.1.raw
  modified_base (293)..(293): a, c, t, g, unknown or other
  misc_feature (293)..(293): n is a, c, g, or t
  modified_base (457)..(457): a, c, t, g, unknown or other
  misc_feature (457)..(457): n is a, c, g, or t
  modified_base (459)..(483): a, c, t, g, unknown or other
  misc_feature (459)..(483): n is a, c, g, or t
tcagctcgcgtgtccacgaccggtgctcgatttagctgcgtcacgatctctcttgggaacagctccaacatcgggactttttatgatgcacactggtaccggcaccttccaggaacagcccccagcctcctcatctataataataacattcggccctcaggggtccctgaccgcttctctggctccaagtctggctcctcagccctccctggccatcacgtgggctccaggctgacgatgaggctgatttattactgccagtcatatgacagcagcctggtcgtttttggggngttcgggcgggaggaccaagcgtggaccgtctgcgtcacgcccaaggctccgccccctcggtccactctcgtttcccccgccctccctcgaccgaccggtcgacgtccgtggggaccgggccggggtccgtaggggaccgaaacggggtcccgacagtaagggngnnnnnnnnnnnnnnnnnnnnnnnnn

SEQ ID NO: 203145 - DNA, 403 bp, Homo sapiens
  misc_feature: GYAE6OF02G55A1.8.36.D03.1.454.CMB.1.raw
  modified_base (346)..(346): a, c, t, g, unknown or other
  misc_feature (346)..(346): n is a, c, g, or t
  modified_base (368)..(368): a, c, t, g, unknown or other
  misc_feature (368)..(368): n is a, c, g, or t
  modified_base (392)..(392): a, c, t, g, unknown or other
  misc_feature (392)..(392): n is a, c, g, or t
  modified_base (398)..(403): a, c, t, g, unknown or other
  misc_feature (398)..(403): n is a, c, g, or t
tcagctcgcgtgtccacgaccggtgctcgatttagctgcgtcacgatctctcttgggaacagctccaacatcgggactttttatgatgcacactggtaccggcaccttccaggaacagcccccagcctcctcatctataataataacattcggccctcaggggtccctgaccgcttctctggctccaagtctggctcctcagcctccctggccatcacgtgggctccaggctgacgatgaggctgattattactgccagtcatatgacagcagcctgtcgttttgggtgttcggcggaggaccaagctgaccgtctgcgtcacgcccaaggctcgcccctcggtcnctctcgttcccacctcctcacncgcgagctgagcggctggcaggcncatagnnnnnn

SEQ ID NO: 203146 - DNA, 408 bp, Homo sapiens
  misc_feature: GYAE6OF02JTAVY.8.36.D03.1.454.CMB.1.raw
  modified_base (390)..(390): a, c, t, g, unknown or other
  misc_feature (390)..(390): n is a, c, g, or t
  modified_base (396)..(408): a, c, t, g, unknown or other
  misc_feature (396)..(408): n is a, c, g, or t
tcagctcgcgtgtccacgaccggtgctcgatttagctgcgtcacgatctctcttgggaacagctccaacatcgggactttttatgatgcacactggtaccggcaccttccaggaacagctcccagcctcctcatctataataataacattcggccctcaggggtccctgaccgcttctctggctccaagtctggcaacacggcctccctgaccgtctctgggctccagactgaggatgaggctgatttattactgcagctcatattcaggcagcaacagggtattcgggcggagggaccaagttgaccgtctaggtcagcccaaggctgcccctggtcactctcgttcccgccctcctcgacacgcgagctgacgcgggctgggcaggcncatagnnnnnnnnnnnnn

SEQ ID NO: 203147 - DNA, 444 bp, Homo sapiens
  misc_feature: GYAE6OF02JZIUD.8.36.D03.1.454.CMB.1.raw
  modified_base (296)..(296): a, c, t, g, unknown or other
  misc_feature (296)..(296): n is a, c, g, or t
  modified_base (352)..(352): a, c, t, g, unknown or other
  misc_feature (352)..(352): n is a, c, g, or t
  modified_base (373)..(373): a, c, t, g, unknown or other
  misc_feature (373)..(373): n is a, c, g, or t
  modified_base (406)..(444): a, c, t, g, unknown or other
  misc_feature (406)..(444): n is a, c, g, or t
tcagctcgcgtgtccacgaccggtgctcgatttagctgcgtcacgagttcgtctcttgggaacagctccaacatcgggactttttatgattgcacactggtaccggcaccttcaggaacagcccccagcctcctcatctataataataacattcggccctcaggggtccctggaccgctttctctggcctccaagtctcggctcctcagcctcctggccatcactgggctccaggctgacgatggagctgattatacgtgcctagtcatatgacagcagcctgtcggtttttgggngttcgcggtaggaccaagctgaccgtctgcgtcagccaagctcgcccctgcactcngtcccactctcgacacgcganctgacgtcgggctcgggcaaggcgctagtagcnnnnnnnnnnnnnnnnnnnnnnnnnnnnnnnnnnnnnnn

SEQ ID NO: 203148 - DNA, 498 bp, Homo sapiens
  misc_feature: GYAE6OF02INHZG.8.36.D03.1.454.CMB.1.raw
  modified_base (472)..(472): a, c, t, g, unknown or other
  misc_feature (472)..(472): n is a, c, g, or t
  modified_base (475)..(475): a, c, t, g, unknown or other
  misc_feature (475)..(475): n is a, c, g, or t
  modified_base (478)..(498): a, c, t, g, unknown or other
  misc_feature (478)..(498): n is a, c, g, or t
tcagctcgcgtgtccacgaccggtgctcgatttagctgcgtcacgatctctcttgggaacagctccaacatcgggactttttatgatgcacactggtaccggcaccttccaggaacagcccccagcctccctcatctataataataacattccggccctcaggggtccctgaccgcttctctggctccaagtctggctcctcagcctccctggccatcactgggctccgaggctgacgatggaggctgatttatactgccagtcatatgactagcagtcctggtccggtttttgggtgttccgggacgggaacgggaccaaggcgtgacccggttctcggcgtcgacgcccaaggcctacgcccccgtaggtcctactccgtcgttccccgccctcctacgacctcggcccgtagccgtaggacgccggggtactcgggaccgaaagggtcccgactaagtacgggctcgancgntcnnnnnnnnnnnnnnnnnnnnn

SEQ ID NO: 203149 - DNA, 407 bp, Homo sapiens
  misc_feature: GYAE6OF02FF110.8.36.D03.1.454.CMB.1.raw
  modified_base (254)..(254): a, c, t, g, unknown or other
  misc_feature (254)..(254): n is a, c, g, or t
  modified_base (289)..(289): a, c, t, g, unknown or other
  misc_feature (289)..(289): n is a, c, g, or t
  modified_base (398)..(398): a, c, t, g, unknown or other
  misc_feature (398)..(398): n is a, c, g, or t
  modified_base (404)..(407): a, c, t, g, unknown or other
  misc_feature (404)..(407): n is a, c, g, or t
tcagctcgcgtgtccacgaccggtgctcgatttagctgcgtcacgatctctcttgggaacagctccaacatcgggactttttatgatgcacactggtaccgacaccttccaggaacagcccccagcctcctcatctataataataacattcggccctcaggggtccctgaccgctttctctggctccaagtctggctcctcagcctccctggccatcactgggctccaggctgacgatgaggctgattattacngccagtcatatgacagcagcctgtcgtttttgggngttcggcggagggaccaagctgaccgtcctgcgtcagccaaggctcgccccctggtcactctcgttccccgcctcctcgacacgcgagctgacgcgggctggcaaggcncatagnnnn

SEQ ID NO: 203150 - DNA, 457 bp, Homo sapiens
  misc_feature: GYAE6OF02H9V6Y.8.36.D03.1.454.CMB.1.raw
  modified_base (437)..(457): a, c, t, g, unknown or other
  misc_feature (437)..(457): n is a, c, g, or t
tcagctcgcgtgtccacgaccggtgctcgatttagctgcgtcacgatctctcttgggaacagctccaacatcgggactttttatgatgcacactggtaccggcaccttccaggaacagcccccagcctcctcatctataataataacattcggccctcaggggtccctgaccgcttctctggctccaagtctggctcctcagcctccctggccatcactgggcctccaggctgacgatgaggctgattattactgccagtcatatgacagcagcctgtcgttttgggtgttcggcggaggaccaagctggaccgtctgcgtcacgccgtaaggctcgccccgtcggtccacttcctcgttcccccaccttccctacgacctaccggccgacgtcctcggacggccggggtctcggggaccaacgggcgacaagtgcnnnnnnnnnnnnnnnnnnnnn

SEQ ID NO: 203151 - DNA, 474 bp, Homo sapiens
  misc_feature: GYAE6OF02JEP41.8.36.D03.1.454.CMB.1.raw
  modified_base (179)..(179): a, c, t, g, unknown or other
  misc_feature (179)..(179): n is a, c, g, or t
  modified_base (270)..(270): a, c, t, g, unknown or other
  misc_feature (270)..(270): n is a, c, g, or t
  modified_base (274)..(274): a, c, t, g, unknown or other
  misc_feature (274)..(274): n is a, c, g, or t
  modified_base (291)..(291): a, c, t, g, unknown or other
  misc_feature (291)..(291): n is a, c, g, or t
  modified_base (407)..(407): a, c, t, g, unknown or other
  misc_feature (407)..(407): n is a, c, g, or t
  modified_base (432)..(432): a, c, t, g, unknown or other
  misc_feature (432)..(432): n is a, c, g, or t
  modified_base (436)..(436): a, c, t, g, unknown or other
  misc_feature (436)..(436): n is a, c, g, or t
  modified_base (438)..(439): a, c, t, g, unknown or other
  misc_feature (438)..(439): n is a, c, g, or t
  modified_base (441)..(441): a, c, t, g, unknown or other
  misc_feature (441)..(441): n is a, c, g, or t
  modified_base (443)..(474): a, c, t, g, unknown or other
  misc_feature (443)..(474): n is a, c, g, or t
tcagctcgcgtgtccacgaccggtgctcgatttagctgcgtcacgatctctcttgggaacagctccaacatcgggactttttatgatgcacactggtacccggcaccttccaggaaccagcccccagccctccctcatcctataataataacattcggccctcaggggtccctgaccgnttctctggctccagtctggctcctcagcctccctggccagtcacgtgggctccgaggctgacgatgaggctgattatactgccagtcatangacngcagctgtcgttttggngttcggcggagggaccaaggtctcggaccgtcgtgcgtcagcccgaggtctcgcccccctggtcactctcgttcccccaccttcctcgacaccggccgtagctggacggcgggtcngggaccaggggccacgtagtacgcncgtncnntnannnnnnnnnnnnnnnnnnnnnnnnnnnnnnnn

SEQ ID NO: 203152 - DNA, 416 bp, Homo sapiens
  misc_feature: GYAE6OF02IFMAO.8.36.D03.1.454.CMB.1.raw
  modified_base (395)..(395): a, c, t, g, unknown or other
  misc_feature (395)..(395): n is a, c, g, or t
  modified_base (400)..(416): a, c, t, g, unknown or other
  misc_feature (400)..(416): n is a, c, g, or t
tcagctcgcgtgtccacgaccggtgctcgatttagctgcgtcacgatctctcttgggaacagctccaacatcgggactttttatgatgcacactggtaccggcaccttccaggaacagcccccagcctcctcatctataataataacattcggccctcaggggtccctgaccgcttctctggctccaagtctggctcctcagcctccctggccatcactgggctccaggctgaccgatgaggctgattattactgccagtcatatgacagcagcctgtcgttttgggtgttcggcgggtagggaccagctgaccgtctgcgtcacgccaggctcgcccccgtgccactctcgttcccacctcctcgaccacgcgagctgacgcggctggcaggcnatagnnnnnnnnnnnnnnnnn

SEQ ID NO: 203153 - DNA, 710 bp, Homo sapiens
  misc_feature: GYAE6OF02GCVYI.8.36.D03.1.454.CMB.1.raw
  modified_base (243)..(243): a, c, t, g, unknown or other
  misc_feature (243)..(243): n is a, c, g, or t
  modified_base (595)..(595): a, c, t, g, unknown or other
  misc_feature (595)..(595): n is a, c, g, or t
  modified_base (607)..(607): a, c, t, g, unknown or other
  misc_feature (607)..(607): n is a, c, g, or t
tcagctcgcgtgtccacgaccggtgctcgatttagctgcgtcacgatctctcttgggaacagctccaacatcgggactttttatgatgcacactggtaccggcaccttccaggaacagcccccagcctcctcatctataataataacattcggccctcgacggggtccctgaccgcttctcgtggctccaagtctggctcctcacgcctcctggacctatcacgtcggctccgaggctgacgntgagctgattatactgacctagtctatatcggacagcacgtccgttggttcggtttttgggttacggtcggggtacgggttaacggaaccgtaaggtccgttacggtaacccggttcgtcggtacccgttaccgaccggtaacccggaacggtcccggtacccggtcccccgttcggtaccctacccgttacccgttcccgttaccccccgtaccgttaccccgttacccggaacccgtaccgggtacccggtaccgtaccggtacgggtaccgggtcccgggtaccgggttccgggaaaccgtaaccggggtccggtacgtaacgttaacgggcctaagttcgcggtcccncgaacgtgaacncctacgacgacgtacgtcgtcgtacgtcgtcgtacgtacgcgtcgtactactcggtcgacgtacggtcgtacgtacgaccgtcgtcgtcgtacgtagtctacg

SEQ ID NO: 203154 - DNA, 589 bp, Homo sapiens
  misc_feature: GYAE6OF02G42HF.8.36.D03.1.454.CMB.1.raw
  modified_base (223)..(223): a, c, t, g, unknown or other
  misc_feature (223)..(223): n is a, c, g, or t
  modified_base (515)..(515): a, c, t, g, unknown or other
  misc_feature (515)..(515): n is a, c, g, or t
  modified_base (518)..(518): a, c, t, g, unknown or other
  misc_feature (518)..(518): n is a, c, g, or t
  modified_base (521)..(521): a, c, t, g, unknown or other
  misc_feature (521)..(521): n is a, c, g, or t
  modified_base (523)..(523): a, c, t, g, unknown or other
  misc_feature (523)..(523): n is a, c, g, or t
  modified_base (529)..(529): a, c, t, g, unknown or other
  misc_feature (529)..(529): n is a, c, g, or t
  modified_base (531)..(532): a, c, t, g, unknown or other
  misc_feature (531)..(532): n is a, c, g, or t
  modified_base (537)..(537): a, c, t, g, unknown or other
  misc_feature (537)..(537): n is a, c, g, or t
  modified_base (543)..(543): a, c, t, g, unknown or other
  misc_feature (543)..(543): n is a, c, g, or t
  modified_base (552)..(552): a, c, t, g, unknown or other
  misc_feature (552)..(552): n is a, c, g, or t
  modified_base (554)..(554): a, c, t, g, unknown or other
  misc_feature (554)..(554): n is a, c, g, or t
  modified_base (559)..(559): a, c, t, g, unknown or other
  misc_feature (559)..(559): n is a, c, g, or t
  modified_base (562)..(562): a, c, t, g, unknown or other
  misc_feature (562)..(562): n is a, c, g, or t
  modified_base (565)..(565): a, c, t, g, unknown or other
  misc_feature (565)..(565): n is a, c, g, or t
  modified_base (567)..(567): a, c, t, g, unknown or other
  misc_feature (567)..(567): n is a, c, g, or t
  modified_base (573)..(573): a, c, t, g, unknown or other
  misc_feature (573)..(573): n is a, c, g, or t
  modified_base (576)..(576): a, c, t, g, unknown or other
  misc_feature (576)..(576): n is a, c, g, or t
  modified_base (582)..(583): a, c, t, g, unknown or other
  misc_feature (582)..(583): n is a, c, g, or t
  modified_base (585)..(585): a, c, t, g, unknown or other
  misc_feature (585)..(585): n is a, c, g, or t
tcagctcgcgtgtccacgaccggtgctcgatttagctgcgtcacgatctctcttgggaacagctccaacatcgggactttttatgatgcacactggtaccggcaccttcaggaacacgcccccagcctcctcatctaataataaataacattccggccctcgacggggtccctgaccgctttctctggcctaccaagtcctggcctcctacacgccttcccgnggcctatccacgttgggacctaccgaggtccgtagaacgatggacggcttagaactttattacgtcgacctagtacctatagtagacgagaccgacgtcctggttcggtttttggggtcgttcgggcgggtaacgggaacctaagtccgtacggtacccgttcgcgtacgtcgaaccgccgaaggtccgccgtcccgtcggtacaccttcgtccgtccccgtcctccgtacgtaccaaccgcgagtccgtacgacggtcggcgacggtacgacggcgtacgacgtagcgtancgngtncngtagcncnncgcgngcgacncgcgctcgngngcganacngcngngtgtcngcncgcgcnngngtcg

SEQ ID NO: 203155 - DNA, 535 bp, Homo sapiens
  misc_feature: GYAE6OF01AYT62.39.77.G11.1.454.CMB.1.raw
tcagtcgcactagtcacgaccggtgctcgatttagctagtcactcaagggaaaggggggggtctcaggaggcagcgctctcaggacatctccaccatggcctgggctctgctgctcctcaccctcctcactcagggcacagggtcctgggcccagtctgccctgactcagcctgcctccgtgtctgggtctctaggacagtcgatcaccatctcctgcactggaaccagcagtgacgttgggggttatgactatgtctcctggtaccagcaatactccaggcacacgcccccaaactcatcatttatgagtcagtaatcggccctcgtagggtttctaagtcgtcttctctggtctccaagtctggacaacgaccggccctccctgaccactctcgtgggctccgaggctggacggacgaggctagtattattactgcagtctctatttgactaatcagtcgaggtcttagtcgttcgttacgggtaagtcgggaaccaggtcacgttccgtacgtaggtcacggcccgaaccgg

SEQ ID NO: 203156 - DNA, 511 bp, Homo sapiens
  misc_feature: GYAE6OF01D5KVI.39.77.G11.1.454.CMB.1.raw
tcagtcgcactagtcacgaccggtgctcgatttagctagtcactcaagggaaaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctactggtaccagcaatatccaggcacagcccccaaaactcatcatttatgaggtcagtaatcggccctcaggggtttctaatcgcttctctggctccaagtctggcaacacggcctccctgacccatcctctgggctccgaggctggaggacgaggctgatttattactgcagctcatttgctaatcagtgaggtctttatgttcgttcggaaggttgggaaccaagatctatcgtacctaggtcaggaccccg

SEQ ID NO: 203157 - DNA, 492 bp, Homo sapiens
  misc_feature: GYAE6OF01CFUM2.39.77.G11.1.454.CMB.1.raw
  modified_base (300)..(300): a, c, t, g, unknown or other
  misc_feature (300)..(300): n is a, c, g, or t
  modified_base (317)..(317): a, c, t, g, unknown or other
  misc_feature (317)..(317): n is a, c, g, or t
  modified_base (362)..(362): a, c, t, g, unknown or other
  misc_feature (362)..(362): n is a, c, g, or t
  modified_base (371)..(371): a, c, t, g, unknown or other
  misc_feature (371)..(371): n is a, c, g, or t
  modified_base (404)..(404): a, c, t, g, unknown or other
  misc_feature (404)..(404): n is a, c, g, or t
  modified_base (416)..(416): a, c, t, g, unknown or other
  misc_feature (416)..(416): n is a, c, g, or t
  modified_base (427)..(427): a, c, t, g, unknown or other
  misc_feature (427)..(427): n is a, c, g, or t
  modified_base (444)..(444): a, c, t, g, unknown or other
  misc_feature (444)..(444): n is a, c, g, or t
tcagtcgcactagtcacgaccggtgctcgatttagctagtcactcaagggaaagggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtgttataactatgtctactggtaccaacaacaccaggcaaagccccaaatcatgatttangagtcactaatcgcctnagggtttctaatcgcttctctggctcaagtctgcacacgcctccngaccatctntggctccaggctgaggacgaggctgattatacngcagctcttaanagaagaagtanctactatggtgttcggnggaggacagctagactcgtaagtcacgccaggctcgccccgtggtacc

SEQ ID NO: 203158 - DNA, 670 bp, Homo sapiens
  misc_feature: GYAE6OF01C143Z.39.77.G11.1.454.CMB.1.raw
  modified_base (127)..(127): a, c, t, g, unknown or other
  misc_feature (127)..(127): n is a, c, g, or t
  modified_base (211)..(211): a, c, t, g, unknown or other
  misc_feature (211)..(211): n is a, c, g, or t
  modified_base (228)..(228): a, c, t, g, unknown or other
  misc_feature (228)..(228): n is a, c, g, or t
tcagtcgcactagtcacgaccggtgctcgatttagctagtcactcaagggaaaggggggggtctcaggaggcagcgctctcaggacatctccaccatggcctgggctctgctgctcctcaccctctnactcagggcacagggtcctgggcccagtctgccctgactcagcctgcctccgtgtctgggtctccgtaggacagtcgatcaccntctctgcactggaaccngcagtgacgttgagttatactatgtatactgtaccaacaacaccaggacaaacgccccaaactaccatcgtatttagagaggtacaactaacgtccggtacctacgtacggggttttactaacgttccgtctttccgtcgttcgggccttaccgtaaacgttccgtaggacctaaccgtaaccgtccccgttaccctacggaccctacgttccgttcgtcgggtccttaccgacggtcgttacggaacgggtacggacggtacttaggtaactttacgttacgtgaccgtagtccttagttaacgtaagtaaacgtaggtacacgtacgttacgttgggtacggtttaccgggacgggtaaccgggaaccacggtaccgtacgtaccggtaccgtaacgtaccgacgtacccgaacggtctccccgcccgttccggttaccc

SEQ ID NO: 203159 - DNA, 679 bp, Homo sapiens
  misc_feature: GYAE6OF01BHWVN.39.77.G11.1.454.CMB.1.raw
tcagtcgcactagtcacgaccggtgctcgatttagctagtcactcaagggaaagggggggggtctcaggaggcagcgctctcaggacatctccaccatggcctgggctctgctgctcctcaccctcctcactcagggcacagggtcctgggcccagtctgccctgactcagcctgcctcgtgtctgggtctccgtggacagtcgatccaccatcctcctgcactggaaacccagctaggtgacggttggttaggttataactatgttctactaggtaccaacaccacccgtagaccaaacgacccccaaacgtaccagtagtatttataggacggtactaacgtaacgtccggtaccctcgtacgggtttcctaaacgtccgtaccgttctcgtcgtcctaccgtaacggttcgtggacgtaaaccgacccggtaccccttcccgtcgtaccctactttccctacgttccgggtcctcccgagggtccgtaggtacgggaccggtaggcctaggtactttacgttacttgcctagtcttacgttagtaagtaacgaaggttactacttacgttcgtaggttcgggtacgggtacgggaacgggtaccaaggtccgtacggacccgtacgttaaccgcgaccgtaccgaaccgtccgtcccgtccccgtccgttaccccg

SEQ ID NO: 203160 - DNA, 778 bp, Homo sapiens
  misc_feature: GYAE6OF01BPTBN.39.77.G11.1.454.CMB.1.raw
  modified_base (277)..(277): a, c, t, g, unknown or other
  misc_feature (277)..(277): n is a, c, g, or t
tcagtcgcactagtcacgaccggtgctcgatttagctagtcactcaagggaaaggggggggtctcaggaggcagcgcgtctcaggacatctccaccatggcctgggctctgctgctcctcaccctcctcactcagggcacgagggtcctgggacccagtctcgccctgactcagcctgcctccgtgtctgggtctccgtggacagtcatccaccatcctcctggaccacgtaggaacgcagctaggtacggtacggttggtagttaactaaacgttnttcgtccgttccgtacggtaaaccctaacgacgtacccgaaccccgtaagggaaccctaaaaccccggaacccccctaaacgtcaacgtttacgttaactttttaaggtcggtaaacggttacctaaacgttaaccgtcccgggtcccgtttacgggttaacggggttttaccaaaccgtttcggttacctttccgtaccggttcgtacccgtttaaccgtaacggttccgtaacgggccctaaaccgtacccggtcccctccggtaccgtacctacgttccgtacggtcggtccctacgacggtcgtaacgggacggtacgtggtacgttacgtacgttactcggtacgtactacggttctagttacgttacgacttacgtacgtagtggtacttactttacggtgtttaccggtacggggtagtacgggtaaccgtggttacccaggtttacccgtacggtaccggtaccgtaccgtaacccggacccgtaaacccccg

SEQ ID NO: 203161 - DNA, 705 bp, Homo sapiens
  misc_feature: GYAE6OF01BCXNR.39.77.G11.1.454.CMB.1.raw
tcagtcgcactagtcacgaccggtgctcgatttagctagtcactcaagggaaaggggggggtctcaggaggcagcgctctcaggacatctccaccatggcctgggctctgctgctcctcaccctcctcactcagggcacgagggtccctgggcccagtctcgccctgactcagcctgcctcgtgtctgggtctccgtaggacagtcatcacctatcctcctgcacgtggaaccagcaggtgtacggttgtagttatacgtatgtactactaggtaccaaacactaccaggacaaccgaccccaatcatgtattagagagtacactacgtcgaccttcgtacgggttactaacgtcgtacttctcgtcggtactacgtaagtcgtacgaccaaaccggtaccgtccctaccggtacaccctacgttaccgtcgtacggtccgtacccgtaggtctagggaacggtaccggaacgggtccttaaggttaactttaacgttaccggtacgaccgttacgggttaccttaaccggttaagtaaacggaacggttaaggtaccgtaccggttacgttacggtacgggttacggtaccgggggaccgtaaacggggaaccgtacgggtaaccgttacgggtaaccccggtgtaaacgtcccgaacggtacccgtacggtacccgtacccgttcccccggtcggttaccccg

SEQ ID NO: 203162 - DNA, 716 bp, Homo sapiens
  misc_feature: GYAE6OF01DOUKB.39.77.G11.1.454.CMB.1.raw
  modified_base (270)..(270): a, c, t, g, unknown or other
  misc_feature (270)..(270): n is a, c, g, or t
  modified_base (344)..(344): a, c, t, g, unknown or other
  misc_feature (344)..(344): n is a, c, g, or t
  modified_base (448)..(448): a, c, t, g, unknown or other
  misc_feature (448)..(448): n is a, c, g, or t
  modified_base (458)..(458): a, c, t, g, unknown or other
  misc_feature (458)..(458): n is a, c, g, or t
tcagtcgcactagtcacgaccggtgctcgatttagctagtcactcaaggggaaagggggggggtctcaggaggcagcgctctcaggacatcctccaccatggcctgggctcgtgctgctcctcaccctcctcactcgaggcacgacgggtcccgccggacgtcgtcgtccgccgtatccacggcgtcgcgtcccgtcggtcgtcgggtacgtcctacggagacgtagactactaaccgactcgtccttacgcaacgtacggaccgaacgnggtactaggtacgggttacggggtttaggtatacgtacgttagtcggtccgtttacggaacgtacggacttaanagtaccgagaccgacaccgtacccaacctactagctaagttatcgaacgtcacgtacggtacctccggtcgtaggtacgttactcgctctcgtagctcgacgtngacggaaacnccgcgtctacgacacgtctcgtaggccgtacgacgaggtcgtacggaacgcgtcgttactacgttaactctaaggtccgactccgtacttacggttactaacaacttaatacgggtacgttaccgtaagggtttcctaaaacggtttccgggtagtaaaccgggggttaggaaacccggtttaaaccggtaacggtctttaaccccgggacgtttaaccgggtacccaacgggttaaccccgaaaccgggaacccccg

SEQ ID NO: 203163 - DNA, 638 bp, Homo sapiens
  misc_feature: GYAE6OF01ARHMJ.39.77.G11.1.454.CMB.1.raw
  modified_base (228)..(228): a, c, t, g, unknown or other
  misc_feature (228)..(228): n is a, c, g, or t
tcagtcgcactagtcacgaccggtgctcgatttagctagtcactcaagggaaaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccngcagtgacgttggtggttataactatgtctactggtaccaacaacacccaggcaaacgcccccaaactcatgtatttatgaggtcactaatcggccctcgtaggggtttctaatccgtcttctcgtggcctaccaacgttccgtggaccaaccgaccggtcccctcccgtcgaccctacttccgtcgtcgggccttaccgacgggtcgtaggaacgggtaccgaagggtcgttagttaactttacgtttacgtgcctagtcctttacttaagtaaggaaacgtaacgtacgcctacgttcgttcgggttacggttcgggccgggtacgggacccaggtccgttacggacccgttaccgtaacgtaccgacgaccccgtacggtcccttcccggtcccccgtcggtacccg

SEQ ID NO: 203164 - DNA, 558 bp, Homo sapiens
  misc_feature: GYAE6OF02F1AAA.39.77.G11.1.454.CMB.1.raw
  modified_base (228)..(228): a, c, t, g, unknown or other
  misc_feature (228)..(228): n is a, c, g, or t
  modified_base (306)..(306): a, c, t, g, unknown or other
  misc_feature (306)..(306): n is a, c, g, or t
  modified_base (443)..(443): a, c, t, g, unknown or other
  misc_feature (443)..(443): n is a, c, g, or t
tcagtcgcactagtcacgaccggtgctcgatttagctagtcactcaagggaaaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccngcagtgacgttggtggttataactatgtctactggtaccaacaacacccaggcaaacgcccccaaactcatgatttangaggtcactaatcggccctcgtaggggtttctaatcgtcttctctggctccaagtctggcaacacggccctcctgaccatctctcgggctccgaggctaggacggacgaggctagtattagttactgctagtccttnttaactaagaagtaagtagactactcgttggttcgttacgggacggagggaaccgaaggccgtaggacccgtactaacgtcgacgcccgaaggcctaccggcccccgtggtaccc

SEQ ID NO: 203165 - DNA, 704 bp, Homo sapiens
  misc_feature: GYAE6OF02JS19J.39.77.G11.1.454.CMB.1.raw
  modified_base (310)..(310): a, c, t, g, unknown or other
  misc_feature (310)..(310): n is a, c, g, or t
  modified_base (421)..(421): a, c, t, g, unknown or other
  misc_feature (421)..(421): n is a, c, g, or t
tcagtcgcactagtcacgaccggtgctcgatttagctagtcactcaagggaaagggggggtacgtcaggaggcgagcgctctcaggacatctccaccatggcctgggctctgctgctcctcaccctcctcactcaggcacagggtcctgggcccagtctgccctgactcacgcctgcctccgtgtctgggtctcctggacagtcgatcaccatcctcctgcactggaaccagcagtgacgttggtgtataactatgtctatgtaccaacaacaccaggacaaacgacccccaactacacttagactttangtaacggtacagtaatccggacccttacgtacggggtttactaacgttcgtacgtttctctcggtcctacctaagtctggtaccaacgccggtccctaccttacgaacctnttccgtcgtacggggtccttcccggggaccttaggaaccgggtacggtaacgggtccttaagggtctttaaactttacgcggtacgacgtttctaccgttaagttccgtaactaacgttacgaggttacggaggttacctttaggtaccggttacgtttacggggaagggttcggttaaacccgaaacgggtttcccaggtttcccccgttaaccggttaacgggtaccgtaacccggttacccgggaaacccggtacccccttaaacccggtacttcccggg

SEQ ID NO: 203166 - DNA, 780 bp, Homo sapiens
  misc_feature: GYAE6OF02IWZZ3.39.77.G11.1.454.CMB.1.raw
  modified_base (228)..(228): a, c, t, g, unknown or other
  misc_feature (228)..(228): n is a, c, g, or t
  modified_base (254)..(254): a, c, t, g, unknown or other
  misc_feature (254)..(254): n is a, c, g, or t
tcagtcgcactagtcacgaccggtgctcgatttagctagtcactcaagggaaaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccngcagtgacgttggtaggttataactntgttctacgttacgtaacctaacaaaccacccgaaggaccaaaccgaccccccaaaactcctaatagtactttagtaggtaacggtaccaacttaaacgtcccggtacccgttacgtaacgggggttttactaacgttccgtacttccttacgtcggtcctaccgtaacgtcgtcggacctaaccgaccgtccctccgtcgacctactcgtcgtcgggcctccgaggtcgtaggacgggacgaggtactaggttaactttattaaccgtcgacgtacgttaccttaacgtttaacggtaacggtaaaagtaacggttaacgacccgttaaccgtttacggttacgggttaccggggttacccggggtaaccggggtaacccggggtaacccgtaaccgggtaccggttacccgggttaacccggtttaacccgttaacggtttaccccggaaaccgggttaacccccgaaaccggggttaccccggttacccccggtacccccccgggttaccgggttaacccccg

SEQ ID NO: 203167 - DNA, 772 bp, Homo sapiens
  misc_feature: GYAE6OF02JVWVK.39.77.G11.1.454.CMB.1.raw
  modified_base (140)..(140): a, c, t, g, unknown or other
  misc_feature (140)..(140): n is a, c, g, or t
tcagtcgcactagtcacgaccggtgctcgatttagctagtcactcaagggaaaggggggggtctcaggaggcagcgctctcaggacatctccaccatgggcctgggctctgctgctcctcaccctcctcactcaggcacngggtcctgggcccagtctgccctgactcagccctgccctccgtgtcgtcggtctccgtaggacagtcactcacctattcctcacgcgaccgtacggaaccagctggtcggttaacgttgggttaggttataacttacgtcgtacttacgtacggtaaccgaacctaaaccaccgaacggaaccgaaacctaccccgtaaccctacagtactataagttcgaacggttacacgttaactccggtccctacgtacgggggtttacctaacgttccgtcgttccttcgtcggtacccgtaccgtaacggtccgtcgggtactaacccggtaccgggtaccccttacccgtaccgggtaaccctaacggttcccgtaccggtaccggtcccgtaaccggtacggtacgtacgggtaaacggtaaccggtacggttacgtaacgttaaacggtttacgttaacccggtacgtaccgtaacgttaccggttaacctaaaggtttaaccaacgtacgtacggacgtacgtacgtacctacgtaccggtttcggtacggttacgtacccgggtaagggtaccgaacggtaacgtaccgtacgtaccgtaccgtacgaccgtacgaccgtacgtaccccgg

SEQ ID NO: 203168 - DNA, 300 bp, Homo sapiens
  misc_feature: GYAE6OF01DQJ1G.15.57.F02.1.454.CMB.1.raw
  modified_base (299)..(300): a, c, t, g, unknown or other
  misc_feature (299)..(300): n is a, c, g, or t
tcagtctacgtagccacgaccggtgctcgatttagctcgatatagttgggtttggatgagaacctatgaacattctgtagggccactgtcttcaacacggcctccctgaccgtctctggcctccagactgaggacgaggctgattattactgccactcatatagaagtagtactactcctgtggttttcggcggagggaccaagctgaccgtcctaggtcagcccaaggctgccccctcggtcactctgttcccgccctcctcgctacgtagactgagcgggctggcaaggcgcatagnn

SEQ ID NO: 203169 - DNA, 249 bp, Homo sapiens
  misc_feature: GYAE6OF01EHFHY.15.57.F02.1.454.CMB.1.raw
  modified_base (245)..(249): a, c, t, g, unknown or other
  misc_feature (245)..(249): n is a, c, g, or t
tcagtctacgtagccacgaccggtgctcgatttagctcgatatagttgggtttgggggtgtggtggtctccactcccgccttgacgaggctgattattactgccactcatatagaagtagtactactcctgtggtttcggcggagggaccaagctgaccgtcctaggtcagcccaaggctgccccctggtcactctgttcccacctctcgctacgtagactgagcgggctggcaaggcgcatagnnnnn

SEQ ID NO: 203170 - DNA, 306 bp, Homo sapiens
  misc_feature: GYAE6OF01DGX8B.15.57.F02.1.454.CMB.1.raw
  modified_base (300)..(306): a, c, t, g, unknown or other
  misc_feature (300)..(306): n is a, c, g, or t
tcagtctacgtagccacgaccggtgctcgatttagctcgatatagttgggtttgggatgagaacctatgaacattctgtaggggccactgtcttcaacacggcctccctgaccgtctctggcctccagactgaggacgaggctgattattactgccactcatatagaagtagtactactcctgtggttttcggcggagggaccaagctgaccgtcctaggtcagcccaaggctgccccctggtcactctgttcccaccctcctcgctacgtagactgagcgggctggcaaggcgcatagnnnnnnn

SEQ ID NO: 203171 - DNA, 301 bp, Homo sapiens
  misc_feature: GYAE6OF01D93E0.15.57.F02.1.454.CMB.1.raw
  modified_base (299)..(301): a, c, t, g, unknown or other
  misc_feature (299)..(301): n is a, c, g, or t
tcagtctacgtagccacgaccggtgctcgatttagctcgatatagttgggtttgggatgagaacctatgaacattctgtagggccactgtcttcaacacggcctccctgaccgtctctggcctccagactgaggacgaggctgattattactgccactcatatagaagtagtactactcctgtggttttcggcggagggaccaagctgaccgtcctaggtcagcccaaggctgccccctggtcactctgttcccgccctcctcgctacgtagactgagcgggctggcaaggcgcatagnnn

SEQ ID NO: 203172 - DNA, 575 bp, Homo sapiens
  misc_feature: GYAE6OF01DTK57.15.57.F02.1.454.CMB.1.raw
  modified_base (250)..(250): a, c, t, g, unknown or other
  misc_feature (250)..(250): n is a, c, g, or t
  modified_base (312)..(312): a, c, t, g, unknown or other
  misc_feature (312)..(312): n is a, c, g, or t
  modified_base (320)..(320): a, c, t, g, unknown or other
  misc_feature (320)..(320): n is a, c, g, or t
  modified_base (443)..(443): a, c, t, g, unknown or other
  misc_feature (443)..(443): n is a, c, g, or t
tcagtctacgtagccacgaccggtgctcgatttagctcgatatagttgggtttgggggggtctcaggaggcagcgctctcaggacatctccaccatcggcctgggctctgctgctcctcaccctcctcactcagggcacagggtcctgggcccagtctgccctgactcacgcctgcctccgtgtcgtgggtctccgtggacagtcgatcaaccatcctccgtgacactggaaaccacattgacgttggtntacttataactttgtctcctggtaccaacaacacccaggcaaacgccccaaatcatcattangaagtctntaagcgcctcagggtactactaatcgcttactcaggctccaagtctggacaacgtacggcctcctgaccgtctcgtggccctcacgactgagacgtaggctagacgttatactgccatcatanagtaagtagtactactccgtgttggtttcggacggtacggacgaacgcgtacggtaaccgtccgttaggcgacggacccgaaacggtccttaccggcccccgttacgggtcctaaccgtcgtttcccccggg

SEQ ID NO: 203173 - DNA, 248 bp, Homo sapiens
  misc_feature: GYAE6OF01C2KRV.15.57.F02.1.454.CMB.1.raw
  modified_base (248)..(248): a, c, t, g, unknown or other
  misc_feature (248)..(248): n is a, c, g, or t
tcagtctacgtagccacgaccggtgctcgatttagctcgatatagttgggtttgggggtgtggtggtctccactcccgccttgacgaggctgattattactgccactcatatagaagtagtactactcctgtggttttcggcggagggaccaagctgaccgtcctaggtcagcccaaggctgccccctcggtcactctgttcccgccctcctcgctcgtagactgagcgggctggcaaggcgcatagn

SEQ ID NO: 203174 - DNA, 249 bp, Homo sapiens
  misc_feature: GYAE6OF01C6NTY.15.57.F02.1.454.CMB.1.raw
  modified_base (249)..(249): a, c, t, g, unknown or other
  misc_feature (249)..(249): n is a, c, g, or t
tcagtctacgtagccacgaccggtgctcgatttagctcgatatagttgggtttgggggtgtggtggtctccactcccgccttgacgaggctgattattactgccactcatatagaagtagtactactcctgtggttttcggcggagggaccaagctgaccgtcctaggtcagcccaaggctgccccctcggtcactctgttcccgccctcctcgctacgtagactgagcgggctggcaaggcgcatagn

SEQ ID NO: 203175 - DNA, 523 bp, Homo sapiens
  misc_feature: GYAE6OF01BXO5O.15.57.F02.1.454.CMB.1.raw
tcagtctacgtagccacgaccggtgctcgatttagctcgatatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagcccccaaatcatcatttatgaagtctctaagcggccctcaggggtatctaatcgcttctctggctccaagtctggcaacacggcctccctgaccgtctctggcctccagactgaggacgaggctgattatactgccactcatatagaagtagtactactcctgtggttttcggcggaggaccaagctgaccgtctaggtcagcccaaggctcgcccctcgtcactctcgttcccaccctcctcgctacgtacgactgacgcggctggcgaggcg

SEQ ID NO: 203176 - DNA, 524 bp, Homo sapiens
  misc_feature: GYAE6OF01CQHP3.15.57.F02.1.454.CMB.1.raw
  modified_base (268)..(268): a, c, t, g, unknown or other
  misc_feature (268)..(268): n is a, c, g, or t
  modified_base (514)..(515): a, c, t, g, unknown or other
  misc_feature (514)..(515): n is a, c, g, or t
tcagtctacgtagccacgaccggtgctcgatttagctcgatatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagcccccaaatcatcatttangaagtctctaagcggccctcaggggtatctaatcgcttctctggctccaagtctggcaacacggcctccctgacccgtctctggcctccagactgaggacaggctgattattactgccactcattatagaagtagtactactcctgtggttttcggcggtaggaccaagctgaccgtcctaggtcagcccaggctcgcccctggtcactctcgttccccgcctcctcgctacgtgactgacgcggnnggcaaggcg

SEQ ID NO: 203177 - DNA, 527 bp, Homo sapiens
  misc_feature: GYAE6OF01EUUH9.15.57.F02.1.454.CMB.1.raw
tcagtctacgtagccacgaccggtgctcgatttagctcgatatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagcccccaaactcatcatttatgaagtctctaagcggccctcaggggtatctaatcgcttctctggctccaagtctggcaacacggcctccctgaccgtctctggcctccagactgaggacgaggctgattattactgccactcatatagaagtagtactactcctgtggttttcggcggagggaccaagctgaccgtcctaggtcagcccaaggctcgccccctcggtcactctcgttcccaccctcctcgctcgtagactgacgcgggctggcaggcg

SEQ ID NO: 203178 - DNA, 308 bp, Homo sapiens
  misc_feature: GYAE6OF01EWICQ.15.57.F02.1.454.CMB.1.raw
  modified_base (300)..(308): a, c, t, g, unknown or other
  misc_feature (300)..(308): n is a, c, g, or t
tcagtctacgtagccacgaccggtgctcgatttagctcgatatagttgggtttgggatgagaacctatgaacattctgtaggggccactgtcttcaacacggcctccctgaccgtctctggcctccagactgaggacgaggctgattattactgccactcatatagaagtagtactactcctgtggttttcggcggagggaccaagctgaccgtcctaggtcagcccaaggctgccccctggtcactctgttcccaccctcctcgctacgtagactgagcgggctggcaaggcgcatagnnnnnnnnn

SEQ ID NO: 203179 - DNA, 531 bp, Homo sapiens
  misc_feature: GYAE6OF01ESORY.15.57.F02.1.454.CMB.1.raw
tcagtctacgtagccacgaccggtgctcgatttagctcgatatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagccccaaactcatcatttatgaagtctctaagcggccctcaggggtatctaatcgcttctctggctccaagtctggcaacacggcctcctgaccgtctctggcctcagactgaggacgaggctgattattactgccactcatatagaagtagtactactcctgtggttttcggcggagggaccaagctgaccgtctaggtcagcccaaggctcgccccctcggtccactctcgttccccaccctccctcgcctacgtacgactgacgcgggctcggcaaggcg

SEQ ID NO: 203180 - DNA, 552 bp, Homo sapiens
  misc_feature: GYAE6OF01A1AAD.15.57.F02.1.454.CMB.1.raw
  modified_base (168)..(168): a, c, t, g, unknown or other
  misc_feature (168)..(168): n is a, c, g, or t
  modified_base (244)..(244): a, c, t, g, unknown or other
  misc_feature (244)..(244): n is a, c, g, or t
tcagtctacgtagccacgaccggtgctcgatttagctcgatatagttgggtttgggggggtctcaggaggcagcgctctcaggacatctccaccatggcctgggctctgctgctccgtcaccctcctcactcagggcacagggtcctgggcccagtctgccctgactnagcctgcctccgtgtctgggtctcctggacagtcgatcaccatctcctgcactggaaccaatagttgacgttggtnattataactttgtctcctgtaccaacaacaccaggcaaagcccccaaaactcatcatttatgaaagtctactaagcggcctcaggggtatctaatcgtcttctctaggctccaagtctggacaacacggcctcctgaccgtctctcggcctcagactgacgacgagtctgattattactcgaccactcatactagaagtatactactcctgttggtttcgcggaggtaccgaagtcgtacgtaccgtccgttaggtccacgacccgaaaggccgtccgccccccgttaggtccaccttcgttaccccg

SEQ ID NO: 203181 - DNA, 530 bp, Homo sapiens
  misc_feature: GYAE6OF01D9XGC.15.57.F02.1.454.CMB.1.raw
  modified_base (497)..(497): a, c, t, g, unknown or other
  misc_feature (497)..(497): n is a, c, g, or t
  modified_base (509)..(509): a, c, t, g, unknown or other
  misc_feature (509)..(509): n is a, c, g, or t
tcagtctacgtagccacgaccggtgctcgatttagctcgatatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaacgccccaaaactcatcatttatgaagtctctaagcggccctcaggggtatctaatcgcttctctggctccaagtctggcaacacggcctccctgacccgtctctcggcctccagactgaggacgaggctgattattactgccactcatatagaagtagtactactctgtgtttcggcggaggacagctgaccgtctaggtcacgcccaaggcctcgccccgtcgtcactcgtcgtcccgcccgtcctcnctacgtacgacncgacgcggctcggcagggccg

SEQ ID NO: 203182 - DNA, 529 bp, Homo sapiens
  misc_feature: GYAE6OF01BV3Y2.15.57.F02.1.454.CMB.1.raw
  modified_base (520)..(520): a, c, t, g, unknown or other
  misc_feature (520)..(520): n is a, c, g, or t
tcagtctacgtagccacgaccggtgctcgatttagctcgatatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagcccccaaactcatcatttatgaagtctctaagcggccctcaggggtatctaatcgcttctctggctccaagtctggcaacacggcctccctgaccgtctctggcctccagactgaggacgaggctgattattactgccactcatatagaagtagtactactcctgtggttttcggcggaggaccgaagctgaccgtcctaggtcagccaaggctcgcccctcggtccactctcgttcccaccctcctcgctacgtacgactcgacgcggcnggcgaggcg

SEQ ID NO: 203183 - DNA, 304 bp, Homo sapiens
  misc_feature: GYAE6OF01CNN10.15.57.F02.1.454.CMB.1.raw
  modified_base (301)..(304): a, c, t, g, unknown or other
  misc_feature (301)..(304): n is a, c, g, or t
tcagtctacgtagccacgaccggtgctcgatttagctcgatatagttgggtttgggatgagaacctatgaacattctgtaggggccactgtcttcaacacggcctccctgaccgtctctggcctccagactgaggacgaggctgattattactgccactcatatagaagtagtactactcctgtggttttcggcggagggaccaagctgaccgtcctaggtcagcccaaggctgccccctcggtcactctgttcccgccctcctcgctacgtagactgagcgggctggcaaggcgcatagnnnn

SEQ ID NO: 203184 - DNA, 527 bp, Homo sapiens
  misc_feature: GYAE6OF01AUL0J.15.57.F02.1.454.CMB.1.raw
  modified_base (474)..(474): a, c, t, g, unknown or other
  misc_feature (474)..(474): n is a, c, g, or t
tcagtctacgtagccacgaccggtgctcgatttagctcgatatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagcccccaaactcatcatttatgaagtctctaagcggccctcaggggtatctaatcgcttctctggctccaagtctggcaacacggcctccctgaccgtctctggcctccagactgaggacgaggctgattattactgccactcatatagaagtagtactactctgtggtttcggcggagggaccagctgaccgtctaggtcagcccaaggcctcgcccctcggtcnctctcgttcccgccctcctcgctacgtacgactgacgcgggctcggcgaggcg

SEQ ID NO: 203185 - DNA, 565 bp, Homo sapiens
  misc_feature: GYAE6OF01CMT47.15.57.F02.1.454.CMB.1.raw
  modified_base (347)..(347): a, c, t, g, unknown or other
  misc_feature (347)..(347): n is a, c, g, or t
tcagtctacgtagccacgaccggtgctcgatttagctcgatatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacaccaggcaaagccccaaatcatcatttatgaagtctctaagcggccctcaggggtatctaatcgcttctctggctcaagtctggcaacacggcctccgtcgaccgtctcncggcctcgagactgaggacgagctagtattatactgccactcatatagaagtagtactactcctgtggtttcggcggtaggacagctagaccgtcgtagtcacgtacccgaggtcctcgccccctcggtaccaccgttccgtccgttccccctacccgttcccgtacccgaccgttacggtacgtacgtcggtacggccgggcgtcggcgaacggccg

SEQ ID NO: 203186 - DNA, 844 bp, Homo sapiens
  misc_feature: GYAE6OF01D3W0T.15.57.F02.1.454.CMB.1.raw
tcagtctacgtagccacgaccggtgctcgatttagctcgatatagttgggtttggggggggtctcaggaggcagcgctctcaggacatctccaccatggcctgggctctgctgctcctcaccctcctcactcagggcacagggtcctgggcccagtctgcccctgactcacgcctgccctcgtgtcgtgggtctccgtggacagtcgatccaccatcctcctgaccacgtacggaaacccaactagttcggacggtttggtagtaatttaacttaaacttttcgttccttcccgttacggtaacccaaaccaaaccaacccgaacggaccaaaaccgaccccccaaaactcaactactaatttagtagtaacgttcctacgtaacggcccggtccccgtacggaaggggttactaccttaacgtccgtctttcctcgtcggtcctaccgtaagtcgtacggaccaacgaccggtcccctcccgtacgtacccgttcctcgtccgtcccctaccgaacgtacgtagggaacgggacgtacggtcgttagttaacttttaacgtttacctaccgtaccctaaccgttactaacgttaaagttaaacggtaaacgtttaaccgttaacccgttttaaccctttcccggttttaggggtttttaccgggggtttttaccgggggaccggggttaaaccggggtaaaccccgtaaaggtcccgttaccggtaaccccgggtttaccggttaaccgggttaccgaacccggtaccccggaaacggtccccgttaccccggtacccccccgtttaccgggtccccttacccgttcccgtttcccccccggg

SEQ ID NO: 203187 - DNA, 524 bp, Homo sapiens
  misc_feature: GYAE6OF01CLA1O.15.57.F02.1.454.CMB.1.raw
tcagtctacgtagccacgaccggtgctcgatttagctcgatatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagcccccaaactcatcatttatgaagtctctaagcggccctcaggggtatctaatcgcttctctggctccaagtctggcaacacggcctccctgacccgtctctggcctccagactgaggacgaggctgattattactgccactcatatagaagtagtactactcctgtggtttcggcggaggaccaagctgaccgtctaggtcagcccaaggctgcccctcggtcactctcgttcccgccctctcgctacgtacgactgacgcgggctggcaggcg

SEQ ID NO: 203188 - DNA, 515 bp, Homo sapiens
  misc_feature: GYAE6OF01EC1W5.15.57.F02.1.454.CMB.1.raw
  modified_base (303)..(303): a, c, t, g, unknown or other
  misc_feature (303)..(303): n is a, c, g, or t
  modified_base (460)..(460): a, c, t, g, unknown or other
  misc_feature (460)..(460): n is a, c, g, or t
  modified_base (506)..(506): a, c, t, g, unknown or other
  misc_feature (506)..(506): n is a, c, g, or t
tcagtctacgtagccacgaccggtgctcgatttagctcgatatagttgggtttgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccaacattgacgtttggtgattataactttgtctcctggtaccaacaacaccaggcaaagccccaaactcatcatttangaagtctctaagcggccctcagggtatctaatcgcttctctggctccaagtctggcaacacggcctccctgaccgtctctggccctccagctgaggacgaggctagattattactcgccactacatatagaagtagtactactctgttggtttcggnggaggacagctgaccgtcgtagtcacgcccgagctcgcccctgtcnctcgtcccg

SEQ ID NO: 203189 - DNA, 519 bp, Homo sapiens
  misc_feature: GYAE6OF01CC9ZJ.15.57.F02.1.454.CMB.1.raw
  modified_base (287)..(287): a, c, t, g, unknown or other
  misc_feature (287)..(287): n is a, c, g, or t
tcagtctacgtagccacgaccggtgctcgatttagctcgatatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagccccaaatcatcatttatgaagtctctaagcggccctnaggggtatctaatcgcttctctggctccaagtctggcaacacggcctcctgaccgtctctggcctcagactgagacgaggctgattatactgccactcatatagaagtagtactactctgttggtttcggcggaggacaagctgaccgtcagtcacgcccgaagctcgcccctcgtcactctcgttcccaccctcctcgctacgtacgacgtgacgcgggctcggcgaggcg

SEQ ID NO: 203190 - DNA, 520 bp, Homo sapiens
  misc_feature: GYAE6OF01C3M10.15.57.F02.1.454.CMB.1.raw
  modified_base (384)..(384): a, c, t, g, unknown or other
  misc_feature (384)..(384): n is a, c, g, or t
  modified_base (397)..(397): a, c, t, g, unknown or other
  misc_feature (397)..(397): n is a, c, g, or t
tcagtctacgtagccacgaccggtgctcgatttagctcgatatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagccccaaatcatcatttatgaagtctctaagcggccctcacggggtatctaatcgcttctctggctccaagtctggcaacacggcctccctcgaccgtctctggcctccagactgaggacgtaggctgattatacngccactcatatanaagtagtactactactgtggttttcggcggagggaccaagctgaccgtctagtcagccaagctgcccctcgcactctcgttcccgccctcctccgctacgagactgacgcgggctggcaggcg

SEQ ID NO: 203191 - DNA, 533 bp, Homo sapiens
  misc_feature: GYAE6OF01EIEA9.15.57.F02.1.454.CMB.1.raw
  modified_base (229)..(229): a, c, t, g, unknown or other
  misc_feature (229)..(229): n is a, c, g, or t
  modified_base (242)..(242): a, c, t, g, unknown or other
  misc_feature (242)..(242): n is a, c, g, or t
tcagtctacgtagccacgaccggtgctcgatttagctcgatatagttgggtttgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccaanttgacgtttggtnattataactttgtctcctggtaccaacaacaccaggcaaacgcccccaaactcatcatttatgaagtctctaagcggccctgagggtatctaatcgcttctctggctccaagtctggcaacacggcctccctgacccgttctcgtggccctccagactgaggacgagctgattattattgccactcatatagaagtagtactacttccgttagttcggtttcggcggaggacgaagctacgacccgtcgtaggcacggcccaaggcgtccgcccctggtccacgtctcccg

SEQ ID NO: 203192 - DNA, 531 bp, Homo sapiens
  misc_feature: GYAE6OF01AV0U6.15.57.F02.1.454.CMB.1.raw
tcagtctacgtagccacgaccggtgctcgatttagctcgatatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacaccccaggcaaagcccccaaatcatcatttatgaagtctctaagcggccctcagggggtatctaatcgcttctctggctccaagtctggcaacacggcctcctgaccgtctctggcctccagactgagcgagctgattattactgccactcatatagaagtagtactactcctgtgttttcggcgagggaccaagctgaccgtctaggtcagcccgaaggctacgcccccgtcggtccactcctcgttcccgcccgtcctcgctccgtagactgacgcgggctggcgaggtccg

SEQ ID NO: 203193 - DNA, 546 bp, Homo sapiens
  misc_feature: GYAE6OF01AIID6.15.57.F02.1.454.CMB.1.raw
  modified_base (300)..(300): a, c, t, g, unknown or other
  misc_feature (300)..(300): n is a, c, g, or t
tcagtctacgtagccacgaccggtgctcgatttagctcgatatagttgggtttgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctctggtaccaacaacaccaggcaaagccccaaactcatcattangaagtctactaagcgccctcgagggtatctaatcgtcttctctggctcaagtctgacaacaccgcctcctcgaccgtctctcggcctccgagactggacggacgaggcttagattattactcgacctactcatataagtaagtatactactccgttggttggtttcggacggacggacagtccgtacgaccgtcgtaggtcgacgacccgaaggcctaccggccccctggtcctcgtcgttcccgg

SEQ ID NO: 203194 - DNA, 592 bp, Homo sapiens
  misc_feature: GYAE6OF01DW1BH.15.57.F02.1.454.CMB.1.raw
  modified_base (305)..(305): a, c, t, g, unknown or other
  misc_feature (305)..(305): n is a, c, g, or t
  modified_base (360)..(360): a, c, t, g, unknown or other
  misc_feature (360)..(360): n is a, c, g, or t
tcagtctacgtagccacgaccggtgctcgatttagctcgatatagttgggtttgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccaacattgacgttgatgattataactttgtctcctggtaccaacaacaccaggcaaacgcccccaaactcatctatttangagtctctaagcgcctgagggtatctaatcgcttctctggctcaagtctgcaacncggcctcctgaccgtctctcgcctccagtactggacggacgaggtctgaatttattactcgaccctactcaataagtaagtaaagttacgtaaccttacgttaccgttggttcgggttttcgggacgggtaacggggtaccaaaggtccgtacggtacccggttcgttaacggttccgaccggtacccgaaacgggtcctaccggaccccccgttcggtcctacgttcccgg

SEQ ID NO: 203195 - DNA, 638 bp, Homo sapiens
  misc_feature: GYAE6OF01AD1RF.15.57.F02.1.454.CMB.1.raw
  modified_base (350)..(350): a, c, t, g, unknown or other
  misc_feature (350)..(350): n is a, c, g, or t
tcagtctacgtagccacgaccggtgctcgatttagctcgatatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattatactttgtctcctgtaaccaacaacacccaggaccaaacgccccaaatcatctaattactgaagtctactaagccggccctgagggtatctaatcgtcttctctggctcctaagtctcggacaaccacggtcctcccgngacccgtctcgtacggcctccagtactggaggacgaggctagtaatttacgtactgaccctactactaagtaataagtaagttaccgtattaaccctcgtttggttcgggttttccgggacgggacggtaccgaacgtcgtacggacccgttcgtacggtaccacggacccgaacggtccctcccggtccccctcggtaccctcttcccgttcccgttccccgcccttccgttcgaaccgttccggtacgacgttcggagggtcccgggactcgggacgtaggaccgg

SEQ ID NO: 203196 - DNA, 519 bp, Homo sapiens
  misc_feature: GYAE6OF01D950L.15.57.F02.1.454.CMB.1.raw
tcagtctacgtagccacgaccggtgctcgatttagctcgatatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagcccccaaatcatcatttatgaagtctctaagcggccctcaggggtatctaatcgcttctctggctccaagtctggcaacacggcctcctgaccgtctctggcctcagactgaggacgaggctgattatactgccactcatatagaagtagtactaactctgtggttttcggcggtagggaccaagctgaccgtcctaggtcagcccaaggctgcccctggtcactctcgtcccacctcctcgctcgtactgacgcggctggcaggcgacg

SEQ ID NO: 203197 - DNA, 528 bp, Homo sapiens
  misc_feature: GYAE6OF01DJFRG.15.57.F02.1.454.CMB.1.raw
tcagtctacgtagccacgaccggtgctcgatttagctcgatatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagcccccaaatcatcatttatgaagtctctaagcggccctcaggggtatctaatcgcttctctggctccaagtctggcaacacggcctccctgaccgtctctggcctccagactgaggacgaggctgattattactgccactcatatagagtatactactctgttggtttcggcggaggacagctgaccgtcgtacgtcacgcccaaggctcgcccctcggtcacctctcgttccccacccgtcctcgcttacgacgactggacggcggctcggcgaggcg

SEQ ID NO: 203198 - DNA, 620 bp, Homo sapiens
  misc_feature: GYAE6OF01E37P6.15.57.F02.1.454.CMB.1.raw
  modified_base (231)..(231): a, c, t, g, unknown or other
  misc_feature (231)..(231): n is a, c, g, or t
  modified_base (244)..(244): a, c, t, g, unknown or other
  misc_feature (244)..(244): n is a, c, g, or t
  modified_base (408)..(408): a, c, t, g, unknown or other
  misc_feature (408)..(408): n is a, c, g, or t
tcagtctacgtagccacgaccggtgctcgatttagctcgatatagttgggtttggggggggtctcaggaggcagcgctctcaggacatctccaccatggcctgggctctgctgctcctcaccctcctcactcagggcacagggtcctgggcccagtctgccctgactcagcctgcctccgtgtctgggtctccgtggacagtcgatcaccatctcctgcactaggaaccanattgacgttggtnattataattgtctcctgtaccaacaacacccaggcaaacgcccccaaactcatactatttatgaagtctactaacgccgtccctcgagggtatctaatcgtcttctctgctaccagtctcgacaacaccggccctcccgtcgaccgtctcgtcggtccctaccncgactggacggacgaggctagattattacctcgaccactacaatagtaagtaagttaagtacttacgtcgtttcggttggttttccgggacgggtaacgggaccgtaacgtcgtacggtacccggttccgtaagggtccgaccgtaccccgaaacggtcccgttacccggtcccccccgttaccgggtccctacccgttccgttacccccgg

SEQ ID NO: 203199 - DNA, 519 bp, Homo sapiens
  misc_feature: GYAE6OF01BPJYB.15.57.F02.1.454.CMB.1.raw
tcagtctacgtagccacgaccggtgctcgatttagctcgatatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaaccaacattgacgttgtgattataactttgtctcctggtaccaacaacacccaggcaaacgccccaaactcatcatttatgaagtctctaagcggccctcaggggtatctaatcgcttctctggctcaagtctggcaacacggcctcctgacgtctctggcctcagactgaggacgaggctgattattactgccatcatatagaagtagtactactctgtcggtttcgcggaggaccagctgcctctagtcagcccaagctcgcccctgcactctcgtcccgcctccgtctacgtcgtacgtacgtggacgtcgggcgtcggcgtacggcg

SEQ ID NO: 203200 - DNA, 574 bp, Homo sapiens
  misc_feature: GYAE6OF01DOT54.15.57.F02.1.454.CMB.1.raw
  modified_base (257)..(257): a, c, t, g, unknown or other
  misc_feature (257)..(257): n is a, c, g, or t
  modified_base (341)..(341): a, c, t, g, unknown or other
  misc_feature (341)..(341): n is a, c, g, or t
  modified_base (360)..(360): a, c, t, g, unknown or other
  misc_feature (360)..(360): n is a, c, g, or t
  modified_base (387)..(387): a, c, t, g, unknown or other
  misc_feature (387)..(387): n is a, c, g, or t
tcagtctacgtagccacgaccggtgctcgatttagctcgatatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataacttttgtctcctggtaccaacaacacccagcaaagccccaaancatcattatgaagtctctaagcgccctcgagggtatctaatcgcttctctggctccgaagtctggcaaacacgggcccttccgngaccgtctctggccctcanacgtgaagcgaggctgtatttatttcnggcggctcatagtgagactaattacagtctttgtcttacgagtggacaagtcacgtcgtaatcaacgccgtaacgcccaaccccagtcgtcaaccgttcctcgttacccctaccccgttccctacgtaccgttaccgtaacgcgttacggacgggccgggtacgttcgggacccgaagggtacccgg

SEQ ID NO: 203201 - DNA, 250 bp, Homo sapiens
  misc_feature: GYAE6OF01A5ZWH.15.57.F02.1.454.CMB.1.raw
  modified_base (249)..(250): a, c, t, g, unknown or other
  misc_feature (249)..(250): n is a, c, g, or t
tcagtctacgtagccacgaccggtgctcgatttagctcgatatagttgggtttgggggtgtggtggtctccactcccgccttgacgaggctgattattactgccactcatatagaagtagtactactcctgtggttttcggcggagggaccaagctgaccgtcctaggtcagcccaaggctgccccctcggtcactctgttcccgccctcctcgctacgtagactgagcgggctggcaaggcgcatagnn

SEQ ID NO: 203202 - DNA, 572 bp, Homo sapiens
  misc_feature: GYAE6OF01BKE2Q.15.57.F02.1.454.CMB.1.raw
tcagtctacgtagccacgaccggtgctcgatttagctcgatatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagcccccaaactcatcatttatgaagtctactaagcggccctcgaggggtatctaatcgcttctctggcctcaagtctggcaacgaccggcctccctgacccgtctctcggcctccgagactggaggacgaggtctagtattattactcgccactcaatataagtaagtagtactactcgttgttgggtttcggcggaggaccagctcgaccgtcgtaggtcacgccaaggcctccgtccccgtcggtacctactccgttccgttccccgccctcccgtcgccttacgtacgaccgtcggacggccgggtactcggcgagggccg

SEQ ID NO: 203203 - DNA, 585 bp, Homo sapiens
  misc_feature: GYAE6OF01CSZ9A.15.57.F02.1.454.CMB.1.raw
  modified_base (573)..(573): a, c, t, g, unknown or other
  misc_feature (573)..(573): n is a, c, g, or t
tcagtctacgtagccacgaccggtgctcgatttagctcgatatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctctggtaaccaacaacacccagcaaacgccccaatcatcatttatgaagtctctaagcggccctcgagggtatcgtaatcgcttcgtctcggctaccaagtctcggacaaccacggccctccgtcgaccgtctctggccctcagactggacggacgaggtctgtatttatactcgacctactcatagtaagaagtactactactctggttaggtttcggacggtaggaccaagcgtacgaccgtcgtacgtcacggcccgaagctaccgccccgtcgtctacctcgtccgttaccctaccctccgtccgtaccgtaacgttacgacttacggacgggtacggtccgtacggnggacggtacccg

SEQ ID NO: 203204 - DNA, 546 bp, Homo sapiens
  misc_feature: GYAE6OF01BM4IX.15.57.F02.1.454.CMB.1.raw
tcagtctacgtagccacgaccggtgctcgatttagctcgatatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaacgccccaaactcatcatttatgaagtctctaagcggccctcaggggtatctaatcgcttctctggctccaagtctggcaacacggccctcctgaccgtctctcggcctccagactgaggacgagctgattattactgccactcatagtagaagttagtactactctgtcggttttcggcggaggacaagcgtagaccgtctagtcacgcctaacggctccgccccgtcggtcctactctcgttccccgcccgttcctcgcctcgtacgaccttacggacggcggcgtcggcgaggccg

SEQ ID NO: 203205 - DNA, 532 bp, Homo sapiens
  misc_feature: GYAE6OF01ADLLO.15.57.F02.1.454.CMB.1.raw
  modified_base (479)..(479): a, c, t, g, unknown or other
  misc_feature (479)..(479): n is a, c, g, or t
  modified_base (522)..(522): a, c, t, g, unknown or other
  misc_feature (522)..(522): n is a, c, g, or t
tcagtctacgtagccacgaccggtgctcgatttagctcgatatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaacgcccccaaactcatcatttatgaagtctctaagccggccctcaggggtatctaatcgcttctctggctccaagtctggcaacacggcctccctgacccgtctctcggcctccagactgagggacgaggcctgattatactgccactcatatagaagtagtactactcttgtggttttcggcggaggacagctcgaccgtcgtaggtcagcccagcctcgccccgtcgtcnctctcgttcccgccctcctcgcgtacgtgacgtcgacgcgggncggcgaggcg

SEQ ID NO: 203206 - DNA, 812 bp, Homo sapiens
  misc_feature: GYAE6OF01C9Q7B.15.57.F02.1.454.CMB.1.raw
tcagtctacgtagccacgaccggtgctcgatttagctcgatatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactaggaaccaacattgacgttggtgattataactttgtctctgtaaccaacaacaccaggaccaaacgcccccaaatcatacatttatgaagtctactaacggccggtccctacgtaaggggtactacttaactcgtcttctcgtcggtcctaccgtaagttccgtacggaccaaacccgaccggtccccttcccgtacggtacccgttcctaccgtcggacccttaccgaacggtaccgtaggaacgggacggacggtactacggtaatttacgttacctacgtaccctacgtactaataacgttaaggtaaacgttaacgttaaccttaaccgtttccgtttacgggtttacggggttttaccggggaccggggtaaccggggtaacctaacgggtcccgttacggtaaccccggttaccggttaaccggttaccgaaccggtaccccggtaaccgggcccgttaccccggtaccccccggttaccgggttacccttaacccgtttcccgttacccccgggttcccccgttccccccgttccccgttacccggtacccgttaacccgggtaaccggtaccggtacggtaccgggtcccgggtacggtcgggaccgtacgggacccgg

SEQ ID NO: 203207 - DNA, 541 bp, Homo sapiens
  misc_feature: GYAE6OF01DAK5Y.15.57.F02.1.454.CMB.1.raw
  modified_base (269)..(269): a, c, t, g, unknown or other
  misc_feature (269)..(269): n is a, c, g, or t
  modified_base (276)..(276): a, c, t, g, unknown or other
  misc_feature (276)..(276): n is a, c, g, or t
  modified_base (491)..(491): a, c, t, g, unknown or other
  misc_feature (491)..(491): n is a, c, g, or t
  modified_base (531)..(531): a, c, t, g, unknown or other
  misc_feature (531)..(531): n is a, c, g, or t
  modified_base (537)..(537): a, c, t, g, unknown or other
  misc_feature (537)..(537): n is a, c, g, or t
tcagtctacgtagccacgaccggtgctcgatttagctcgatatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgatttataactttgtctcctggtaccaacaacacccaggcaaacgccccaactcatcatttangaagtcnctaagccggcctcgagggtatctaatccgcttctctggcctccaagtctcggacaacgacggccctccctgaccgtctctggccctacccgagactcggaggacggaggctgagtttattactgccactcaatatagaagtagtactacttctgttggtttcggcggacggaccagcgtcgaccgtcgtagtcacgccgagcctcgcccctgtcnctcgtcgtcccgcctcctcgctacgtacgcgtgacgcggncggcgnggcg

SEQ ID NO: 203208 - DNA, 253 bp, Homo sapiens
  misc_feature: GYAE6OF01DMK5U.15.57.F02.1.454.CMB.1.raw
  modified_base (249)..(253): a, c, t, g, unknown or other
  misc_feature (249)..(253): n is a, c, g, or t
tcagtctacgtagccacgaccggtgctcgatttagctcgatatagttgggtttggggggtgtggtggtctccactcccgccttgacgaggctgattattactgccactcatatagaagtagtactactcctgtggttttcggcggagggaccaagctgaccgtcctaggtcagcccaaggctgccccctggtcactctgttcccgccctcctcgctacgtagactgagcgggctggcaaggcgcatagnnnnn

SEQ ID NO: 203209 - DNA, 567 bp, Homo sapiens
  misc_feature: GYAE6OF01BMV5Y.15.57.F02.1.454.CMB.1.raw
tcagtctacgtagccacgaccggtgctcgatttagctcgatatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagccccaaactcatcatttatgaagtctctaagcggccctcaggggtatctaatcgcttctctggctcaagtctgcaacacggcctcctgaccgtctctcggcctccagactgacggacgagctgattatactgccactcatatagaagtagtactactcgtgttggtttcggcggaggacagctgaccgtctacgtcgacgacccgaacggcctcgtcccccgtcggttccaccttccttcgttccccctaccccgttcccgtcccgaccgttaccgtacggtacctggacggtcgggaccgtcggccgaacgggtccg

SEQ ID NO: 203210 - DNA, 308 bp, Homo sapiens
  misc_feature: GYAE6OF01DEGH1.15.57.F02.1.454.CMB.1.raw
  modified_base (298)..(298): a, c, t, g, unknown or other
  misc_feature (298)..(298): n is a, c, g, or t
  modified_base (304)..(308): a, c, t, g, unknown or other
  misc_feature (304)..(308): n is a, c, g, or t
tcagtctacgtagccacgaccggtgctcgatttagctcgatatagttgggtttgggatgagaacctataaacattctgtaggggccactgtcttcaacacggcctccctgaccgtctctggcctccagactgaggacgaggctgattattactgccactcatatagaagtagtactactcctgtggttttcggcggagggaccaagctgaccgtcctaggtcagcccaaggctcgccccctcggtcactctcgttccccaccctcctcgctacgtagactgagcgggctggcaaggcncatagnnnnn

SEQ ID NO: 203211 - DNA, 686 bp, Homo sapiens
  misc_feature: GYAE6OF01CDFSO.15.57.F02.1.454.CMB.1.raw
  modified_base (273)..(273): a, c, t, g, unknown or other
  misc_feature (273)..(273): n is a, c, g, or t
tcagtctacgtagccacgaccggtgctcgatttagctcgatatagttgggtttgggggctttgcctgggctctgctgctcctcaccctcctcatcagggcacagggtcctgggcccagtctgccctgactcagcctgcctccgtgtctgggtctcctggacagtcgatcaccatctcctgcactggaaccaacattgacgttggtgattataactttgtctctgtaccaacaacaccagacaaacgccccaaatcatctatttatgaagtctntaacgcggtccctacgagggtatctaactcgtcttctctcgctaccaagttctcggaccaaaccgaccggtccctccgtcgacccgttctcgtcggcctcgagactggagacgaggctagtaatttactacgtcgacctactacaattaagtacggtaaattacgttaacctacgttcccgttggtttacgggttttccgggacgggaacgggtaacctaaggtcctacggtaccccggtacctttaagggacccgaaccggacccgtaacgggtccctcccgggttcccccgttacggtcccttaccgtccgtttcccgttcccccgccccgtttcccgtacccggtaccgtacccgggtaacgtaccgttagggaaccggtccgggtactcgggaccggtaacggacccgg

SEQ ID NO: 203212 - DNA, 536 bp, Homo sapiens
  misc_feature: GYAE6OF01B86XW.15.57.F02.1.454.CMB.1.raw
  modified_base (478)..(478): a, c, t, g, unknown or other
  misc_feature (478)..(478): n is a, c, g, or t
  modified_base (526)..(526): a, c, t, g, unknown or other
  misc_feature (526)..(526): n is a, c, g, or t
tcagtctacgtagccacgaccggtgctcgatttagctcgatatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagcccccaaatcatcatttatgaagtctctaagccggccctcgaggggtatctaatcgctttctctggctccaagtctggcaacacggcctccctgaccgtctctcggcctccagactgaggacgaggctgattattactgccactcatatagaagtagtactactcgtgtggtttcggcggaggaccagctgaccgtctggtcacgccgaaggcctcgcccctcgtaccnctcctcgttccccgtccctcctccgctcgtacgacgtcgacgcgggcncggcgaggcg

SEQ ID NO: 203213 - DNA, 527 bp, Homo sapiens
  misc_feature: GYAE6OF01E4YCT.15.57.F02.1.454.CMB.1.raw
  modified_base (491)..(491): a, c, t, g, unknown or other
  misc_feature (491)..(491): n is a, c, g, or t
  modified_base (507)..(507): a, c, t, g, unknown or other
  misc_feature (507)..(507): n is a, c, g, or t
  modified_base (519)..(519): a, c, t, g, unknown or other
  misc_feature (519)..(519): n is a, c, g, or t
tcagtctacgtagccacgaccggtgctcgatttagctcgatatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagcccccaaaactcatcatttatgaagtctctaagcggccctcaggggtatctaatcgcttctctggctccaagtctggcaacacggcctccctgaccgtctctggcctccagactgaggacgaggctgattattactgccactcatatagaagtagtactactcctgtggtttcgcggtagggaccaagctgaccgtctaggtcacgcccaaggctcgcccccgtcggtcactctcgtccccncctccctcgctcgtanactgacgcgggntggcaggc

SEQ ID NO: 203214 - DNA, 549 bp, Homo sapiens
  misc_feature: GYAE6OF01ELOXL.15.57.F02.1.454.CMB.1.raw
  modified_base (389)..(389): a, c, t, g, unknown or other
  misc_feature (389)..(389): n is a, c, g, or t
  modified_base (539)..(539): a, c, t, g, unknown or other
  misc_feature (539)..(539): n is a, c, g, or t
tcagtctacgtagccacgaccggtgctcgatttagctcgatatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctctggtaccaacaacacccaggacaaacgccccaaactcatcatttatgaagtctctaagcggccctgagggtatctaatcgcttctctcgctccaagtctggcaacgacgcctcctgaccgtctctcgcctcagactgaaggacgaggctagtatttacttacgtcnccgactcaatataagtaagtacgtactacttcgtgttcgggtttcggcggaggacagctacgaccgtcgtacggtcacgccaaggtcctcgcccctcggtcactcgttccgtccccacccgtcctacgctacgtcgactcgcggcggcgngcgaggtccg

SEQ ID NO: 203215 - DNA, 525 bp, Homo sapiens
  misc_feature: GYAE6OF01ETTJZ.15.57.F02.1.454.CMB.1.raw
tcagtctacgtagccacgaccggtgctcgatttagctcgatatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaacgccccaaactcatcatttatgaagtctctaagcggccctcaggggtatctaatcgcttctctggctccaagtctggcaacacggcctccctgaccgtctctcggcctccagactgaggacgaggctgattattactgccactcatatagaagtagtactactctgtggtttcggcggaggacagcgtgaccgtctaggtcacgccgaagcctcgcccctcgtcactctcgttcccgccctcctcgctcgacgtactgacgcggactggcgaggccg

SEQ ID NO: 203216 - DNA, 538 bp, Homo sapiens
  misc_feature: GYAE6OF01DA03Z.15.57.F02.1.454.CMB.1.raw
  modified_base (390)..(390): a, c, t, g, unknown or other
  misc_feature (390)..(390): n is a, c, g, or t
  modified_base (500)..(500): a, c, t, g, unknown or other
  misc_feature (500)..(500): n is a, c, g, or t
tcagtctacgtagccacgaccggtgctcgatttagctcgatatagttgggtttggggctttgcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctctgtaccaacaacaccagcaacgcccaaatcatcatttatgaagtctactaagccggcctcgagggtatctaatcgctttctctggctccaagtctggactaacacggccctccctcgaccgtctcgttcggccttaccagactgaggacgagggctgatttagttacngccactcatatagaagtagtactactcgtgtggtttcggcggaggacagctcgacgtctagtcacgaccgagcctcgccccgtcgcactcctccgtccctcccgtcctcncgtacgtacgactacggcggacggcgtggccgaggccg

SEQ ID NO: 203217 - DNA, 581 bp, Homo sapiens
  misc_feature: GYAE6OF01DBNS9.15.57.F02.1.454.CMB.1.raw
tcagtctacgtagccacgaccggtgctcgatttagctcgatatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctgtaccaacaacaccaggacaaacgccccaaatcatctatttatgaagtctctaagcggccctcgaggggtatctaatcgtcttctctggctccaagtctggacaacgaccgcctccctgaccgtctcgtcggcctccagtactggacggacgaggctgtagttattacgtcgccactcatataagaagttatactactctgttggtttcggcggacggaccagtcgtcgtaccgtcgtagtccgacgcccgaacgctccgtccccgtcggtcctaccttccgtccgttccccgtccctcccgtcgtaccgtaccggtacgtaccgtcggtacggccggcgtacggcgtaaggcccg

SEQ ID NO: 203218 - DNA, 535 bp, Homo sapiens
  misc_feature: GYAE6OF01DIU2D.15.57.F02.1.454.CMB.1.raw
  modified_base (208)..(208): a, c, t, g, unknown or other
  misc_feature (208)..(208): n is a, c, g, or t
  modified_base (270)..(270): a, c, t, g, unknown or other
  misc_feature (270)..(270): n is a, c, g, or t
  modified_base (290)..(290): a, c, t, g, unknown or other
  misc_feature (290)..(290): n is a, c, g, or t
  modified_base (521)..(521): a, c, t, g, unknown or other
  misc_feature (521)..(521): n is a, c, g, or t
tcagtctacgtagccacgaccggtgctcgatttagctcgatatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaaccaacattgacgttgggtnatttataactttgtctcctggtaccaacaacacccaggcaaagcccccaaatcatcatttangaagtctctaagcggccctnagggtatctaatcgcttctctggctccaagtctggcaacacggcctcccgtgaccgtctctggcctcagactgaggacgaggctgattagttactgccatcataatagaagtagtactactccttagttggttttcggcggaggaccaaggctcgaccgtctaaggtcacgccaagctcgcccctggccactctcgttcccgccctccgtcgcttacgagctgacggcggntcggcgtaaggccg

SEQ ID NO: 203219 - DNA, 617 bp, Homo sapiens
  misc_feature: GYAE6OF01B39VY.15.57.F02.1.454.CMB.1.raw
  modified_base (610)..(610): a, c, t, g, unknown or other
  misc_feature (610)..(610): n is a, c, g, or t
tcagtctacgtagccacgaccggtgctcgatttagctcgatatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacaccaggacaacgccccaactcatcatttatgaagtctctaagcggccctcgaggggtatctaatcgcttctctcgctcaagtctggcaacacggccctcctcgaccgtctctcggcctccgacgtactacggagggacgacgggtctagtactttacttacgtcgccgtacctctaataagtaagtaaaggtacgttaactaccgttccgttgggttcggggttttaccgggacgggacgggtaccgacggtcttacgacccgtcgtacggtcacggacccgaacggtccttccgccccgtcggtcctaccgtcttcccgttccccgcccgttccgtcgcgtacgtcgacgtcggacggtcgggctcgggcgngggaccg

SEQ ID NO: 203220 - DNA, 703 bp, Homo sapiens
  misc_feature: GYAE6OF01EDXQY.15.57.F02.1.454.CMB.1.raw
tcagtctacgtagccacgaccggtgctcgatttagctcgatatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactaggaaccaacattgacgttggtgattataactttgtctcctaggtaccaacaacacccaggacaacgaccccaaactcatctattatgaagtctctaagcgccctcgagggtatctaatcgtcttctcgtggctccagtctggacaaccgcgccctcctcgaccgtctcgtcggcctccgagactggaggaccggagtctagtaacttacttacgtcgtcctactactaacttaataagtaaacgttaacgttaacttaccttccgtttagggtttcggggtttttaccgggacggggtaacgggtaaacccgaaggtaccgtaccggtaacccgttccgtacggtacccggtaacgacccgtacggtacccgtcccggtacccccgtcggttaccctaccgttcccgttcccggttcccccgtcccgttccccgttcccggtacccgttaaccgggttaaccggtaccggttacgggaccgggacgggtaccgtcggggtacggaaccgggtaccgg

SEQ ID NO: 203221 - DNA, 310 bp, Homo sapiens
  misc_feature: GYAE6OF01DDBAI.15.57.F02.1.454.CMB.1.raw
  modified_base (304)..(310): a, c, t, g, unknown or other
  misc_feature (304)..(310): n is a, c, g, or t
tcagtctacgtagccacgaccggtgctcgatttagctcgatatagttgggtttgggatgagaacctatgaacattctgtaggggccactgtcttcaacacggcctccctgaccgtctctggcctccagactgaggacgaggctgattattactgccactcatatagaagtagtactactcctgtggttttcggcggagggaccaagctgaccgtcctaggtcagcccaaggcctgccccctcggtcactctcgttccccaccctcctcgctacgtagactgagcgggctggcaaggcgcatagnnnnnnn

SEQ ID NO: 203222 - DNA, 741 bp, Homo sapiens
  misc_feature: GYAE6OF01C2HJB.15.57.F02.1.454.CMB.1.raw
tcagtctacgtagccacgaccggtgctcgatttagctcgatatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctgtaccaacaacaccagcaaacgccccaatcatctatttatgaagtctactaacgccgccctcgagggtatactaatccgcttctcgtggcctccaagtcgtggacaaccaccggtccctcccgtcgaccgtcttcgtcggccctcacgtacgtggaacggacggaggtcttaggtatttacttactcggaccctaaccgtacaattaacgtaaggtaaagttaacgttaaccttaccgttccggtttacggtttacggggttttccgggacgggtaaccgggtaacccgtaacggtccgtaacgggtaccccgttaccggttaacggtaccgaacccggtaccccgtaacgggtcccgtaccccgggtacccccccgttcgggtacccctaccttccccggtttaccccggttaccccccgtaacccccgttccggtacccggttacccgttaaaccggtaccggtaccgttacgggacgggtccgggacgttacgggaccgtaacgggtacccgg

SEQ ID NO: 203223 - DNA, 740 bp, Homo sapiens
  misc_feature: GYAE6OF01B17MS.15.57.F02.1.454.CMB.1.raw
  modified_base (210)..(210): a, c, t, g, unknown or other
  misc_feature (210)..(210): n is a, c, g, or t
tcagtctacgtagccacgaccggtgctcgatttagctcgatatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcacgtacgaaccactattgacgttggtanattatatttgtctctgtaccaacaaccaccagacaaacgcccaatcatactattatagaatctacgtaacgccggtcctaggaggttactactaactccgtcttcgttcgtcgtctaccgtaagtcacgaccgaacgaccggtccctccgtcgtaccgtcctcgtcgccctacgacggtactaggacgacggtacgtacttagtactttagtacctacgtacctactactaagttaacgtaaggtaacgttacgttacgttaccgttccgtttacgggtttaccgggttttacgggacgggtaaccggtaccgtaacgtccgttacggtacccgttacgttaacggtaccgtaacccggaccgtaaccggtcccgttaccccggtccccgttaccggttcccgtacccgtttcccgttaccccgttcccccgtacccgtttccccggtccgtaacccggtttacccggtaacgtaccggttacggggtacccggtaccgggtacccggacgggtaaccgtccgggtaccg

SEQ ID NO: 203224 - DNA, 684 bp, Homo sapiens
  misc_feature: GYAE6OF01CB4C7.15.57.F02.1.454.CMB.1.raw
  modified_base (226)..(226): a, c, t, g, unknown or other
  misc_feature (226)..(226): n is a, c, g, or t
  modified_base (238)..(238): a, c, t, g, unknown or other
  misc_feature (238)..(238): n is a, c, g, or t
  modified_base (332)..(332): a, c, t, g, unknown or other
  misc_feature (332)..(332): n is a, c, g, or t
  modified_base (447)..(447): a, c, t, g, unknown or other
  misc_feature (447)..(447): n is a, c, g, or t
tcagtctacgtagccacgaccggtgctcgatttagctcgatatagttgggtttgggggggtctcaggaggcagcgctctcaggacatctccaccatggcctgggctctgctgctcctcaccctctcactcagggcacagggtcctgggcccagtctgccctgactcagcctgcctccgtgtctgggtctcgtggacagtcgatcacatctctgcactggaaaccanattgacgttggntaacttataactttgtctctggtaacaacaacaccagacaaacgccccaaatcatcatttatgaagtctgtaacgcgcctcgagggtatctaancgtcttctcgtggtccttaccgaaagtcgtacggactaaccacgggccctccgtacggtaccgttctccgtacggtccttaccacgaccgtacggacgggtaacggaaccgggtnttacggaagttttaactttaacgttacggaccctacctttaccaagttaaaccgttaaggaaaacgttaacgttaaccgttaaaccttccgtttaggtttaacgggtttttccggggaacgggaaccgggttaaaccgaaacggtaccgttacggtaacccggttaccgtaggttaaccgaccgtacccggtaaacggcctcccggaccccttccggtcaaccgttccgttaccccg

SEQ ID NO: 203225 - DNA, 801 bp, Homo sapiens
  misc_feature: GYAE6OF01DDENS.15.57.F02.1.454.CMB.1.raw
tcagtctacgtagccacgaccggtgctcgatttagctcgatatagttgggtttgggggctttgcctgggctctgctgctcctcaccctcctcactcagggcacagggtcctgggcccagtctcgccctgactcagcctgcctccgtgtctgggtctcctggacagtcgatcacatctcctgcactcggaaccaactagttgacgttggtagtatttattaacttttgtccttccgtacggtaacccaaacctaaccaccccgaaggacccaaaaccgaccccctaaactcacttacctaattttaactagtaacttcctaaccttaacgggccggtcccctaggtaacggggttactacgtaactccgtctttcctcgtcgcctacgacgtctcggaccaaccgaccgtccctacccgtcgtaccgttcctcgttcggcccttaccgaggtaccgtaggaacgggcggacgtcgttagtactttaacttaccgtacgtaccttaaccgtacctaaggtttaactaagggtaaacgttaaccgtttaacctacggtttaccggtttcggttttacggggttttaccgggaccggggtaccggtaaccgtaaggtccgtaccggtaccgttccggtaacggtacctaccggaacccggtacggttcccgtccggttcccccgtacggtaaccgttccccgttaccgttccccgttccccgtaacccccgttccgtaccgtcccggtttaaacgtaccgggtactacgggtaaccggtccggtacgtacggacgtcggtaccgg

SEQ ID NO: 203226 - DNA, 510 bp, Homo sapiens
  misc_feature: GYAE6OF01B0H3A.15.57.F02.1.454.CMB.1.raw
  modified_base (331)..(331): a, c, t, g, unknown or other
  misc_feature (331)..(331): n is a, c, g, or t
  modified_base (449)..(449): a, c, t, g, unknown or other
  misc_feature (449)..(449): n is a, c, g, or t
  modified_base (467)..(467): a, c, t, g, unknown or other
  misc_feature (467)..(467): n is a, c, g, or t
  modified_base (478)..(478): a, c, t, g, unknown or other
  misc_feature (478)..(478): n is a, c, g, or t
  modified_base (483)..(483): a, c, t, g, unknown or other
  misc_feature (483)..(483): n is a, c, g, or t
  modified_base (489)..(489): a, c, t, g, unknown or other
  misc_feature (489)..(489): n is a, c, g, or t
  modified_base (494)..(494): a, c, t, g, unknown or other
  misc_feature (494)..(494): n is a, c, g, or t
  modified_base (501)..(501): a, c, t, g, unknown or other
  misc_feature (501)..(501): n is a, c, g, or t
  modified_base (505)..(505): a, c, t, g, unknown or other
  misc_feature (505)..(505): n is a, c, g, or t
tcagtctacgtagccacgaccggtgctcgatttagctcgatatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggacaaagcccccaaactcatcatttatgaagtctctaagcggccctcaggggtatctaatcgcttctctggctccaagtctggcaacncggcctcctgaccgtctcgtcgccctcagactggaggacgaggctgtattattactgccactcatatagaagtatactactctagttggtttcgcggaggccagctgaccgtcgtgcngccgagctcgccctgtcnctctcgtcccncctcngctcgngtacngcgcggncggngagcg

SEQ ID NO: 203227 - DNA, 737 bp, Homo sapiens
  misc_feature: GYAE6OF01C0ZPL.15.57.F02.1.454.CMB.1.raw
  modified_base (210)..(210): a, c, t, g, unknown or other
  misc_feature (210)..(210): n is a, c, g, or t
  modified_base (243)..(243): a, c, t, g, unknown or other
  misc_feature (243)..(243): n is a, c, g, or t
  modified_base (707)..(707): a, c, t, g, unknown or other
  misc_feature (707)..(707): n is a, c, g, or t
tcagtctacgtagccacgaccggtgctcgatttagctcgatatagttgggtttggggggggtctcaggaggcagcgctctcaggacatctccaccatggcctgggctctgctgctcctcaccctcctcactcagggcacaggtcctgggcccagtctgccctgactcagcctgcctccgtgtctgggtctccgtggacagtcgatcaccntctcctgccagtgaaaccatattcgacgttggntattattaactttgtccttcgtacggtaaccaaactaaccgacccgaaggaccaaaccgtacccccaaatctaactaccttatttaagtagtaacgttcctacgttaacggcccgtacccgttacggtaacgggttactacgttaacttccggtccttttaccgtccgtcgggtaccttccaaggttccgttacggacctaaaccgtccggtaccctccgtgacccgttctccgtcggacccttcgaacgtacgtcggaacggcgtaacggtcgttagttaactttacgttacgtacgacccttaactttccgaattaaacggttaacgtaaacgtttaacggttaccctttacgttacccggttagggttttacccggggttttaccggacggggaacggtaacccgttaacgccggttacgacccgttacgtacgttaccgacgtacccgtagccccgtacnccccgttggtaccctccgttcgttcccccg

SEQ ID NO: 203228 - DNA, 894 bp, Homo sapiens
  misc_feature: GYAE6OF01EE76U.15.57.F02.1.454.CMB.1.raw
tcagtctacgtagccacgaccggtgctcgatttagctcgatatagttgggtttggggggggtctcaggaggcagcgctctcaggacatctccaccatggcctgggctctgctgctcctcaccctcctcactcaggcacgagggtcctgggcccagtctcgccctgactcagcctgcctcgtgtcgtgggtctcctggacagtcgatccacctatcctcctagacctaccgtacggaaaccctaacgtatttcggtacgttttgggtataattttaacgtttaacttttcggtaccttcccgttacggtaaccctaaaccaaaccacccgacggaaccaaaaccgaccccccaaaacttcaacttacctaattttacgtagtaacgttaccttaccgtaacggtcccggtaccctcgggttaacggggttacttaccgtaacgttcccgtctttccgtcgtcggtacccttaccgtaagtttccgtacggtacaacccgtacccggtccccgttacccgtaccgtacccgtttccgttcccgtccgggaccccctttacccgaacggtaaccgttacgggaacggtaccggtacggtacgttacgtaacttttaacgttaccctcgtaaccctacgttactaactttacgaaacggttaacggttaacgttaaccgtttacccgtttcggtttaacgggtttttccgggtttaccggggtaaccggggtaacgggaaacccgttaacgggttccgtaaccccggtttaacccggttccgggttaaaccggtacccggtaaaccggtacccccccgggtaaaggttcccccggttccccgttaacccccccgggtttccggttacccttacccgtttccccgtttacccccccggg

SEQ ID NO: 203229 - DNA, 724 bp, Homo sapiens
  misc_feature: GYAE6OF01BVX5E.15.57.F02.1.454.CMB.1.raw
  modified_base (334)..(334): a, c, t, g, unknown or other
  misc_feature (334)..(334): n is a, c, g, or t
tcagtctacgtagccacgaccggtgctcgatttagctcgatatagttgggtttgggggctttgcttgggctctgctgctcctcaccctcctcactcagggcacagggtcctgggcccagtctgccctgactcagcctgcctccgtgtctgggtctcctggacagtcgatcaccatctcctgcactggaaccacattgacgttggtgattataactttgtctcctggtaccaacacacccagcaaacgcccccaaactcatcatttatgaagtctctaacgcggccctcgaggggttactctaatccgtcttctctcggctcaagtctggcaacnccggacctccccgtagacccggtctccgtcggccctccgaacgacgtggaagggaccgaagggtcctaggtaagtttactttaaccgtcggtaccctacttaccaattaacgtaacggtaaacgttacgttaaccttaacccgtttccgtttgggtttcggggtttttaccgggaccggggtaaccggggtaacccgaacggtcgtaccgggttaccccgttcggtaacggttaccgaaccggccccgtaaacgggtcccgtcccggcccccgttaccggtcctaccttcccgtttcccggttaccccctaccccgttcccttaccggtacccctttacggtaccgtacgttacggacgggtccggggtaccgtgggacccgtagggccg

SEQ ID NO: 203230 - DNA, 655 bp, Homo sapiens
  misc_feature: GYAE6OF01AUJCP.15.57.F02.1.454.CMB.1.raw
tcagtctacgtagccacgaccggtgctcgatttagctcgatatagttgggtttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctctggtaccaacaaccaccagacaaacgcccccaaactcatcatttatgaagtctactaagccggccctcgagggtatctaatcgtcttctcgtggcctccaagtctggacaacgaccgtccctccctcgacccgttctcgtcggccctccgagacgtaggacggacgaggtctagtactttattactcgaccctactactaattaataagtaacgttaacgttacctaacgttccgtttggtttacgggttttaccgggacgggtaacgggaaccgtaacggtccgttacgggtacccggttaccgttaaggggttccgaaccggtacccccgtaagggtccccgttacccggtcccccccgttagggttaccctcccgtttcccggttacccccgg

SEQ ID NO: 203231 - DNA, 761 bp, Homo sapiens
  misc_feature: GYAE6OF01C1HP9.15.57.F02.1.454.CMB.1.raw
  modified_base (147)..(147): a, c, t, g, unknown or other
  misc_feature (147)..(147): n is a, c, g, or t
  modified_base (213)..(213): a, c, t, g, unknown or other
  misc_feature (213)..(213): n is a, c, g, or t
tcagtctacgtagccacgaccggtgctcgatttagctcgatatagttgggtttgggggggtctcaggaggcagcgctctcaggacatctccaccatggcctgggctctgctgctcctcaccctctcactcagggcacgagggttccngggcccagtctgccctgactcagcctgcctccgtgtctcgggtctccgtggacagtcgatcaaccntcctcctgcacgtacggaaaccaagtgttggtaacgttgggtataatttaacttaactttcgttctccgttaggtaaccaaacaaccaccgaacggaaccaaaccgaccccaaactacctaatactaactttatacgtaaagtccgtaacgtaaccggtccgtacccgtacggaagggtaacttactaacgtcgttccttacgtcgtcggtacctaccgtaacgtctacgggacaaacccgtaccggtccccgttaacccgtaccggtacccgttcgtccgtcccggcccgttaccaacggtacctaggggaacgggaccgtaggcttacgttaagtttactaccgtcgtacctagtacctaataagtaagtaaacggttacttaaccgtacctttccggttcggtttcgggttacggggtacgggaacgggtaacccgaaggtcccgtaacggttaacccggttcgtacggttacccgcccggaacccggtacggtcccgttaaccccgccccggttaacggtcttaaccccgtccgtttacccccg

SEQ ID NO: 203232 - DNA, 687 bp, Homo sapiens
  misc_feature: GYAE6OF01CDN8K.15.57.F02.1.454.CMB.1.raw
  modified_base (220)..(220): a, c, t, g, unknown or other
  misc_feature (220)..(220): n is a, c, g, or t
  modified_base (493)..(493): a, c, t, g, unknown or other
  misc_feature (493)..(493): n is a, c, g, or t
tcagtctacgtagccacgaccggtgctcgatttagctcgatatagttgggtttgggggggtctcaggaggcagcgctctcaggacatctccaccatggcctgggctctgctgctcctcaccctcctcactcgagggccacgacgggtccgtcgggcccagttctcgccctgactcagcctgcctccgtgtcgtgggtctccgtggacagtcgatccaccntctcctgccacgtcggaaaccaactgttagacgttggtatatttaattaactttgtcttccgtacgtaaccgaacaaccacccgaggacctaaaccgacccccaaactctaactacgtaatttacgtagtacgtctacgtaacgccgtccgtcgacgggttactcctaagtccgtcctttcgtcgtacgccgtactaacggtctacggacaaccgaccggtccctccgtacgtccgtacgtcgtcgacctccgatacgtacggacggaacggngtccgttagtactttactacgacgtacctacgtactacgtaacgtaagtaagtaccgtaacttccgttcgttacgggtttgttccggggaacgtacgggaaccgtacgtccgtacggtaccggttccgtaggtaccgtacggacccgtaagtcccgtcccgtccccgtacgtccctacgttcccgttaccccgg

SEQ ID NO: 203233 - DNA, 766 bp, Homo sapiens
  misc_feature: GYAE6OF01CZLYT.15.57.F02.1.454.CMB.1.raw
  modified_base (187)..(187): a, c, t, g, unknown or other
  misc_feature (187)..(187): n is a, c, g, or t
tcagtctacgtagccacgaccggtgctcgatttagctcgatatagttgggtttggggctttgcctggctctgctgctcctcaccctcctcactcagggcacaggtcctggcccagtctgccctgactcagcctgcctccgtgtctggtctccgtggcagtcgatcaccatctctgcactgaaccacnttgacgttgtgtattatacttgtcctctaggtaccacaacaccagacaacgcccaatcatcgtatttacgtagaagttcctcgtaacgccggtccctacgaagggtattactaacgtccgtacctttcgtacgtggtaccctccggtaacgtcgttacggacctaaccgtaaccgggtccctcccgttaaccgtcccgttccgtccgtcggaacccctttccgaacggtacgttacggaacggacgtaacggtcgtagtaacgtttacgtactcggtaaccctagtaccgtaagttaacgttaaggaacgtttaacgtaccgtttaacgttccgtttagggttacgggtttacccggacgggttaaccgggacgttaacggtccgtaccggtaaccgtacgtaccggtacgaacggtcccgtaacggtccgtccccgttaaccccggtgttacccgtaaccctttcgtaaaccccgttccccaaacccggttcctaccggttacccttaaaccggtaacggtaccccgttcgggtaaccggttcggggaacctttaccgggccgttaacccgggaaacg

SEQ ID NO: 203234 - DNA, 907 bp, Homo sapiens
  misc_feature: GYAE6OF01C1SP6.15.57.F02.1.454.CMB.1.raw
tcagtctacgtagccacgaccggtgctcgatttagctcgatatagttgggtttgggggggggtctcaggaggcagcgctctcaggacatctccaccatggcctgggctctgctgctcctcaccctcctcactcagggcacagggtcctgggccagtctcgccctgactcacgcctgcctcgtgtcgtcgggtctccgtggacagtcgatccaccatcctcctgaccacgtacggaaccaactagtttcgacggttggtagtactactaatttaacgtttcgttccttccgtacggttaacccaaaccaaaccaccccgaacggacctaaacccgaccccctaaactacctaacgtactaatttagtacgtaacgttacctacgtaacggtcccggtacccgtacggtaacgggttacttacgtaacgttccgttaccgttttaccgtccgttcggtacccttacccgtaaacgtttccggtacggaaccccgtaaacccggtaacccggttcccccgttacccggttacccggttaccccggttccgttacccgttaccgggtcccccgttaacccgaaggttaaccgggtacgggttaacggggaaccggttaacggttcgtttaacgggttaaactttttaaccggttaccttacccggtaaccttaacctaacgttaattaaacgggttaacgttaaacgggtttaaccgttaacccgtttaccgttccggtttacgggttttaccgggggtttccgggaacgggggtaaccccggtaaaccgacgggttacccgtaccgggtaccccgttacgggttaccggtacccggaaccggtaaccccgacggggttcccccttaccccgggtacccccgttaccggttcccgttacccgtttaccccg

SEQ ID NO: 203235 - DNA, 775 bp, Homo sapiens
  misc_feature: GYAE6OF01DMXUZ.15.57.F02.1.454.CMB.1.raw
  modified_base (209)..(209): a, c, t, g, unknown or other
  misc_feature (209)..(209): n is a, c, g, or t
  modified_base (215)..(215): a, c, t, g, unknown or other
  misc_feature (215)..(215): n is a, c, g, or t
  modified_base (246)..(246): a, c, t, g, unknown or other
  misc_feature (246)..(246): n is a, c, g, or t
tcagtctacgtagccacgaccggtgctcgatttagctcgatatagttgggtttggggggggtctcaggaggcagcgctctcaggacatctccaccatggcctggctctgctgctcctcaccctcctcactcagggcacagggtcctcgggcccagtctcgccctgactcagcctgcctcgtgtctggtctctggacagtcgatcacctntcctcngccacgtcgaaaccatagttgtacgttggtntaatttaattaactttgtcctaccgttcgaacctaaacaaccacccgacgtacaaaaccgccccctaaactcctactacgtaatttagtagaacttctacgtaacgccggcctacgagggttaactacgttaactcgtaccttccttacgtacgtacccgttaccgaaacggttcgtacggacctaaccggtaccccgtcccctacccgttaccgtacccgttccgttcgtacccggtacccttaccgaaccgtacgtacgggaaacggttacggacggttcgtaacggttactttaaccgttaccttccgaaccttactacgttaagttataaacggtaacgtttaaccggttactttaaccgtttcggttaacgggttttcgggtttaccggggtacgggtaaaccggtacgtaacggtccgttaaccggtaccggtaaccgtttacggtaaccggacccgtacccgtaacggcccggttccccggtaccccgttacgtcccgttacccgttccgttcccccccggg

SEQ ID NO: 203236 - DNA, 789 bp, Homo sapiens
  misc_feature: GYAE6OF01BZYCW.15.57.F02.1.454.CMB.1.raw
tcagtctacgtagccacgaccggtgctcgatttagctcgatatagttgggtttggggggggtctcaggaggcagcgctctcaggacatctccaccatggcctgggctctgctgctcctcaccctcctcactcagggcacagggtcctgggcccagtctgccctgactcagcctgcctccgtgtcgtgggtctccgtggacagtcgatccacctattcctcctgcactacggaaaccaaacgtagttggtacggtttggtagtaatttacttaacttttgtcctccgttacggtaaccaaaccaacctacccaaggaaccaaaccgacccccctaaactcctaactactaattttatacgtaacgttccttaccgtaaacggcccggtaccctaccgggtaaggggttactaccgtaacgttccgtcctttctccgtacgggtccttaaccgtaacgttccgtacggaccgtaaccgtacccggtacccttcccgtacgtacccgttccgttccgtaccggtcccttaccgaacgtaccgttacgggaacgggtaacggacgggtactaggtactttaagttccgtacgtaccctaacgtctaagttaacgttaagtaacgttacttaccgttaaccgttccgttacggttttcggggttaccgggaccgggtaacgggtaccgtaacggtaccgtacgggtacccgttacggtacggtccgaccggtacccgtaacggtcccgttcccggtaccccccgttacggtcctacccgttccgttacccccgg

SEQ ID NO: 203237 - DNA, 528 bp, Homo sapiens
  misc_feature: GYAE6OF01B9XI7.15.57.F02.1.454.CMB.1.raw
  modified_base (516)..(516): a, c, t, g, unknown or other
  misc_feature (516)..(516): n is a, c, g, or t
tcagtctacgtagccacgaccggtgctcgatttagctcgatatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacaccaggcaaagccccaaatcatcatttatgaagtctctaagcggcctcaggggtatctaatcgcttctctgctccaagtctggcaacacggcctcctcgaccgtctctggcctccagactgaggacgaggctgattatactgccatcatatagaagtacgtactactcctgtcggtttcggcggacgggacaagctgaccgtcgtagcacgaccgaacgctcgcccctcggtacctctcctcgttcccaccctcctcgctcgtagacctgacggacggngtcggcgaggcg

SEQ ID NO: 203238 - DNA, 799 bp, Homo sapiens
  misc_feature: GYAE6OF01BL5DM.15.57.F02.1.454.CMB.1.raw
tcagtctacgtagccacgaccggtgctcgatttagctcgatatagttgggtttgggggctttgcctgggctctgctgctcctcaccctcctcactcagggaacagggtcctgggcccagtctgccctgactcagcctgcctccgtgtctgggtctcctggacagtcgatcaccatctcctgcactggaaccaacattgacgttggtgattataactttgtctcctggtaccaacaacacccaggacaaacgccccaaatcactctatttatagaagtctacaacgccggtccctgagggtactactaatcgtctttctcgtcggacctccgtaacgtctacgggaccaaccgaccgggtaccccttaccccgtagtaccttccggttccttccggtcggtcccctacccaggtaaccgtacgggacggaacggacgggtccttaggttaactttaacgttaaccgtgtaccccttaacttactaacttaagtaaggtaaaacggttaacgttaaccgttaacgtttaccgtttacgggtttacggggtttttacccggggaaccgggggtaacgggtaaacccgtaacgggtaccgttacggaacccgggttccgtaacggtaccggtaaccggtacccggtaaacggtcccgttacccggtaccccccgttcggttaaccctaccgtttcccttccggtttacccccctacccgtttccgttacccgtaccctttaacggtacggtacccgtacgggtaccggccggggtagggtccgggaccggtaacgggaaccgg

SEQ ID NO: 203239 - DNA, 661 bp, Homo sapiens
  misc_feature: GYAE6OF01EI0UP.15.57.F02.1.454.CMB.1.raw
  modified_base (305)..(305): a, c, t, g, unknown or other
  misc_feature (305)..(305): n is a, c, g, or t
tcagtctacgtagccacgaccggtgctcgatttagctcgatatagttgggtttggggggggtctcaggaggcagcgctctcaggacatctccaccatggcctgggctctgctgcctcctcaccctcctcactcagggcacgagggtcctgggcccagtctgccctgactcagcctgcctccgtgtctgggtctcctggacagtcgatcacatctcctgcactcggaaccaactattgacgttggtagattataactttgtctcctgtaccaacaacaccagacaacgccccaactcatcatttangagtctactaagcgcctagagggtatactatcgcttctctgctacgaagtcgtacggtacaaccgaccggtccctacccgtacgtacccgtctccgtcggtccccttaccgaacgtaccgtagggaacggtaaccggacgggtctacggtaactttacttaccgtcgtaccctactactaagtaacgttaagtaacgttacgttaccttaccgttccggtttaggtttcgggttttacgggacgggtaacgggtaccgaaacggtccgtacggtacccggttacgtacgggtccgtacgacccgtaacggcccgtcccggtaccccccgttgggacccttccgtcccgttaccccg

SEQ ID NO: 203240 - DNA, 760 bp, Homo sapiens
  misc_feature: GYAE6OF01A1FW4.15.57.F02.1.454.CMB.1.raw
  modified_base (631)..(631): a, c, t, g, unknown or other
  misc_feature (631)..(631): n is a, c, g, or t
tcagtctacgtagccacgaccggtgctcgatttagctcgatatagttgggtttgggggctttgcctgggctctgctgctcctcaccctcctcactcagggcacgagggtcctgggcccagtcctgccctgactcagcctgcctcgtgtctggtctcctgacagtcatcactatctcctgacactacggaaccaactattgtacggttggtagtaatttaattacttttcgtccttaccgtacggtaaccaaaaccgaaaccacccgaacgggaacccaaaacccgacccccaaaacttctacgttaccttaattttacgtaggtaaccgttcttacgttacggcccggtaccctacgggtagggttactactacgttccgtcctttacgtcgtcgcctaccgtacgtcgtacgaccacgccgtccctccgcgtcctcgttacgcgacccacgtagacgtaggaggtacgtacgtcgtaacgttaactttacgtaccgctacccgtacttacgtaacttaaggtaacgttaaacggttaacgttacttacgttccgggtttcgggtttcgggtttaccggggacggtaacgacgtaccgtcgtaccggtaccgtaccgtacgtacccgaccnccggtaccgtccgtcccgtacccgtaccgtcctccttcccggttcctaccccctaccgtccgtttaccgaccgttaacggtaccgtcggtacggtaccgggttcggacggtacgggtgaacccgggtcg

SEQ ID NO: 203241 - DNA, 764 bp, Homo sapiens
  misc_feature: GYAE6OF01DGSRD.15.57.F02.1.454.CMB.1.raw
  modified_base (251)..(251): a, c, t, g, unknown or other
  misc_feature (251)..(251): n is a, c, g, or t
  modified_base (747)..(747): a, c, t, g, unknown or other
  misc_feature (747)..(747): n is a, c, g, or t
tcagtctacgtagccacgaccggtgctcgatttagctcgatatagttgggtttgggggctttgcctgggctctgctgctcctcaccctcctcactcagggcacagggtcctgggcccagtctcgccctgactcagcctgcctccgtgtctgggtctcctggacagtcgatcaccatctcctgcactggaaccactattgacgttggtagtatttattaactttgtccttccgtacggtaaccaacaaaccnccgaaggaccaaaccgacccccaaatccaatctatttatcggtaatctacgtaacgccggaccctacgacgggtattctaacttcggtctttcgtcgtcggccttaccgaacgttcgtacggccaaacgtcccggtccctccgtcgacctcgttctcggtccctacgactacgtaggacgggacggtacgtaccgtaggttaaatttaaccgttcgtacccggtactaaccttacgtaaagttaacgtaaacggtaaacggttaactttaaccttaaccgtttcgtttcggggttttacgggtttcgggaaccggggtaacggtaaccaacggttcgtaccggtaaccggtttcgtaacgggtacccaaccggtcccgttaacggtcccgttacccgtacccccgtttacgggaccttaaccgttcccgttcccgttacccctacccgtccgtacgtacccgttcggtaacgccgtagggtaccggcgggttaccngggtaaccgcggtaccg

SEQ ID NO: 203242 - DNA, 680 bp, Homo sapiens
  misc_feature: GYAE6OF01DUGPI.15.57.F02.1.454.CMB.1.raw
  modified_base (655)..(655): a, c, t, g, unknown or other
  misc_feature (655)..(655): n is a, c, g, or t
tcagtctacgtagccacgaccggtgctcgatttagctcgatatagttggggtttggggggggtctcaggaggcagcgctctcaggacatctccaccatggcctgggctctgctgctcctcaccctcctcactcagggcacgaggtccgtgggcccagtctcgccctgactcacgcctcgcctccgtgtcgtgggtctccgtaggacagtcgatccaacctatcctacctgcctaacgtacggaaacccaactagtttcggaacggtttgtagtaatttagttaactttcgtcctccgtagtaaccaaacaacaaccgacggacaaaccgaccccaaatcatacgtattatgaaactctacgaacgccggtcccgtagtacgggtactacgtaacgtccgttcttcgtcgtggtcctacgtaaggtctcggacaaccgccgtccctcgtcgtaccgtcgtcctaacggtcctacgacgtacgtcggacggacgtgacgtagtaattacttacgacgtccatacaagttacgtaagtaacgttataccgttacttcggtaggttttcgggtaccggtaaggaccggtaccacggtacgaccgtacggttccgaagtaccgtaccgacccgacggtcccgttaccccggtccccggtntaccgtcccgttcccgttacccccg

SEQ ID NO: 203243 - DNA, 726 bp, Homo sapiens
  misc_feature: GYAE6OF01CC1B9.15.57.F02.1.454.CMB.1.raw
  modified_base (162)..(162): a, c, t, g, unknown or other
  misc_feature (162)..(162): n is a, c, g, or t
  modified_base (216)..(216): a, c, t, g, unknown or other
  misc_feature (216)..(216): n is a, c, g, or t
tcagtctacgtagccacgaccggtgctcgatttagctcgatatagttggggtttggggggggtctcaggaggcagcgctctcaggacatctccaccatggcctgggctctgctgctcctcaccctcctcactcgagggcacgacgggtcctgggcccagtcncgccctgactcagcctcgcctccgtgtcgtggtctcgtgacagtcgatccaacntcctcctgctacgtacggaaccaactattcgacgttggataattattaacttgtctccgtacggtaaccaaacaaccgaccgaggacctaaaaccgaccccctaaactctaactacgtaatttacgtaggtaacgtcctaacgtaacgccggtaccctacgggacgggttactactaacgtcgtcttccgtcgtcgtacctacgtaacgtcgtacggacctaaccggccgtccctacccgtacggtacccgtcgtccgtccggtaccctaccgtaagtaccgtagggaacggtacgagggtactacggttaacttacgttaaccgtcaaccctactacgtaagtaagtaacgttaaacgttacgttaccttacgttcggtttcgtttacgggtttaccgggacggtaacgggaaccgtacgtaccgtacggacccgttcggtaaggcccgtaacgacccgtaacgtccgtccccgtccccgttactcctaacccgttccgttaacccccg

SEQ ID NO: 203244 - DNA, 803 bp, Homo sapiens
  misc_feature: GYAE6OF01CTW8Q.15.57.F02.1.454.CMB.1.raw
  modified_base (202)..(202): a, c, t, g, unknown or other
  misc_feature (202)..(202): n is a, c, g, or t
  modified_base (344)..(344): a, c, t, g, unknown or other
  misc_feature (344)..(344): n is a, c, g, or t
tcagtctacgtagccacgaccggtgctcgatttagctcgatatagttgggtttgggggggggtctcaggaggcagcgctctcaggacatctccaccatggcctgggctctgctgctcctcaccctcctcactcagggcacagggtcctgggcccagtctgccctgactcagcctgcctccgtgtctgggtcctccgtggacngtcgatccaccatcctcctgcacgtacgaaccaactattcgacggttggtgaatttattaacttttcgtccttccgtacggtaaccaaacctaaccaacccgaggaccaaaaccgcccccctaaactcactacctaatttanagtaacgtcctacgtaacggcccggtacccgtacggtacggggttactcgttaaacgtccgtcctttacgtccgtcgggtccctaccgtaaggttccgtacgggaccaaccgtaccccgggtacccctaccccgtacgtaccccggttactccgtaccggtacccctaccgacgtacgtacgggacgggaaccggtacggtactagttactttacgttactaccgaccctaccttactaacgttaagtaacggtaaacgttaacgttaaccgttacccgttaccgtttacggggttttcgggtttttacccggggacggggtaaccggggtaaccgtaacggtccggttacggtaccccggttaccggtacggtacccggaccggacccccgggtaacggtccccgtacccgggtccccccggttaggttcccctacccgttcccgtttacccccccgg

SEQ ID NO: 203245 - DNA, 310 bp, Homo sapiens
  misc_feature: GYAE6OF01A4JBM.15.57.F02.1.454.CMB.1.raw
  modified_base (297)..(297): a, c, t, g, unknown or other
  misc_feature (297)..(297): n is a, c, g, or t
  modified_base (303)..(310): a, c, t, g, unknown or other
  misc_feature (303)..(310): n is a, c, g, or t
tcagtctacgtagccacgaccggtgctcgatttagctcgatatagttgggtttgggatgagaacctatgaacattctgtaggggccactgtcttcaacacggcctccctgaccgtctctggcctccagactgaggacgaggctgattattactgccactcatatagaagtagtactactcctgtggttttcggcggaggaccaagctgaccgtcctaggtcagcccaaggctcgccccctcggtcactctcgttccccaccctcctcgctacgtagactgagcgggctggcaaggcncatagnnnnnnnn

SEQ ID NO: 203246 - DNA, 830 bp, Homo sapiens
  misc_feature: GYAE6OF01APBZM.15.57.F02.1.454.CMB.1.raw
tcagtctacgtagccacgaccggtgctcgatttagctcgatatagttgggtttgggggctttgcctgggctctgctgctctcaccctcctcactcagggcacgacgggtcctgggcccagtctggaccctgactcagcctgcctccgtgtcgtcgggtctcgtggtacgtagtcgatacacctatcctccgtgaccgtacgtacgaaacctaacgtagttcggtacggttggtagtaatttacgttaaccgtttcgtccgttccgtacggtaaacccaaaccgaacccacccgaacgggtacccaaaacccggtaccccctaaactctaacttacttaattttagtacgttaacgtccttaccggtaaccggccggtacccgttaggtaggttactacgtactcggtccttacgcggtcgcctacgtagtcggtacgaccgtaaccgtccgtccctaccgtcgtaccgtcgtacgtaccgtctaacgacgtcgtaacggaggtacgttacttactttacgttacctcggtacctaccgtaacttcgtaagaattaacggtaacgttaccttaccgtacgtttaccggttagggttccggggttaccgaagggtaccggtaaccgtacgggttacccgtacggttaccgtaaccggtacgtaccggaaccgggttaccccgccggttacccggtaacccgttccccgggttccgttacgacccccgtttcggttcccctaccccgtaccccgtttcgtaacccgttaccgttaacggtcctaaccgggtaggtccgggtacgtccgggtaaaggcctcccggggattacgg

SEQ ID NO: 203247 - DNA, 888 bp, Homo sapiens
  misc_feature: GYAE6OF01A4GA8.15.57.F02.1.454.CMB.1.raw
tcagtctacgtagccacgaccggtgctcgatttagctcgatatagttgggtttgggggggtctcaggaggcagcgctctcaggacatctccaccatggcctgggctctgctgctcctcaccctctcactcagggcacagggtcctgggcccagtctcgccctgactcacgcctgcctccgtgtctcgggtctccgtggacaggtcgatccaccatcctccgtgcctaccgtaggaaacccaactagtttcgggacggtttgggtataattttaacttaaacgttttcgttccttccgttacggtaaacccaaacctaaacccaacccgaacgggaacccaaaacccggaacccccccaaaacctacctaacttaaccttaattttaacgttaggtaaacgttaccgtttaccgtaacgggcccggtaccccgttacggtaacgggggtttacttaaccgttaaacgtccggttcctttacgttcctcggtacctacccgtaacgttcggtacgtaccaaccggtacccgtcccgtcccccgttacggtccccgtttacgtcccgttacccggtccctacccgaacggtaccgtacggggaacggtaccgggtacgggtacgttaacgttacgtttaaccgtttacctaccggtaccctaccgttaactaagtttaacgtaaaggtaacggtttaaccgttaaccgttaacccgtttccggtttacgggtttccggggtttaaccgggtaccggggtaacgggaccgtaacgtaccggtaccgggttacccgttccggttaaccggaccgtacccggacccggtaaccgggtccccgtacccggtacccccggttaccgtcccgtacccgtttccccggttacccccgg

SEQ ID NO: 203248 - DNA, 761 bp, Homo sapiens
  misc_feature: GYAE6OF01CMBD4.15.57.F02.1.454.CMB.1.raw
tcagtctacgtagccacgaccggtgctcgatttagctcgatatagttgggtttgggggctttgcctgggctctgctgctcctcaccctctcactcagggcacagggtcctgggcccagtctgccctgactcagcctgcctcgtgtcgtggtctcgtggacagtcatcacatctcctgacacgtacgaaaccaatagttgacgttggtatatttaataacgtttgtcctacgtacgtaaaccaacaaaccgaccgaacggaacaaaccgacccctaaatccattactaattttaagacgtaacgtcgtacgtaacggccggtcccgtaaggtaacgggtactaacgttaacgtcgtactttcgtcgtacggtccctaccgtaacgtcgtacggacaacccgtacggcccttccgacgtcgttcctcgtacgtaccacgaagtacgaggacgaacggtcgtactaagtactttacgtaccgtacgtaccattaacaagttaagaacggttaacgtagttaaccttacgtcggttgggtttacgggttacgggacggtaacgggaacctaggccgttaacggtaccggttaaccgtacgacggtaaccggaccccgtacggaccccgttccggtaaccccgtacgggtaccttacgttacccggtcccccttaacccgtcccccgtacgtacccgttacccgtacgggttaaccgccgggttaaggccccggaagggttaccgacgggaacctaaaccggggtc

SEQ ID NO: 203249 - DNA, 676 bp, Homo sapiens
  misc_feature: GYAE6OF01EFH8T.15.57.F02.1.454.CMB.1.raw
  modified_base (358)..(358): a, c, t, g, unknown or other
  misc_feature (358)..(358): n is a, c, g, or t
tcagtctacgtagccacgaccggtgctcgatttagctcgatatagttgggtttgggggctttgcctgggctctgctgctcctcaccctcctcactcaggcacagggtcctgggcccagtctgccctgactcagcctgcctccgtgtctgggtctcctggacagtcatcacctatctcctgcacgtacgaaccaactattgtacggttggtgtatttaattactttcgtccttccgtaggtaacccaacctaaccaacccgaggaccaaacgaccccaatcatctattatagacgtctactaacgccgcctaggagggttactacttactcgtacttctcgtcggtctaccgtagtcgngaccgaccgaccgtcccgtccgtcgtaccgtcgtacgtcgtccgtacacggtcgaggacgacggtagtcgtattaacttacgtacctcgtacctacgtactaactaagttaacgtaagttaccgtacttaccgttacggtttcggtttcgggtacgggaccggtaacggtccgtacgtcgtaccgtaccgttacgtacggacctacccgaccgtaccgcccttcccggccctaccggtcctaccgttctccccggtcccgtccctaccggtctacggtcgacgtagtcgggtacggccgtaggcggaacgcggtaccg

SEQ ID NO: 203250 - DNA, 662 bp, Homo sapiens
  misc_feature: GYAE6OF01EKVAS.15.57.F02.1.454.CMB.1.raw
  modified_base (533)..(533): a, c, t, g, unknown or other
  misc_feature (533)..(533): n is a, c, g, or t
  modified_base (548)..(548): a, c, t, g, unknown or other
  misc_feature (548)..(548): n is a, c, g, or t
tcagtctacgtagccacgaccggtgctcgatttagctcgatatagttgggtttgggggggggtctcaggaggcagcgctctcaggacatctccaccatggcctggctctgctgctcctcaccctcctcactcgagggcacgagggtcctgggccagtctcgccctgactcagcctgcctcgtgtcgtgggttctccgtaggactaggtcgatccacctacgttcctaccgtgcctacgtacggaaacctactagttcggtacgttgggtactatttacgtttacgtttcgtaccttccgtacgtaaccaaaccgaaccaaccgacggaacctaaacccgacccccctaaaacttccgaacttactttaacgtttacgtaagtaacgttccttaaccggaacggtccgtaccgtacggtaagggttactacgtacgtcgtcttacgtcgtgacctacgtacgtgtaaccggacaccgtccgtccctccgtacgtccgtctacgtcgtacctcgacgtcgaggacgacggacgtntagttatactacgcnctacctgtatagaacgtagttactacctgttcgtggtttgggcgacgtacggcaggtcgtacgtacgacgtcgacgcgaccgtgtcccgtctacccgtggtctccgtcgtcccc

SEQ ID NO: 203251 - DNA, 870 bp, Homo sapiens
  misc_feature: GYAE6OF01DNYVA.15.57.F02.1.454.CMB.1.raw
tcagtctacgtagccacgaccggtgctcgatttagctcgatatagttgggtttgggggctttgcctgggctctgctgctcctcaccctcctcactcgagggcacgagggtcctcgggcccagtctcgcctcgactcagcctcgccgtcgtgtcgtcggtctccgtagacgtagtccgataccacctacgttcctccgttcgacctacggtaacgaaacctaacgtactttcgggtacgtttagggtagtaacttttaagttaacgtttcgtccttaccgtaacggtaaacccaaacccgaaccgtaacccggtacggaaaccctaaacccgtaaccccctaaacttaccgtaactttaaccttaaatttacgtaacggttaacgttacttaccgtaacggtccggtacccgtaacggttacggggttaacttacgttaacgttccgttcttcgtccgttcgacccttacgtaacgtcgtacgaccgaaccgccggtccctccgttaccgacgtccgtaccgtccgtccgtacacgtacgacggtggacggtacggtacttaaggttaacgttacgtccgtacgtccgtactaaacgtactaaggtaacgttaacggttaactttaaccggttacgtttacgggtttcggtttaccgggttacggggacggtaaccgggtactaaccgggtcttaccgggtacccgttaccggttacggaacccgaccgggtccgtaacccggttccgtccgtacccgtaccgttctccgttcccctacccgtaccccgttacctcccggtacgtaaccgtttaaccggccgttacgggccgtacggggtccggtacccgtacgggtaccgccggtaaacg

SEQ ID NO: 203252 - DNA, 737 bp, Homo sapiens
  misc_feature: GYAE6OF01D1O35.15.57.F02.1.454.CMB.1.raw
  modified_base (288)..(288): a, c, t, g, unknown or other
  misc_feature (288)..(288): n is a, c, g, or t
tcagtctacgtagccacgaccggtgctcgatttagctcgatatagttgggtttgggggctttgcctgggctctgctgctcctcaccctcctcactcagggcacagggtcctgggcccagtctgccctgactcagcctgcctccgtgtcgtgggtctcctggacagtcgatcaccatctcctgcacgtaggaaccaactattgtacgttggtataatttattaactttgtcctaccgtacggtaccaaacaaccacccgagaccaaaccaccccaaatcatactattangtaactctactaacggccgtacctacggtaagggtactactaacgttcgtacctttcctccgtcggtaccttaccgtaagttcgtaccggaacaacccgacccgggtccccttacccgtaccgtacccgttcgtccgtcggtaccctaccgaggaccgtagggaacggtaacggaggtacttagtaatttacttacgtaccgacctactataaacgttataaggttaacgttaacttaacgtaccttccggttgggtttacgggtttcgggaacggacggtaactacgtacgtacggtacccgtacggtacgaccgaccggaacccgtacggtcccgtcccgttccccgtcgggtccctaccgttccgttccccggtcccctcccgtcgtaccgtacgtaacgacgttccgacgggtaccgggtccggtagtacccggagacggtaccg

SEQ ID NO: 203253 - DNA, 845 bp, Homo sapiens
  misc_feature: GYAE6OF01CSG19.15.57.F02.1.454.CMB.1.raw
  modified_base (447)..(447): a, c, t, g, unknown or other
  misc_feature (447)..(447): n is a, c, g, or t
  modified_base (465)..(465): a, c, t, g, unknown or other
  misc_feature (465)..(465): n is a, c, g, or t
tcagtctacgtagccacgaccggtgctcgatttagctcgatatagttgggtttgggggctttgcctgggctctgctgctcctcaccctcctcactcagggcacagggtcctgggcccagtctgccctgactcagcctgcctccgtgtcgtggtctctggacagtcgatcacatctcctgcacgtagaaccactagttgacgttggagtatttattaactttcgtctaccgtacggtaaccaaacaaccaccgaaggaccaaaccgacccctaatctagtactaatttacgagtaattccgtacgtacggccgtcctaggaggttactactaacgtcgtcttacgtcggtcgtacctaccgtaagtcgtacggacctaacgtaccggtcccttccgtacgccgttccgtacgtccgtactacgacgtacgtaggaacggtacacggtntagttaactttcgtaacncgtaccgtactaacgtattaagtaacgttaaacggttaacgttaccgttaacgttccgggtttacgggtttacggggttaccgggtaaaccggggtaccgggtaaaccgtaaccgggtacgttaacccggttacccggttacggttaacccggttaaacccgggtacccgtaaacccggggttaacgggcccccgtttaccccgggtaccccccgtttacgggttaccccgtttacccgttacccgggttcccccgttcccccggttaaccccgttccccggtttaaccggggtaacctttacccgggttaaccggtaccggttacgggtaccccggggacggttaacccgggtacgggaacccgggtacgtaacccggg

SEQ ID NO: 203254 - DNA, 784 bp, Homo sapiens
  misc_feature: GYAE6OF01BARPK.15.57.F02.1.454.CMB.1.raw
  modified_base (141)..(141): a, c, t, g, unknown or other
  misc_feature (141)..(141): n is a, c, g, or t
  modified_base (277)..(277): a, c, t, g, unknown or other
  misc_feature (277)..(277): n is a, c, g, or t
  modified_base (522)..(522): a, c, t, g, unknown or other
  misc_feature (522)..(522): n is a, c, g, or t
tcagtctacgtagccacgaccggtgctcgatttagctcgatatagttgggtttggggggggtctcagggaggcagcgctctcaggacatctccaccatggcctgggctctgctgctcctcaccctctcactcagggcacgngggtcctgggcccagtctcggccctgacctcagccctggccctcggtgtcgtggggttcctaccgtagggacctaggtccgatccaccctagtctaccgtggccactaacggaacctacgtattcgtaggttggtntattaatactttgcctcgtacggtaccaacgtaacaaccgaggaccaaccgacccccaaagtcactactactttagtaacggtacttctacgtaacggcccggtccgtacggaacggggttactaaccgttaactccgtacgttcttccgtaggtcctaccgtaagtcgttaacggctaacgaccgtccctcccgtcggtaccgtcctcgtcggccctacgtacgaccggttacgagggtaacgnggtaggtacctaaagtttaccgttttaaccgccggtacccttacgaccctaacgttagaaccggttaagttaacgtaccttctttaaccggggttcgggtttacggggtttacccgtacggggtaccggtaaagaccgggtacgttaccggttacccggtaacccggttaggttacccgaacccgggttccaaacccggggttcctacccccgggttacccgttaccggttacctacccccggttggtttaacccccccggg

SEQ ID NO: 203255 - DNA, 876 bp, Homo sapiens
  misc_feature: GYAE6OF01C7VUB.15.57.F02.1.454.CMB.1.raw
  modified_base (134)..(134): a, c, t, g, unknown or other
  misc_feature (134)..(134): n is a, c, g, or t
  modified_base (188)..(188): a, c, t, g, unknown or other
  misc_feature (188)..(188): n is a, c, g, or t
  modified_base (208)..(208): a, c, t, g, unknown or other
  misc_feature (208)..(208): n is a, c, g, or t
tcagtctacgtagccacgaccggtgctcgatttagctcgatatagttgggtttgggggctttgcctgggctctgctgctcctcaccctcctcactcagggcacgagggtcctgggcccagtctgccctgactcngcctgccctcgtgtctgggtctccgtggactagtcgactcaacctatccttccngctacgtacggaaacctaancttaggtacggttggtataactttaaacttacgttttcgtaccttccgtacggtaaccaaacaaccacccgtaacgaactaacccgaaccccaattacattacctaatttacgtacgtaacgttaccgtacctaaacggcccggtaccgttacggacggggttaactacgttaacgtcgttaccttgttcccgtggtaccctaaccgtaacggttcgtccggaaacccgtacccgttaacccggcccttaccccgtacggtaccgttccttcggtaccggtaaccctacgaaacggttctacggggtacgtaaacgggaccggtaccgtttaaattacctttaaacggtacctcggttaacccctaacgttactaaagttaacgttaaacggtaacgttaacggtaccgtaccttaccgtttaccgggttgggttttaccggggttacgggtacgtaaccggtaaccgtacgtacgtaccggtaccgtaccgttacgtaaccgccgtacgtacggtcccgttacccggtcccgtacgttacccctacgtttcccccttacccgttacccccgtaaccccgttgtacccgggtttaacccttacccggaaacgggttaccggtaccgggtaaccggggcgggttacccggacgggtaacggtaaccggg

SEQ ID NO: 203256 - DNA, 918 bp, Homo sapiens
  misc_feature: GYAE6OF01ENE6H.15.57.F02.1.454.CMB.1.raw
  modified_base (387)..(387): a, c, t, g, unknown or other
  misc_feature (387)..(387): n is a, c, g, or t
tcagtctacgtagccacgaccggtgctcgatttagctcgatatagttgggtttggggctttgcctgggctctgctgctcctcaccctcctcactcgagggcacgagggtcctgggcccagtctgccctgactcacgcctgcctcgtgtctgggtctccgtaggacagtcgactccacctatctcctgaccacgtacggaaaccaactagttgtacggtttaggtagtaacttttaacgttaacttttcgttcccttaccgtacgtaacccaaaacaacccgaccccgtaaggaaccctaaaaccgaccccctaaaactctactcctaatttatagtaacgtctacgtacgaccgcctcgtagggtactcgtaactcgtcttactcgnggtcctaccgtaacgtcgttacggacaaaccgtccggtaccctccccgtacgtacccgtcgtcgtccggtacctaccgtactaccggtaggaacgggaccggtagggtaccctaagttacggtttaactttaaccgtcggtaaccctacgttaaccgtaagttaacggtaacggttaaacggttaaccgtttaaaccgtttaaccgttcggttttaccggggtttaccggggttttaacccggggtaccggggaaaccgggtaaaccgtacggtacccgtttaaccgggtacccgttaaccggttccgggttaaaccgaccccggtacccgggtaaccggttcccgttccccgggacccccggttttaccgggtacctttaccccggttacccgtttacccccgttaaccccccgttaccccggtttcccggttaaccccggttaccgttaaccgggttaaaccggttaccggttaccgggtacggggttaccgggaccggtttacgggacccggtaaacgggtaacccgg

SEQ ID NO: 203257 - DNA, 766 bp, Homo sapiens
  misc_feature: GYAE6OF01B48Y1.15.57.F02.1.454.CMB.1.raw
  modified_base (202)..(202): a, c, t, g, unknown or other
  misc_feature (202)..(202): n is a, c, g, or t
  modified_base (330)..(330): a, c, t, g, unknown or other
  misc_feature (330)..(330): n is a, c, g, or t
  modified_base (735)..(735): a, c, t, g, unknown or other
  misc_feature (735)..(735): n is a, c, g, or t
tcagtctacgtagccacgaccggtgctcgatttagctcgatatagttgggtttgggggctttgcctgggctctgctgctcctcaccctcctcactcagggcacagggtcctgggcccagtctgccctgactcagcctcgcctccgtgtcgtggtctccgtggacagtacgatcaccatctcctgccacgtacgaaaccactnttcggtacggttgtagtaattactttaacgtttcgtaccttaccgtacggtaaaccaaacctaacccgaaccgacggaaccaaaccgaacccctaaatctaacttactaattttagtacgtaacgttntaaccgtacggcccggtacccgtcggtaagggttaacctactaacgttccgtactttccggttcgtaccgtacctacgtacgtacgtacgaccaccgcccgtcctccctacgtcctacgtcggtcctaccgtacaggtacgacggtacggaacgacgttataccgtatttacgtaccgtactacctatacgaagttaactaagttaacgttaacgttaccgttaccgttacgggtttagggttttccggtacgggggtaaccgacggtacggaccggttaccgtaccggttaccgtaaccgtccgaccggtaccccgacggtccgtacccgttccccgcccggttacctccgtacccttccgtaccccttccccgtaccctaccgtcctacggtacgtcggtacncgggtaccgcggtcgaccgttggccggtacg

SEQ ID NO: 203258 - DNA, 684 bp, Homo sapiens
  misc_feature: GYAE6OF01B5CT4.15.57.F02.1.454.CMB.1.raw
  modified_base (260)..(260): a, c, t, g, unknown or other
  misc_feature (260)..(260): n is a, c, g, or t
  modified_base (410)..(410): a, c, t, g, unknown or other
  misc_feature (410)..(410): n is a, c, g, or t
tcagtctacgtagccacgaccggtgctcgatttagctcgatatagttgggtttgggggctttgcctgggctctgctgctcctcaccctcctcactcagggcacagggtcctgggcccagtctgccctgactcagcctgcctcgtgtcgtgggtctccgtggacagtcgatcacctatctcctgctactaggaaccatattgacgttggtagtatttattaactttgtctccgtacgtaccaacacacccgaggaccaacnccccaaatcgtatctattactgtaactctacgtaacggccgtccctacggtacgggtactacgttaactcgtacttccgtcgtcgtcctactacgtcgtacgaccaccgacccggtcctcccgtctccgtcctcgcgtcctacaggtacnggcggaaggcgtcgtagttacttacgttactcgtacctactctactaatagtaacgtacttacctacgttccgttggttacggtttacgggcgggtacgaaccggtacgtacgtacccggtaccgtacgacggttaccgaacgacccgtaccggtccgtccccgtacccgtccggttaccctccgttccgttacccgttccctacgttcccttccgtaccgttaccgaccggttacgaccgtgggtaccgggtacggcggtcggaccggtaacg

SEQ ID NO: 203259 - DNA, 738 bp, Homo sapiens
  misc_feature: GYAE6OF01BA1ZE.15.57.F02.1.454.CMB.1.raw
tcagtctacgtagccacgaccggtgctcgatttagctcgatatagttggggtttgggggggggtctcaggaggcagcgctctcaggacatctccaccatggcctgggctctgctgcctcctccaccctcctcactcgacgggcacgtagggtcctcgggcccagtctcgccctgacctcagcctcgccgtccgtgtcgtcggtctccgtcggacacggtcgactccaacctacttcctccgtcgaccaccgtaccggaaaccaactagttcggtaacggtttgggtatactttaattacgtttcttcctacgtacgtaaccaaacaacccgtaccgaacgaccgaaaccgccccaaactcacttacttagttacgtacgaacgtctacgtaacgccgtacccgtaggtacggtactactacgtctctctcgtcgctacgtatcgacgaccacgccgtcctcctcgccttcaccgtcgtacctacgacgtcgtaacggacggaggtacgtgttacgttaacttacgttaccgtccaccccgtaattacgtaacgttaagttaaacggttaactaacgttaccgttacccgtttacggtttagggtttaccgggttccggggaacgtaacgggtactaccgtaccggtacggtacccgtacggttaccgcgtacccggacccgttagggccccttacccgtaccccggtaccgaacccttcccggttccgttccccccgg

SEQ ID NO: 203260 - DNA, 725 bp, Homo sapiens
  misc_feature: GYAE6OF01BABPU.15.57.F02.1.454.CMB.1.raw
  modified_base (544)..(544): a, c, t, g, unknown or other
  misc_feature (544)..(544): n is a, c, g, or t
tcagtctacgtagccacgaccggtgctcgatttagctcgatatagttggggtttgggggggggtctcaggaggcagcgctctcaggacatctccaccatggcctgggctctgctgctcctcaccctcctcactcgagggcacgagggtcctcgggcccaggtctcgcccctgactcacgcctgcctccgtgtccgtgggtcctccgtggacaggtcgatccaccatcctccgtcgcctacgtacggaaacccaatatttcggacggttttggtatattacttaacgtttcgttccttccgtcggtaaccaaccgaaccaacccgaggtaccaaacccgacccccctaaactctaactactaattttagtacggtacgttactaccgtaacggccgtacccgtacggtagggttactaccgttagtccgttcttctcgtcgtccttaccgagtcgtacggacaccgtccgcccttccgtacgtaccgtccttcgccggtccctcacgtcgtacgggaggacggtgtacgtacgttacttcgtacncgtacctacgtactataagtacgtaacgtacgttaccttccgttacggttggtttacgggtttacgggaccgggtaacggtacgtaacggtcccgtaccgggtacccgttcggtaacggtcccgacggtacccgacggtccgtcccggtacccgtcgggtacccttcgttcccgttccccg

SEQ ID NO: 203261 - DNA, 395 bp, Homo sapiens
  misc_feature: GYAE6OF01CC7D2.15.57.F02.1.454.CMB.1.raw
  modified_base (298)..(298): a, c, t, g, unknown or other
  misc_feature (298)..(298): n is a, c, g, or t
  modified_base (319)..(319): a, c, t, g, unknown or other
  misc_feature (319)..(319): n is a, c, g, or t
  modified_base (321)..(321): a, c, t, g, unknown or other
  misc_feature (321)..(321): n is a, c, g, or t
  modified_base (323)..(323): a, c, t, g, unknown or other
  misc_feature (323)..(323): n is a, c, g, or t
  modified_base (325)..(327): a, c, t, g, unknown or other
  misc_feature (325)..(327): n is a, c, g, or t
  modified_base (330)..(330): a, c, t, g, unknown or other
  misc_feature (330)..(330): n is a, c, g, or t
  modified_base (333)..(395): a, c, t, g, unknown or other
  misc_feature (333)..(395): n is a, c, g, or t
tcagtctacgtagccacgaccggtgctcgatttagctcgatatagttgggtttgggatgagaacctatgaacattctgtaggggccactgtcttcaacacggcctccctgaccgtctctggcctccagactgaggacgaggctgattattactgccactcatatagaagtagtactactcctgtggttttcggcggaggacaagctgacccgtctaggcacgcccaaggcctacgccccccttggtaccactccttcgttccccaccctccgtcgctacgtagacgtggacggcgggntgggacaaggcgactagtagnangntnnnacntannnnnnnnnnnnnnnnnnnnnnnnnnnnnnnnnnnnnnnnnnnnnnnnnnnnnnnnnnnnnnn

SEQ ID NO: 203262 - DNA, 725 bp, Homo sapiens
  misc_feature: GYAE6OF01AI36K.15.57.F02.1.454.CMB.1.raw
  modified_base (376)..(376): a, c, t, g, unknown or other
  misc_feature (376)..(376): n is a, c, g, or t
tcagtctacgtagccacgaccggtgctcgatttagctcgatatagttgggtttgggggctttgcctgggctctgctgctcctcaccctcctcactcagggcacagggtcctgggcccagtctgccctgactcagcctgcctccgtgcctgggtctcctggacagtcgatcaccatctcctgcactggaaccaacattgacgttggtgattataactttgtctcctggtaccaacaaccacccaggacaaacgccccaaactcatcatttactgaagtctactaacgcggcctcgagggtatctaatcgtcttctctgctcaagtctggacaacacggtcctcctgaccgtctctcggcctcacgactggaggacgnggtctgtaattacttactcgaccctactacaacttaataaggtaaacgttaacgttaaccttaccgtttaccgtttacgggtttcggggttttttaccgggaccggggttaaccgggaacccgtaaaggtcccgttacggtaaccccgtaccgttaaccgggttaccgaacgaccccgtaaccgggccgttacccggtcccccgttaccgggtccctaaccgttcccgttcccgtttacccccaacccccgtttccccgtaccggttacccttaacccggttaacggtaacccgttacgggaccgggttccggggaccggttaccgggaacccggtaacgggaacccgg

SEQ ID NO: 203263 - DNA, 495 bp, Homo sapiens
  misc_feature: GYAE6OF02I9OM3.15.57.F02.1.454.CMB.1.raw
  modified_base (322)..(322): a, c, t, g, unknown or other
  misc_feature (322)..(322): n is a, c, g, or t
  modified_base (408)..(408): a, c, t, g, unknown or other
  misc_feature (408)..(408): n is a, c, g, or t
  modified_base (455)..(455): a, c, t, g, unknown or other
  misc_feature (455)..(455): n is a, c, g, or t
tcagtctacgtagccacgaccggtgctcgatttagctcgatatagttgggtttgggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaagcccccaaactcatgatttatgaggtcagtaatcggccctnaggggtttctaatcgcttctctggctccaagtctggcaacacggcctccctgaccatctctgggctccaggctgaggacgagggtnattattactgcagctcatatagaagtggcagcactctcgtattcggnggtggaccaagctgaccgtctaggcagccaggctgccccg

SEQ ID NO: 203264 - DNA, 172 bp, Homo sapiens
  misc_feature: GYAE6OF02GATKM.15.57.F02.1.454.CMB.1.raw
  modified_base (172)..(172): a, c, t, g, unknown or other
  misc_feature (172)..(172): n is a, c, g, or t
tcagtctacgtagccacgaccggtgctcgatttagctcgatatagttgggtttgggggaagaggaagactgacggtcccccaggagttcaggtgctgggcacagcggccctgggctgcctggtcaaggactacttccgctacgtaactgagcgggctggcaaggcgcatagn

SEQ ID NO: 203265 - DNA, 523 bp, Homo sapiens
  misc_feature: GYAE6OF02I9YBL.15.57.F02.1.454.CMB.1.raw
  modified_base (486)..(486): a, c, t, g, unknown or other
  misc_feature (486)..(486): n is a, c, g, or t
  modified_base (495)..(495): a, c, t, g, unknown or other
  misc_feature (495)..(495): n is a, c, g, or t
tcagtctacgtagccacgaccggtgctcgatttagctcgatatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagcccccaaatcatcatttatgaagtctctaagcgccctcaggggtatctaatcgcttctctggctccaagtctggcaacacggcctccctgaccgtctctggcctccagactgaggacgaggctgattattactgccactcatatagaagtagtactactcctgtggttttcggcggagggaccagctgaccgtctaggtcagacccaaggctcgcccctcggtcactctcgttcccnccctcctcnctacgtcgactgacgcggctggcaggcg

SEQ ID NO: 203266 - DNA, 523 bp, Homo sapiens
  misc_feature: GYAE6OF02HJV7O.15.57.F02.1.454.CMB.1.raw
  modified_base (305)..(305): a, c, t, g, unknown or other
  misc_feature (305)..(305): n is a, c, g, or t
tcagtctacgtagccacgaccggtgctcgatttagctcgatatagttgggtttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagcccccaaactcatcatttangaagtctctaagcggccctgagggtatctaatcgcttctctggctccaagtctggcaacacgcctccctgaccgtctctggccctccagactggaggacgaggctgattattactgcccactcatatagaagtagtactactctgttggtttcggcggaggaccagctgtaccgtctacggtcacgcccaaggcctcggccccctggtctcttctccg

SEQ ID NO: 203267 - DNA, 538 bp, Homo sapiens
  misc_feature: GYAE6OF02IZHIF.15.57.F02.1.454.CMB.1.raw
tcagtctacgtagccacgaccggtgctcgatttagctcgatatagttgggtttgggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacaccccaggcaaagcccccaaatcatcatttatgaagtctctaagcggccctcaggggtatctaatcgcttctctggctccaagtctggcaacacggccctccctgacccgtctcgtcggccctccagactgaggacgaggctgattattactgccactcatatagaagtagtactactcctgttcggttttcggcggtagggacagcgtgaccgtctaggtcacgacccaaggctcggtccccctcggtcctacgtcttcccgg

SEQ ID NO: 203268 - DNA, 520 bp, Homo sapiens
  misc_feature: GYAE6OF02F6GEL.15.57.F02.1.454.CMB.1.raw
tcagtctacgtagccacgaccggtgctcgatttagctcgatatagttgggtttgggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagcccccaaactcatcatttatgaagtctctaagcggccctcgaggggtatctaatcgcttctctggctccaagtctggcaacacgcctccctgaccgtctctcggcctccagactgaggacgaggctgattattactgccactcatatagaagtagtactactcctgttggtttcgcggaggacagctgaccgtcgtagtcacgccaaggctcgcccccgtggtcctactctccg

SEQ ID NO: 203269 - DNA, 534 bp, Homo sapiens
  misc_feature: GYAE6OF02HUXQE.15.57.F02.1.454.CMB.1.raw
tcagtctacgtagccacgaccggtgctcgatttagctcgatatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataacttttgtctcctggtaccaacaacacccaggcaaagccccaaactcatcatttatgaagtctctaagcggccctcaggggtatctaatcgcttctctggctccaagtctggcaacacggcctccctgatcgtctctggcctccagactgaggacgaggctgattattactgccactcataatagaagtagtactactcctgttggttttcggcgggagggaccaagctgaccgtcctaggtcagcccaaggcctcgcccctcggtcactcttcgttcccaccctcctcgcctacgtagactgacgcgggctggcaacggg

SEQ ID NO: 203270 - DNA, 538 bp, Homo sapiens
  misc_feature: GYAE6OF02JG6NV.15.57.F02.1.454.CMB.1.raw
tcagtctacgtagccacgaccggtgctcgatttagctcgatatagttgggtttgggggctttgcctgggctctgctgctcctcaccctcatcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagccccaaactcatcatttatgaagtctctaagcggccctcgagggtatctaatcgcttctctgctccaagtctggcaacacgcctcctgaccgtctctcggcctccagactggacggacgaggctgattattactcgccactcatatagaagtagtactactctgtgtttcggcggaggaccaagctgacgtctaggtcagacccaaggtcctcgcccctggtccacttctcgttaccccacccttcctccgacgttacgtacgacgtggacgcgggctcggctaacggg

SEQ ID NO: 203271 - DNA, 526 bp, Homo sapiens
  misc_feature: GYAE6OF02FO2DU.15.57.F02.1.454.CMB.1.raw
  modified_base (513)..(513): a, c, t, g, unknown or other
  misc_feature (513)..(513): n is a, c, g, or t
  modified_base (522)..(522): a, c, t, g, unknown or other
  misc_feature (522)..(522): n is a, c, g, or t
tcagtctacgtagccacgaccggtgctcgatttagctcgatatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagcccccaaactcatcatttatgaagtctctaagcggcccctcaggggtatctaatcgcttctctggctccaagtctggcaacacggcctccctgatcgtctctggcctccagactgaggacgaggctgattattactgccactcatatagaagtagtactactcctgttggttttcggcggtagggaccaagctgaccgtcctaggtcagcccaaggctcgcccctcgtccactctcgtcccgccctcctccgctacgtagctgngcggctggnacgg

SEQ ID NO: 203272 - DNA, 581 bp, Homo sapiens
  misc_feature: GYAE6OF02HN3L2.15.57.F02.1.454.CMB.1.raw
  modified_base (325)..(325): a, c, t, g, unknown or other
  misc_feature (325)..(325): n is a, c, g, or t
tcagtctacgtagccacgaccggtgctcgatttagctcgatatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccagacaacgccccaaactcatcatttatgaagtctactagccggccctacgagggtatctaatcgcttctctcggctccaagtcnggacaacgacggccctcctcgaccgtctctcggcctccagacgtgacggacgacggtctagtaattattactcgacctactcaatataagaagtattacctactcgtgttgggttcggacggtacggaccgagcgtcgaccgttccgtaggtaccaccgaccgtacgtcctccgtccccgtcgcctactccgtaccgtccctcccttccacgtacctaacgtacgcgtcggacggcggtcgacggtacgaggaccg

SEQ ID NO: 203273 - DNA, 571 bp, Homo sapiens
  misc_feature: GYAE6OF02HVH2V.15.57.F02.1.454.CMB.1.raw
  modified_base (245)..(245): a, c, t, g, unknown or other
  misc_feature (245)..(245): n is a, c, g, or t
  modified_base (563)..(563): a, c, t, g, unknown or other
  misc_feature (563)..(563): n is a, c, g, or t
tcagtctacgtagccacgaccggtgctcgatttagctcgatatagttgggtttgggggggggtcgtcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctctgcactggaaaccaacatttgacgttggngatttataactttgtctcctggtacaacaacaccaggcaaacgccccaaactcatcatttatagaagtctctaagcggcctcgagggtatctaatcgcttctctggctccaagtctggacaacgacgccctccctgacccgtctctaggcctccagactgaggacgaggctgtattattactcgctactctatactaagaagtaagtaccgtaacttccgtagttggttttccgggcggaacgggtaccaagctacgtacccgttcgtacggttcacggtacccgaaggcctccgccccccgttcggtctacccgttnttccccgg

SEQ ID NO: 203274 - DNA, 532 bp, Homo sapiens
  misc_feature: GYAE6OF02H7BWT.15.57.F02.1.454.CMB.1.raw
tcagtctacgtagccacgaccggtgctcgatttagctcgatatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataacttttgtctcctggtaccaacaacacccaggcaaagcccccaaatcatcatttatgaagtctctaagcggccctcaggggtatctaatcgcttctctggctccaagtctggcaacacggcctccctgaccgtctctggcctccagactgaggacgaggctgattattactgccactcatatagaagtagtactactcctgttggttttcggcggtagggaccaagctgaccgtctaggtcagcccgaaggctcgcccctcggtccactctcgttcccgccctcctccgctaccgtagactgacgcgggctggcaggcg

SEQ ID NO: 203275 - DNA, 303 bp, Homo sapiens
  misc_feature: GYAE6OF02H1PTI.15.57.F02.1.454.CMB.1.raw
  modified_base (300)..(303): a, c, t, g, unknown or other
  misc_feature (300)..(303): n is a, c, g, or t
tcagtctacgtagccacgaccggtgctcgatttagctcgatatagttgggtttgggatgagaacctatgaacattctgtaggggccactgtcttcaacacggcctccctgaccgtctctggcctccagactgaggacgaggctgattattactgccactcatatagaagtagtactactcctgtggttttcggcggagggaccaagctgaccgtcctaggtcagcccaaggctgccccctggtcactctgttcccgccctcctcgctacgtagactgagcgggctggcaaggcgcatagnnnn

SEQ ID NO: 203276 - DNA, 525 bp, Homo sapiens
  misc_feature: GYAE6OF02HU1BV.15.57.F02.1.454.CMB.1.raw
  modified_base (407)..(407): a, c, t, g, unknown or other
  misc_feature (407)..(407): n is a, c, g, or t
  modified_base (417)..(417): a, c, t, g, unknown or other
  misc_feature (417)..(417): n is a, c, g, or t
  modified_base (441)..(441): a, c, t, g, unknown or other
  misc_feature (441)..(441): n is a, c, g, or t
tcagtctacgtagccacgaccggtgctcgatttagctcgatatagttgggtttgggggggggtctcaggaggcagcgctctcaggacatctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatggttgggggttatcaccttgtctcctggtaccaacaccaccccggcagacgcccccaaactcatgattatgaggccactaagcgaccctcgaggtctttctaatcgtcttctctggctccaagtctggcacacggcctccctgacatctctggctccagctgacgagagntaattatacngctgctcatatgaaggttactaanactatactagttcgggacggacgggacaagtcgcgtacccgtctggtcgtacgacgcccgaaggcctcgtcccccgtggtaccc

SEQ ID NO: 203277 - DNA, 552 bp, Homo sapiens
  misc_feature: GYAE6OF02HS5DT.15.57.F02.1.454.CMB.1.raw
  modified_base (483)..(483): a, c, t, g, unknown or other
  misc_feature (483)..(483): n is a, c, g, or t
  modified_base (511)..(511): a, c, t, g, unknown or other
  misc_feature (511)..(511): n is a, c, g, or t
tcagtctacgtagccacgaccggtgctcgatttagctcgatatagttgggtttgggggggggtctcaggaggcagcgctctcaggacatctccaccatggcctgggctctgctgctcctcaccctcctcactcagggcacagggtcctgggcccagtctgccctgactcagcctgccctccgtgtctgggtctcctggacagtcatccacatctcctgcactggaaaccaacattgacgtttggtgtaattattaactttgtctcctggtaccaacaacaccaggacaaacgacccccaaactcatctatttatagaagtctactaagccgccctcgagggtatactaatcgcttctcgtgctaccaagtctggacaacgccgccctccgtcgaccgtctcgtcgccctccagctgacggacgagctgatttacttactcgcctactcactatagaagtagtactactcgttgttgtttcggnggacggacagctacgaccgtcgtacgtnacgaccgaaggctccgccccgtcggtacctactcgttcccg

SEQ ID NO: 203278 - DNA, 559 bp, Homo sapiens
  misc_feature: GYAE6OF02G1HHN.15.57.F02.1.454.CMB.1.raw
tcagtctacgtagccacgaccggtgctcgatttagctcgatatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaacgcccccaaactcatcatttatgaagtctctaagcggccctcaggggtatctaatcgcttctctggctccaagtctggcaacacggcctccctgaccgtctctggcctccagactgaggcgagctgattatactgccactcatatagaagtagtactactcttggttggttttcggcggtacggacgaagctagaccgtcgtaggtacacgacccgaaggccgtcgtcccccgtcggttccactccttcgttaccccacccgtccctccgctacgttacgacgtcggtacggccggcgtcggcgaggtccg

SEQ ID NO: 203279 - DNA, 539 bp, Homo sapiens
  misc_feature: GYAE6OF02GB2JV.15.57.F02.1.454.CMB.1.raw
tcagtctacgtagccacgaccggtgctcgatttagctcgatatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagcccccaaactcatcatttatgaagtctctaagcggccctcaggggtatctaatcgcttctctggctccaagtctggcaacacggcctccctgaccgtctctggcctccagactgaggacgaggctgattatactgccactcatatagaagtagtactactcctgtggttttcggcggaggaccaagctgaccgtcctaggtcacgccaaggctgccccctcggtccactctcgttccccacccgttcctccgtctacgtacgacgtcgaggccgggctcgggctaggccg

SEQ ID NO: 203280 - DNA, 575 bp, Homo sapiens
  misc_feature: GYAE6OF02F67AX.15.57.F02.1.454.CMB.1.raw
tcagtctacgtagccacgaccggtgctcgatttagctcgatatagttgggtttgggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgatcataactttgtctcctggtaccaacaacacccaggcaaacgccccaaactcatcatttatgaagtctactaagcggccctcaggggtatctaatcgtcttctctggctcaagtctgcaacacgcctccctcgaccgtctcgtcggccctccacgactggacggacggaggctagtattattactgccactcatatagaagttacgtacttacctccgttggtttggttttccgggacgggtacgggtaccgaagccgtacggtacccgttaccgttacggtccacggtcccgaacgggtcctccggccccctccggtccaccgttcccg

SEQ ID NO: 203281 - DNA, 573 bp, Homo sapiens
  misc_feature: GYAE6OF02HFI66.15.57.F02.1.454.CMB.1.raw
  modified_base (269)..(269): a, c, t, g, unknown or other
  misc_feature (269)..(269): n is a, c, g, or t
tcagtctacgtagccacgaccggtgctcgatttagctcgatatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgatttataactttgtctcctggtaccaacaacacccaggcaaagcccccaaatcatcatttangaagtctctaagcggcctcaggggtatctaatcgcttctctggctccaagtctggcaacacggcctccctgaccgtctctggcctcagactgaggcgaggctgattatactgaccactcatatagaatagtactactctgttggtttcggcggaggaccaagctacgaccgttccgtaggtcacgcccgaaggcctaccgcccccgtcgtccgtacctccgttccgttccccgccccttcccgtccgtaccgttaccgtacgtacctacggaccggtccgggccgtacggccggtaacggccgg

SEQ ID NO: 203282 - DNA, 537 bp, Homo sapiens
  misc_feature: GYAE6OF02JGRYZ.15.57.F02.1.454.CMB.1.raw
  modified_base (238)..(238): a, c, t, g, unknown or other
  misc_feature (238)..(238): n is a, c, g, or t
tcagtctacgtagccacgaccggtgctcgatttagctcgatatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacncccaggcaaagccccaaatcatcatttatgaagtctctaagcggccctcaggggtatctaatcgcttctctggctccaagtctggcaacacggcctcctgaccgtctctggcctcagactgaggcgagctgattattactgccactcatatagaagtagtactactcctgtggtttcggcggaggaccagctgaccgtctaggtcacgccaaggctcgcccctcggtccactcctcgttccccgcccttcctccgtctaccgtacgaccgtcgacggccggtctcggaccgaaggtccg

SEQ ID NO: 203283 - DNA, 519 bp, Homo sapiens
  misc_feature: GYAE6OF02G91T4.15.57.F02.1.454.CMB.1.raw
tcagtctacgtagccacgaccggtgctcgatttagctcgatatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagcccccaaatcatcatttatgaagtctctaagcggccctcaggggtatctaatcgcttctctggctccagtctggcacacgcctcctgacctctctcggcctcagactgaggacgaggtctgattacttactgccactcatatagaatagtactactcttgtggtttcggcggagggacagctgaccgtctaggtcagccacggctcgccccgtcgtcactctcgttcccacctcctccgctacgtacacgtgcgcggctcggacgaggcg

SEQ ID NO: 203284 - DNA, 528 bp, Homo sapiens
  misc_feature: GYAE6OF02FPIDC.15.57.F02.1.454.CMB.1.raw
  modified_base (418)..(418): a, c, t, g, unknown or other
  misc_feature (418)..(418): n is a, c, g, or t
tcagtctacgtagccacgaccggtgctcgatttagctcgatatagttgggtttgggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagcccccaaactcatcatttatgaagtctctaagcgcctcagggtatctaatcgcttctctggctcaagtctggcacacgcctccctgaccgtctcgtcggccctccagactgaggacgaggctgattattacngtaccactcatatagaagtagtactactctgttcggtttcgcggaggaccagcgtcgaccgtcgtagtcacgcccgaaggcctcgccccctcggtctaccgtcttacccg

SEQ ID NO: 203285 - DNA, 651 bp, Homo sapiens
  misc_feature: GYAE6OF02IUUT9.15.57.F02.1.454.CMB.1.raw
  modified_base (313)..(313): a, c, t, g, unknown or other
  misc_feature (313)..(313): n is a, c, g, or t
  modified_base (398)..(398): a, c, t, g, unknown or other
  misc_feature (398)..(398): n is a, c, g, or t
tcagtctacgtagccacgaccggtgctcgatttagctcgatatagtttgggtttgggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctccgtggtaccaacaacaccccaggacaaacgcccccaaactcaatcattttanagtaacgtctacgtaagcggccctcgaggggttatacgtaaactcgcctttctcgtggcctacccgaagttcctcggactaaacnccggacccttcccgtgtacccgtcttcgtcgccctcacgacgtaggaggacggaggtcgttgtaactttaacgttactcgaccctacgtactataagtaagtaaagtaacgttacgttaaccgttcgtttcgttgggtttttccggacggggtaacgggaccgtaacgtccgtacggtacccggtacgttaacgggtccaccggtcccgaaggtccgtaccggtccccctccggtacctaccgtccttcccgg

SEQ ID NO: 203286 - DNA, 535 bp, Homo sapiens
  misc_feature: GYAE6OF02GPHER.15.57.F02.1.454.CMB.1.raw
tcagtctacgtagccacgaccggtgctcgatttagctcgatatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagcccccaaactcatcatttatgaagtctctaagcggcccctcaggggtatctaatcgcttctctggctccaagtctggcaacacggcctccctgaccgtctctggcctccagactgaggacgaggctgtattattactgccactcatatagaagtagtactactctgtggtttcggcggaggacagctgaccgtctaggtcacgccaggctcgcccctcggtccactctcgttcccgtccctcctccgcctacgtacgccgtgacggccggcgtcggaccgaggccg

SEQ ID NO: 203287 - DNA, 635 bp, Homo sapiens
  misc_feature: GYAE6OF02II7DD.15.57.F02.1.454.CMB.1.raw
  modified_base (190)..(190): a, c, t, g, unknown or other
  misc_feature (190)..(190): n is a, c, g, or t
  modified_base (225)..(225): a, c, t, g, unknown or other
  misc_feature (225)..(225): n is a, c, g, or t
  modified_base (348)..(348): a, c, t, g, unknown or other
  misc_feature (348)..(348): n is a, c, g, or t
tcagtctacgtagccacgaccggtgctcgatttagctcgatatagttgggtttgggggctttgcctgggctctgctgctcctcaccctcctcactcagggcacagggtcctgggccagtctgccctgactcagcctgcctcgtgtctgggtctcctggacagtcgatcacatctctgcactggaaccaanattgacgttggtgattataactttgctctgacaanaacaccaggtcaaagcccaaatcatcatttatgtaagtctactaacgcgcctacgaggggtatactaatctcttctcgtggctcctaaacgtctcggacaaacacggtcctcctgaccgttcncgtcggacctcagtacgtgaacggacgaggactgtaacttatacgtctaccatcaataacgtaagtaaacgtacgttactaactccgttggtacggttttcgggcggaagggaaccaagtacgtcggtaccgttacgtacggtacgacgtccgaaagggtcctccggccccgttcggtacctaacgttccgttacgttcccggtccccttccgtaccgtccggtaaccgttaaggtacccgtaaggtccggaaccgggtccggttacggtaccggaacgggtaccgg

SEQ ID NO: 203288 - DNA, 519 bp, Homo sapiens
  misc_feature: GYAE6OF02F2GFB.15.57.F02.1.454.CMB.1.raw
  modified_base (401)..(401): a, c, t, g, unknown or other
  misc_feature (401)..(401): n is a, c, g, or t
  modified_base (428)..(428): a, c, t, g, unknown or other
  misc_feature (428)..(428): n is a, c, g, or t
  modified_base (483)..(483): a, c, t, g, unknown or other
  misc_feature (483)..(483): n is a, c, g, or t
  modified_base (511)..(511): a, c, t, g, unknown or other
  misc_feature (511)..(511): n is a, c, g, or t
tcagtctacgtagccacgaccggtgctcgatttagctcgatatagttgggtttgggggctttgcctgggctctgctgctcctcaccctcctcactcagggcacagggtcctgggcccagtctgccctgacccctcagcctgcctccgtgtctgggtctcctggacagtcgatcaccatctcctgcactggaaccaacattgacgttggtgattataactttgtctcctggtaaccaacaacacccaggcaaacgcccccaaatcatcatttatgaagtctctaaagcggccctcgaggggtatctaatcgcttctctggctccaagtctggcaacacggcctccgtgaccgtctctggcctcagactgaggacgaggctagattattactgccactcatanagaagtagtactactctgtgtttcggngaggacagctgaccgtctagcacgccaaggctcgcccctggtcactctcgtcccncctcctcgctacgtgcgtcgacgcggcnggacagcg

SEQ ID NO: 203289 - DNA, 527 bp, Homo sapiens
  misc_feature: GYAE6OF02I4H4I.15.57.F02.1.454.CMB.1.raw
tcagtctacgtagccacgaccggtgctcgatttagctcgatatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgatttataactttgtctcctggtaccaacaacacccaggcaaagcccccaaatcatcatttatgaagtctctaagcggccctgaggggtatctaatcgcttctctggctccaagtctggcaacacggcctcctgaccgtctctggcctccagactggaggacgaggctgattatactgccactcatatagagtagtactactctgtggtttcggcggaggaccagctgaccgtcgtaggtcacgaccgaagctccgcccgtcgtcactctcgttcccaccgtcctcgctacgtacgacgtgacggcggctcggacgaggcg

SEQ ID NO: 203290 - DNA, 576 bp, Homo sapiens
  misc_feature: GYAE6OF02JC3PB.15.57.F02.1.454.CMB.1.raw
  modified_base (231)..(231): a, c, t, g, unknown or other
  misc_feature (231)..(231): n is a, c, g, or t
  modified_base (244)..(244): a, c, t, g, unknown or other
  misc_feature (244)..(244): n is a, c, g, or t
  modified_base (305)..(305): a, c, t, g, unknown or other
  misc_feature (305)..(305): n is a, c, g, or t
  modified_base (365)..(365): a, c, t, g, unknown or other
  misc_feature (365)..(365): n is a, c, g, or t
  modified_base (395)..(395): a, c, t, g, unknown or other
  misc_feature (395)..(395): n is a, c, g, or t
tcagtctacgtagccacgaccggtgctcgatttagctcgatatagttgggtttgggggggggtctcaggaggcagcgctctcaggacatctccaccatggcctgggctctgctgctcctcaccctcctcactcagggcacagggtcctgggcccagtctgccctgactcagcctgcctccgtgtctggtctcctggacagtcgatcaccatctcctgccactggaaccaanattgacgttggtnattataacttgtctcctggtaccaacaacaccaggcaaacgcccccaaactcatcatttangaagtctctaagcgcctacgagggtatctaatcgcttctgtcggctcaagtctggcaacncggcctcctgtaccgtctcgtcgcctccanactaggacggacgacgtcgtgtacttattaacgtcgtacctactctaatagtaagtaagtagttactactcttacgttggttttcgggcggtaggaccgtaagcgtacgtacccgttacgtagtccgacgacccgtaaggtcctaccggtcccccgttacgtccgtactacccgttcccgg

SEQ ID NO: 203291 - DNA, 524 bp, Homo sapiens
  misc_feature: GYAE6OF02GTP4I.15.57.F02.1.454.CMB.1.raw
  modified_base (288)..(288): a, c, t, g, unknown or other
  misc_feature (288)..(288): n is a, c, g, or t
  modified_base (329)..(329): a, c, t, g, unknown or other
  misc_feature (329)..(329): n is a, c, g, or t
  modified_base (382)..(382): a, c, t, g, unknown or other
  misc_feature (382)..(382): n is a, c, g, or t
tcagtctacgtagccacgaccggtgctcgatttagctcgatatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagcccccaaatcatcatttatgaagtctctaagcggccctnaggggtatctaatcgcttctctggctccaagtctggcaacncggcctccctgaccgtctctggcctcagactgaggacgaggctgattattacngccactcatatagaagtagtactactctgttggtttcggcggagggaccagctgaccgtcgtaggtcacgcccgaaggctcgcccctcggtcactctcgtcccgcctcctccgctacgtcgacgtgacgcggctggcaggcg

SEQ ID NO: 203292 - DNA, 251 bp, Homo sapiens
  misc_feature: GYAE6OF02IA3L2.15.57.F02.1.454.CMB.1.raw
  modified_base (250)..(251): a, c, t, g, unknown or other
  misc_feature (250)..(251): n is a, c, g, or t
tcagtctacgtagccacgaccggtgctcgatttagctcgatatagttgggtttggggggtgtggtggtctccactcccgccttgacgaggctgattattactgccactcatatagaagtagtactactcctgtggttttcggcggagggaccaagctgaccgtcctaggtcagcccaaggctgccccctcggtcactctgttcccgccctcctcgctacgtagactgagcgggctggcaaggcgcatagnn

SEQ ID NO: 203293 - DNA, 565 bp, Homo sapiens
  misc_feature: GYAE6OF02HC0WC.15.57.F02.1.454.CMB.1.raw
tcagtctacgtagccacgaccggtgctcgatttagctcgatatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagcccccaaatcatcattttatgaagtctctaagcggccctcaggggtatctaatcgcttctctggctccaagtctggcaacaccggcctccctgaccgtctctggcctccagactgaggacgaggctgtattattactgccactcatataagaagtatactactcctgttggtttcggcggtacgggaccaaggctcgtacccgtcgtaggttccacgtcccgaagggtctccggccccctcggtaccactcctcgttcccacccgttccctccgtactaccgtactacgtcgacggccggtcgtcggacaggtccg

SEQ ID NO: 203294 - DNA, 530 bp, Homo sapiens
  misc_feature: GYAE6OF02G6M0L.15.57.F02.1.454.CMB.1.raw
tcagtctacgtagccacgaccggtgctcgatttagctcgatatagttgggtttgggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagcccccaaactcatcatttatgaagtctactaagcggccctcaggggtatctaatcgcttctctggctcaagtctggcaacacgcctccctcgaccgtctctcggcctccagacgtgaggacgaggtctagtattattactgcctactcatatagaagtacgtactactcctgttggtttcggcggtaggacagctgaccgtctacggtcacgccaaggctcgccccgtcggtcctctcttcccg

SEQ ID NO: 203295 - DNA, 582 bp, Homo sapiens
  misc_feature: GYAE6OF02IMFIL.15.57.F02.1.454.CMB.1.raw
  modified_base (233)..(233): a, c, t, g, unknown or other
  misc_feature (233)..(233): n is a, c, g, or t
  modified_base (377)..(377): a, c, t, g, unknown or other
  misc_feature (377)..(377): n is a, c, g, or t
  modified_base (435)..(435): a, c, t, g, unknown or other
  misc_feature (435)..(435): n is a, c, g, or t
tcagtctacgtagccacgaccggtgctcgatttagctcgatatagttgggtttgggggggggtctcaggaggcagcgctctcaggacatctccaccatggcctgggctctgctgctcctcaccctcctcactcagggcacagggtcctgggcccagtctgccctgacctcagcctgcctccgtgtctgggtctcctggacagtcgatcaccatctcctgcactggaaccaacnttgacgttggtgattataacttttgtctcctggtaccaacaacacccaggcaaacgcccccaaactcatctatttatgaagtctactaagcggccctcgagggtactctaatcgtcttctctggtcctccaagtctggacaacncggcctcctgaccgtctctcgcctcgacgctagacggacgagctagtattacttactncccgactctatatagaagttacgttactacttccttggttcgttttcgggacgggtaacggtaccaagtcgtacgtacccggttcgttaaggtccgaacgtcccgaagggcctccggtacccccgtcggtcctacctccgttcccgg

SEQ ID NO: 203296 - DNA, 736 bp, Homo sapiens
  misc_feature: GYAE6OF02JSNDZ.15.57.F02.1.454.CMB.1.raw
  modified_base (166)..(166): a, c, t, g, unknown or other
  misc_feature (166)..(166): n is a, c, g, or t
  modified_base (199)..(199): a, c, t, g, unknown or other
  misc_feature (199)..(199): n is a, c, g, or t
  modified_base (212)..(212): a, c, t, g, unknown or other
  misc_feature (212)..(212): n is a, c, g, or t
  modified_base (273)..(273): a, c, t, g, unknown or other
  misc_feature (273)..(273): n is a, c, g, or t
  modified_base (468)..(468): a, c, t, g, unknown or other
  misc_feature (468)..(468): n is a, c, g, or t
tcagtctacgtagccacgaccggtgctcgatttagctcgatatagttgggtttgggggtcgtttgtccgtgggctctgctgctcctcaccctcctcactcagggcacagggtcctgggcccagtctgccctgactcagcctgcctccgtgtctgggtctctggacngtcgatcaccgatctcctgacactggaaccaanattgacgttggtnattatactttgcttctggtaccaacaacacccaggacaaacgtccccaaatcatcatttangaagtctacgtaacgcggtaccctcggaggggtactcttaaatccggtctttcctacgttcggacctaccaagttccgtaggccctaaacgcccgggtcccttcccctaccgggtaccttccgtccgttcggggaccctttaccgacgtacctgggacggtacggagggcttaggtaaacttacgttttaaccgngacccctattaccctagttaagtaacgtaacggtaattaaccgttaaccttaccggttggtttcgggttttaccgggacgggttacgggaccgtaaaggaccgtcggtaaacccgttcgtaacgggttaccacggtacccgtaaggccgttacccgccccgttaccgggttcaaccttcgttcccgttaacccgtcccgttccctaccgttccgtaacggtaccgtacgttacgggacgtccggggttacagggtacgacgggtaccg

SEQ ID NO: 203297 - DNA, 310 bp, Homo sapiens
  misc_feature: GYAE6OF02GDV7W.15.57.F02.1.454.CMB.1.raw
  modified_base (296)..(296): a, c, t, g, unknown or other
  misc_feature (296)..(296): n is a, c, g, or t
  modified_base (302)..(310): a, c, t, g, unknown or other
  misc_feature (302)..(310): n is a, c, g, or t
tcagtctacgtagccacgaccggtgctcgatttagctcgatatagttgggtttgggatgagaacctatgaacattctgtaggggccactgtcttcaacacggcctccctgaccgtctctggcctccagactgaggacgaggctgattattactgccactcatatagaagtagtactactcctgtggttttcggcggagggaccaagctgaccgtcctaggtcagcccaaggctgccccctcggtcactctcgttccccgccctcctcgctacgtagactgagcgggctggcaggcncatagnnnnnnnnn

SEQ ID NO: 203298 - DNA, 613 bp, Homo sapiens
  misc_feature: GYAE6OF02JV9X1.15.57.F02.1.454.CMB.1.raw
  modified_base (352)..(352): a, c, t, g, unknown or other
  misc_feature (352)..(352): n is a, c, g, or t
tcagtctacgtagccacgaccggtgctcgatttagctcgatatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctctggtaccaacaacaccaggcaaacgccccaaaactcatcatttaatgaacgtctctaagccggccctcgaggggtatctaatcgcttctcgtggctaccaagtctggcaacacggcctcctgaccgtcncgtggcctcagactgaggacgagctgattatctcgcactacatataagaagtagtaactactctgtggtttcggacggtacggacaagtcgtacgtaccgtacgtagcgacgacccgaacgccgtacgtcccccgttcggacctaccgttaccgttccggttaccccgtaccccgttcccgttaccgtaccgttaaccggtaacggttaccgtacgggtaacgggtcccgggtacggttacggggacccgtaagggacccg

SEQ ID NO: 203299 - DNA, 304 bp, Homo sapiens
  misc_feature: GYAE6OF02FTV7G.15.57.F02.1.454.CMB.1.raw
  modified_base (302)..(304): a, c, t, g, unknown or other
  misc_feature (302)..(304): n is a, c, g, or t
tcagtctacgtagccacgaccggtgctcgatttagctcgatatagttgggtttgggatgagaacctatgaacattctgtaggggccactgtcttcaacacggcctccctgaccgtctctggcctccagactgaggacgaggctgattattactgccactcatatagaagtagtactactcctgtggttttcggcggagggaccaagctgaccgtcctaggtcagcccaaggctgccccctcggtcactctcgttcccgccctcctcgctacgtagactgagcgggctggcaaggcgcatagnnn

SEQ ID NO: 203300 - DNA, 629 bp, Homo sapiens
  misc_feature: GYAE6OF02GEB74.15.57.F02.1.454.CMB.1.raw
  modified_base (331)..(331): a, c, t, g, unknown or other
  misc_feature (331)..(331): n is a, c, g, or t
tcagtctacgtagccacgaccggtgctcgatttagctcgatatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaaccaacattgacgtttggtgattataactttgcttcctggtaccaacaacaccaggcaaacgccccaaactcatcatttatgaagtctctaagcggccctgaggggtactctaatcgcttctctggctcaagttctggcaacncggcctcctgaccttctctggcctcagtactggacggacgaggtcttggaatttacgttaactggaccctacgtcaattactaagtaaacgttagttactaacttccgttcggttacggttttccgggcgggtacgggaccgaacggtctacggtacccgtaccgttacggtctacgcccgtaaggtcctcgcccccgtcggtaccgtacgttccggttaccccgcccgttcccgtccgtaccgttacgtacgtaccgttaggacggtccgggtcgtcgggacggtacgggctaccgg

SEQ ID NO: 203301 - DNA, 633 bp, Homo sapiens
  misc_feature: GYAE6OF02HJ11P.15.57.F02.1.454.CMB.1.raw
tcagtctacgtagccacgaccggtgctcgatttagctcgatatagttgggtttgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgtattataactttgtctcctggtaccaacaacaccagcaaacgccccaaactcatcatttatagtaagtctctaagcgtccctcgagggtatctaatcgtcttctctcgctccaagtcgtgacaacgaccggccctcccgtcgaccgttcctcgtcggtcccttaccacgtacctaggaacggtacggaacgggcgtagtaagtttaacgtttaacgttcgtacccgtacttactacgtaacttaacgtaacgttaacgttacttacctccgttaggttcggttttccggacggtacgggacctaagggctacggtacccgtccgttaacggtccaacggaccctaaggccgttcccgtacccccgttccggtcctaccgtcccgttcccgg

SEQ ID NO: 203302 - DNA, 546 bp, Homo sapiens
  misc_feature: GYAE6OF02F1LU2.15.57.F02.1.454.CMB.1.raw
tcagtctacgtagccacgaccggtgctcgatttagctcgatatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagcccccaaatcatcatttatgaagtctctaagcggccctcaggggtatctaatcgcttctctggctccaagtctggcaacacgcctcctgaccgtctctggcctcagactgaggacgaggctgattattactgccactcatatagaagtagtactactcctgtggttttcggcggtacggacaagctcgaccgttccaggttccacgcccgaacgctcgccccgtcgtcctaccttctcttccccaccctccctccgtactacgtagtactcggacggccgggcgtcggcgacggtcg

SEQ ID NO: 203303 - DNA, 554 bp, Homo sapiens
  misc_feature: GYAE6OF02HIGVU.15.57.F02.1.454.CMB.1.raw
  modified_base (270)..(270): a, c, t, g, unknown or other
  misc_feature (270)..(270): n is a, c, g, or t
tcagtctacgtagccacgaccggtgctcgatttagctcgatatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaacgcccccaaactcatcatttangaagtctctaagcggccctcgaggggtatctaatcgcttctctggctcaagtctggcaacacggcctcctgaccgtctctcggcctccagactgaggacgtagctagattatactgcctactcatataagaagtagtactactctgttggtttcggcggaggaccgagctcgaccgtcgtacggtcacgcccgaaggtcctccgccccgtcgtaccacgtcctccgttcccgtcccgttcctcgtctaacgtacgacgtgacggcggtcgtcggtacgacggcg

SEQ ID NO: 203304 - DNA, 524 bp, Homo sapiens
  misc_feature: GYAE6OF02F0XVC.15.57.F02.1.454.CMB.1.raw
  modified_base (289)..(289): a, c, t, g, unknown or other
  misc_feature (289)..(289): n is a, c, g, or t
  modified_base (348)..(348): a, c, t, g, unknown or other
  misc_feature (348)..(348): n is a, c, g, or t
  modified_base (423)..(423): a, c, t, g, unknown or other
  misc_feature (423)..(423): n is a, c, g, or t
tcagtctacgtagccacgaccggtgctcgatttagctcgatatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaaccaacattgacgtttggtgattataactttgtctcctggtaccaacaacacccaggcaaagcccccaaatcatcatttatgaagtctctaagcggccctnaggggtatctaatcgcttctctggctccaagtctggcaacacggcctcccctgaccgtntctggcctcagactgaggacgaggctgattattactgccactcatatagaagtagtactactctgtggtttcggnggaggacaagctgaccgtctaggtcacgcccaaggctcgcccctcggtcactctcgtcccgccctcctccgctacgtacgacgtgcgcggcgtggcaggcg

SEQ ID NO: 203305 - DNA, 594 bp, Homo sapiens
  misc_feature: GYAE6OF02GI4ZM.15.57.F02.1.454.CMB.1.raw
  modified_base (331)..(331): a, c, t, g, unknown or other
  misc_feature (331)..(331): n is a, c, g, or t
tcagtctacgtagccacgaccggtgctcgatttagctcgatatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaaccacccaggcaaacgcccccaaatcatcattatgaagtctctaagccggccctcgagggtatctaatcgcttctctggctccagtctggacaacncgcctccctgaccgtctctcgcctccagactggacggacgacggctagacttatactcgaccactacatatagaagttagtactactccgttggttcggtttcggacggtaggaccgaagtctacgtaccgtccgtaggtccacgtacccgaacggtcctccgccccgtcggtaccaccgttccttccgttccccgcccgttcccgtaccgtaccgttacgtacgtaccgtacggacggtccggtcgtcggacgacggtaccg

SEQ ID NO: 203306 - DNA, 617 bp, Homo sapiens
  misc_feature: GYAE6OF02IAIKC.15.57.F02.1.454.CMB.1.raw
  modified_base (243)..(243): a, c, t, g, unknown or other
  misc_feature (243)..(243): n is a, c, g, or t
  modified_base (253)..(253): a, c, t, g, unknown or other
  misc_feature (253)..(253): n is a, c, g, or t
tcagtctacgtagccacgaccggtgctcgatttagctcgatatagttgggtttgggggggggtcgtcaggaggcagcgctctcaggacatctccaccatggcctgggctctgctgctcctcaccctctcactcagggcacagggtcctgggcccagtctcgccctgactcagcctgcctccgtgtctgggtctcctggacagtcgatcaccatctctgcactggaaaccacattgacgttggnatcatacttntctctgtacaacaacaccagcaacgccccaatcatctattatagacttctactaacggccgccctacgagggtactcaatcgcttctctggtctcctaagtcaggtaccaacgaccggtccctcccgtaggtcccgttcctcgtcggccccttcgaacgtactgggacggacggacggctgtaactttacgttactcggtccctaagttcacgttaagtaacgtaagtacgttaacctacgtcccgtttgttaccgggtttcggaggtaacggaccgacgtcggtaccgtaaccgtaccgttcggtaccgacggtcccgtaacggcccgtcccgtaccccggttcgtacccgtaccgtttcccg

SEQ ID NO: 203307 - DNA, 608 bp, Homo sapiens
  misc_feature: GYAE6OF02GZBLT.15.57.F02.1.454.CMB.1.raw
  modified_base (231)..(231): a, c, t, g, unknown or other
  misc_feature (231)..(231): n is a, c, g, or t
  modified_base (243)..(243): a, c, t, g, unknown or other
  misc_feature (243)..(243): n is a, c, g, or t
  modified_base (300)..(300): a, c, t, g, unknown or other
  misc_feature (300)..(300): n is a, c, g, or t
  modified_base (341)..(341): a, c, t, g, unknown or other
  misc_feature (341)..(341): n is a, c, g, or t
  modified_base (352)..(352): a, c, t, g, unknown or other
  misc_feature (352)..(352): n is a, c, g, or t
tcagtctacgtagccacgaccggtgctcgatttagctcgatatagttgggtttgggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccaanattgacgttggnattataactttgtctctgtaccaacaacaccaggcaaagccccaaatcatcatttangaagtctactaagccgcctcgagggtatctaatcgcttctngctccaagtcnggcaacgcgtcctcctgacccgtcgtctcggccctccgagacgtgaacggacgacggtctggtattaagttacgtacgtaccctacgtactataataacgaaagttacgtaacctacttaccgttggtttacggttttcgggacgggtacgggaaccgtaaggccgtacggtacccggttccgtaggtcccaacggtaccccgaaggtcccgtacccgtccccccgttaggtacccttaccgttcccgtttccccg

SEQ ID NO: 203308 - DNA, 543 bp, Homo sapiens
  misc_feature: GYAE6OF02GU1CV.15.57.F02.1.454.CMB.1.raw
tcagtctacgtagccacgaccggtgctcgatttagctcgatatagttgggtttgggggggggtctcaggaggcagcgctctcaggacatctccaccatggcctgggctctgctgctcctcaccctcctcactcagggcacagggtcctgggcccagtctgccctgactcagcctgcctcgtgtctgggtctcctggacagtcgatcaccatctcctgcactggaaccaacattgacgttggtgattataactttgtctctggtaccaacaacaccaggcaaacgccccaaactcatcatttatgaagtctactaagcggcctcgagggtactctaatcgcttctctggctacaagtctcggacaacacggtacctcccgtcgaccgtctcgtcgccctcagactgacggacgagctagacttattactcgccactcatagagaagtacgtactactcgttgttggtttccggcggtacgacgtagctcggtaccgtcgtaaggtcacgtaccgagctcgtccccgtcgtctaccgtcttcccg

SEQ ID NO: 203309 - DNA, 708 bp, Homo sapiens
  misc_feature: GYAE6OF02ID6MF.15.57.F02.1.454.CMB.1.raw
  modified_base (201)..(201): a, c, t, g, unknown or other
  misc_feature (201)..(201): n is a, c, g, or t
  modified_base (233)..(233): a, c, t, g, unknown or other
  misc_feature (233)..(233): n is a, c, g, or t
  modified_base (244)..(244): a, c, t, g, unknown or other
  misc_feature (244)..(244): n is a, c, g, or t
tcagtctacgtagccacgaccggtgctcgatttagctcgatatagttgggtttggggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacngtcgatccacatcctcctgcactggaaccatnttgacgttggngtaattattaactttgtctccgtgtaccaactaacacccgaggaccaaacgcccccaaacgtcatacctattttacagaagttcctactaaggccggaccctcggaacgggttatacgtatccggtcttctcgtcggtctaccgaagttcgtacgacgaaccgaccggtccctcccgtacgacccgttctacgtccggtccctaccgacgtacgtacggtaacggaacggtacggtaccgtacgtaactttaacgttaccgtaccgtacctaacctcgtaataacttaaaggaacgttaacgttaaacctccgttaccgtttcgggtttaccgttttcggggaaccggtaacgggtaacccgtaaggttcccgtaacggccggtaccggtaccggtacgaacccgccggtaacggtccctaaccggttccccccgtacggtaccttaccgtcccgttaccccgg

SEQ ID NO: 203310 - DNA, 252 bp, Homo sapiens
  misc_feature: GYAE6OF02GLE09.15.57.F02.1.454.CMB.1.raw
  modified_base (249)..(252): a, c, t, g, unknown or other
  misc_feature (249)..(252): n is a, c, g, or t
tcagtctacgtagccacgaccggtgctcgatttagctcgatatagttgggtttggggggtgtggtggtctccactcccgccttgacgaggctgattattactgccactcatatagaagtagtactactcctgtggttttcggcggagggaccaagctgaccgtcctaggtcagcccaaggctgccccctcggtcactctgttcccgccctcctcgctacgtagactgagcggctggcaaggcgcatagnnnn

SEQ ID NO: 203311 - DNA, 695 bp, Homo sapiens
  misc_feature: GYAE6OF02JGA6R.15.57.F02.1.454.CMB.1.raw
  modified_base (205)..(205): a, c, t, g, unknown or other
  misc_feature (205)..(205): n is a, c, g, or t
tcagtctacgtagccacgaccggtgctcgatttagctcgatatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaaccacattgacgttggngattattaactttgtcttccgtgtaccaacaacacccgaggaccaaacgcccccaaactcactctatttatagaagtctacgtaagccggccctacgaggggtatactaactcgcttactcgtcggccttaccgaagttcgtggacctaaccgacggtaccctcccctacggaccgttcctcgtacggccctctacgacgttggaacggtacggacgtcgtgtaactttatacctcgccctactctaatataagtaacgtacgttaactaccgttccgttgtttcggtttcgggccgggtaacgggtaccgtacgtacgtacggtaccgtccgtaaggtccgtaacgtacccgtaaacgggtccctaccggttccccccgtcggttacccgtaccgttccgttcccgttaccccggtcccccttcccgtaccgttcccgtaaccgtacgtaccgtcggacggtccggtcgtacggacggtacggtaccgg

SEQ ID NO: 203312 - DNA, 742 bp, Homo sapiens
  misc_feature: GYAE6OF02IU9CP.15.57.F02.1.454.CMB.1.raw
tcagtctacgtagccacgaccggtgctcgatttagctcgatatagttgggtttggggggggggtctcaggaggcagcgctctcaggacatcctccaccatggcctgggctctgctgctcctccaccctcctcactcagggcacgagggtcctcgggcccagtctcgccctgactcagcctgcctcgtgtcgtgggtcctccgtggacagtcgatcaccatcctcctgaccacgtacggaaaccaactacgttgtacggttggtagtaatttaacttaactttcgtccttccgttacggtaacccaaccaaaccaacccgacggaaccaaaaccgacccccaaactacactactatttagtagtaacgtcctacgtacggcccggtacccgtacggtagggttactacgtaagtaccgtcttccgtcgtcggtaccctacgtaacgtcgtacgaccaaccgaccggtcccctcccgtacggtacccgttccgtcgtccggtccctaccgacgtacgtcggaacggacggtacggtcgttagtaattacttacgtctaccgacttactataacgtaagtaacgttaacgtaccttaaccgttccggtttacgggtttcgggtttccgggaccgggtacggaaccgtacggtaccgtaccgtacccggttccgtacgtaccgaccgtacccgtaacggtcccgtacccgtccccgttaccggtaccttaccgtcccgtttccccg

SEQ ID NO: 203313 - DNA, 528 bp, Homo sapiens
  misc_feature: GYAE6OF02FVUTH.15.57.F02.1.454.CMB.1.raw
  modified_base (268)..(269): a, c, t, g, unknown or other
  misc_feature (268)..(269): n is a, c, g, or t
  modified_base (275)..(275): a, c, t, g, unknown or other
  misc_feature (275)..(275): n is a, c, g, or t
  modified_base (292)..(292): a, c, t, g, unknown or other
  misc_feature (292)..(292): n is a, c, g, or t
  modified_base (302)..(302): a, c, t, g, unknown or other
  misc_feature (302)..(302): n is a, c, g, or t
  modified_base (307)..(307): a, c, t, g, unknown or other
  misc_feature (307)..(307): n is a, c, g, or t
  modified_base (311)..(311): a, c, t, g, unknown or other
  misc_feature (311)..(311): n is a, c, g, or t
  modified_base (316)..(316): a, c, t, g, unknown or other
  misc_feature (316)..(316): n is a, c, g, or t
  modified_base (324)..(324): a, c, t, g, unknown or other
  misc_feature (324)..(324): n is a, c, g, or t
  modified_base (330)..(330): a, c, t, g, unknown or other
  misc_feature (330)..(330): n is a, c, g, or t
  modified_base (376)..(376): a, c, t, g, unknown or other
  misc_feature (376)..(376): n is a, c, g, or t
  modified_base (485)..(485): a, c, t, g, unknown or other
  misc_feature (485)..(485): n is a, c, g, or t
  modified_base (516)..(516): a, c, t, g, unknown or other
  misc_feature (516)..(516): n is a, c, g, or t
tcagtctacgtagccacgaccggtgctcgatttagctcgatatagttgggtttgggggtcgtttgtcctgggctctgctgctcctcaccctcctcactcagggcacagggtcctgggcccagtctgccctgactcagcctgcctccgtgtctgggtctcctggacagtcgatcaccatctcctgcactggaaccaacattgacgtttggtgattataactttgtctctggtaccacaacaccagcaagcccccaaactcaatcattannaagtcntaagcggcctcagggtntcatcgctcntgacncatngcaancgctcctnaccgtntctgcctcagactgaggcagggctaggattagtttaccgtccactnatataagtaagtagtactactctgttggtttcggcggtacgggacgagtcgtcgaccgtacgtgcacgccgagctcgcccctcgtccactccttcgtccctcccttccnccgtaccgtacgtacgacgtcgcggtccggngcggacgaggcg

SEQ ID NO: 203314 - DNA, 664 bp, Homo sapiens
  misc_feature: GYAE6OF02FO11J.15.57.F02.1.454.CMB.1.raw
tcagtctacgtagccacgaccggtgctcgatttagctcgatatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaaccacattgacgttggtgattataactttgtctcctggtaccaacaacacccaggcaaacgcccccaaatcatcatttatgaagtctctaacgcggcccctgaggggtatctaatcgctttctcgtggctccaagtctggcaacacggccctccctgtaccgtctctcggcctccagactggaggacggagcgtagtactttagttactcgcctactactaataataagtaaacgttaagtacctaccttccgttaggttcgggttttccgggacgggtacgggtaaccgaacggtccgtacggtacccgttaccgttacggtaccgaaccgtacccgaaacggtccgttacccgtccccccgttcggttcctaacccgttccgttcccgtttcccccgccccgttcccgtccgtacccgttaaccggttacgaccgttcggacgggtccgggtccgtcggtaccggaggtacccg

SEQ ID NO: 203315 - DNA, 803 bp, Homo sapiens
  misc_feature: GYAE6OF02H4SIG.15.57.F02.1.454.CMB.1.raw
tcagtctacgtagccacgaccggtgctcgatttagctcgatatagttgggtttggggggggggtctcaggaggcagcgctctcaggacatctccaccatggcctgggctctagctgctcctcaccctcctcactcagggcacagggtcctgggccagtctgccctgactcagcctgcctccgtgtctgggtctctggacagtcgatcgacatctcctgcactggaaaccactattcggacgttggtcgtaatttaacttaactttcgtacctccgttacggtaacccaaactaaccaacccgacggtaccaaaaccgtaccccctaaacgtacgaactactatttatacgaacgtctacgtaacggtccgtacccgtacgtaggggtactactaacttcgtctttactcgtcggtcctaccgtaacgttcgtacggacctaacgtacccggtaccccgttcccgtacggtacccggttcctaccgttccggtacccctaccgaacgtccggtacggacggacggtacggtacgtgttaacttagttactccgtaccaaccgtttcaacttaacgtaagtaacgtttaaccggttaccctttaaccgttccgtttacgggttttccgggttttaacggggaccggggtaaaccggggtaacccgtaaggtacccgttacgggtaaccccggtttaccggttaaccgggttaaccgtacccgggtaaccccgtaaaccgggttccctaccccggttcccccccggttacgggttaccccgttacccgtttcccggttacccccgg

SEQ ID NO: 203316 - DNA, 562 bp, Homo sapiens
  misc_feature: GYAE6OF02FXGD4.15.57.F02.1.454.CMB.1.raw
  modified_base (231)..(231): a, c, t, g, unknown or other
  misc_feature (231)..(231): n is a, c, g, or t
  modified_base (243)..(243): a, c, t, g, unknown or other
  misc_feature (243)..(243): n is a, c, g, or t
  modified_base (364)..(364): a, c, t, g, unknown or other
  misc_feature (364)..(364): n is a, c, g, or t
  modified_base (408)..(408): a, c, t, g, unknown or other
  misc_feature (408)..(408): n is a, c, g, or t
tcagtctacgtagccacgaccggtgctcgatttagctcgatatagttgggtttgggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatcctcctgcactggaaccanattgacgttggngatcataactttgtctcctggtaccaacacaccaggcaaacgccccaactcatcatttatgaagtctactaagcggccctcgagggtatctaatcgcttctctggctccagtctggcaacncggcctcctcgaccgtctctcggcctcgagctgagacgaggtcngtattactactgcctactcatatagaagttacgtactactccttgttcggttttcggacgggtaggtaccgagtccgtacggtacccgttccgtagggtccacgtaccccgaacggcccttaccgacccccgttccggtaccgtccgttcccgg

SEQ ID NO: 203317 - DNA, 632 bp, Homo sapiens
  misc_feature: GYAE6OF02ILSN9.15.57.F02.1.454.CMB.1.raw
  modified_base (234)..(234): a, c, t, g, unknown or other
  misc_feature (234)..(234): n is a, c, g, or t
  modified_base (244)..(244): a, c, t, g, unknown or other
  misc_feature (244)..(244): n is a, c, g, or t
tcagtctacgtagccacgaccggtgctcgatttagctcgatatagttgggtttggggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccaactnttgacgttgngattattactttgtctctggtaccaacaacacccaggacaaacgacccccaaactcatactatttataggaagtctactaagcgcctgagggtactctaatcgcttctctcggtctcagtctgacacgaccggcctcctgtacccgtctcgtcggtccctcgacgactgacggtacgacggctagtattacttactcgaccctactctaataacgtaagtaacggttagttaccgtacttccgttgtttacggggtttcgggacggtaacgggacctaaacggccgttacgacccggttcgttaacgggtaccgtaccggaaccccgtaagggtccccttaccgggtaccccccgttccggtacccgtacccgtttaccgtcccccgg

SEQ ID NO: 203318 - DNA, 715 bp, Homo sapiens
  misc_feature: GYAE6OF02G1KCP.15.57.F02.1.454.CMB.1.raw
tcagtctacgtagccacgaccggtgctcgatttagctcgatatagttgggtttgggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcacgtcggaaaccaactagttgacggttggtagtaatttattaacttttgtaccttccgttacggtaaccaaacaaccgacccaggaccaaaccgacccccaaactcatactatttatagtaagtctacgtaacgccgtccctcgaagggtacttactaacgtccgtctttcctcgtcggtccttaccgtaacgttcgtacggacctaaaccgacccgtccctaccctacgtaacctaacttccgtccgtcgggtaccctccgaacgggcttacggaaccggacgggtacggtaactttaaacgtttacgttactacgtcttcgccttacacgttaagtaacggtaaagtttaactaaaccgtaacttaacttaaccgttacggttcgggaaccggggtaacgtaccgaacgtccgtaccggtacccttccggtacgtccggtacgtaaccgacccgtacggccccgttcccgtaccccgttccggtaccttacccg

SEQ ID NO: 203319 - DNA, 712 bp, Homo sapiens
  misc_feature: GYAE6OF02I38W4.15.57.F02.1.454.CMB.1.raw
tcagtctacgtagccacgaccggtgctcgatttagctcgatatagttgggtttgggggggggtctcaggaggcagcgctctcaggacatctccaccatggcctggctctgctgctcctcaccctcctcactcagggcacagggttcctgggcccagtctcgccctgactcacgcctgcctccgtgtctgggtctcctggacagtcatccaccatcctcctgcctacgtacggaaaccactagttacggacggttggtagtaatttaactttaacgttttcgtccttcccgtaggttaaccccaaactaaccaaccccgacggaacccgaaaacccgtaccccccaaaacttccaacttccgttaatttaataggtaacgttccttacgtaaaccggcccggtaccctacggtaaggggttacttacgtaacttccgtctttaccgtcgtacgtcctaaccgtagtcgtcgacaacgccgtcctaccctcgtacgttcctcgtccgtcccgtacgtacgtagtacgggacggacggtacgtatacgtaattacgttactacgcctacgtacagttactaaggtattacgttacctaccttcgttgtttcggttaggtacggaacgacgtaacgcgtaccgtaccgtacggttaccgtcgacccgtacgtaccggtcctcccggtccccgtacgtcctaccggtcttaccccgg

SEQ ID NO: 203320 - DNA, 746 bp, Homo sapiens
  misc_feature: GYAE6OF02JF3N7.15.57.F02.1.454.CMB.1.raw
tcagtctacgtagccacgaccggtgctcgatttagctcgatatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaaccacattggacgttggtgaattataactttgctcctggtaaccaacaacacccaggaccaaacgcccccaaatccagtctatttatagaacgtctacgtaacgccggtcccctacgaacggggtacttccgtaaagtccgtcctttcgtccgtcggcgttaccctaagtcgtcgggaccaaccgtaccggccttccccgacggtaccgtccgtctcggacccttccgacggtacgtacggacggacggacgtcgtacgtaacgtttaacttaccgttcgacccacctaccgtaataagtaacggtaacgttaacgttaaccttaaccgttaccgttcgggtttcgggttttacggggtacgggaaccgggtaaccgaagtccgtaccggtaacccggttacgttaccggtacgtaccgtaccgtacggtccgtacccgtccccggtccgtccgtaaccgttccgttaccgttccccgttccccgtacccgttccgtaccggttaaccgttacgtaaccgtcggtaacggtccgggtacggcggtacgtacgggaccg

SEQ ID NO: 203321 - DNA, 797 bp, Homo sapiens
  misc_feature: GYAE6OF02IBRD8.15.57.F02.1.454.CMB.1.raw
  modified_base (180)..(180): a, c, t, g, unknown or other
  misc_feature (180)..(180): n is a, c, g, or t
tcagtctacgtagccacgaccggtgctcgatttagctcgatatagttgggtttgggggcttttcgacctgggctctgctgctcctcaccctcctcactcagggcacagggtcctgggcccagtctgccctgactcagcctgcctccgtgtctgggtctcctggacagtcgatcaccatcncctgcacgtgaacaacattcgacgttggtgatttaattaacgtttgtctccgtacggtaccaacaaccaccaggacaaaccgcccaaacgtcatacgtaagtttacgagaacgtcgtacgtaacgtcgtacctcgtaggggttataccgtaagttcgtactttacgtacgtacggtacctaccgtaacgttcgtacggacctaacgaccgggttcccttaccgacggtacccgttacgtaccgtacggtacctaccgaacggtaacctaagggaacggtaaccggtaggttaccttaaggtaaactttaacgttaaccggtcggtaaccctactaacgtaacgttaacgttaaacggtaaacgttaacggtttaaccttaaacgttccgtttacggtttacggggttttaaccggacggggtaaaccgtacggtaaaccgtcgttaaccggacccgttacgtaaccgggttacgaccgtaacccgtaaggtcccttacccggacccccgttcggtacccttaccgtaccttaccggttacccctacccgtccgttaccgtaccgtaaccggaccgtacgtacggacgggtccgtacgtacggaccgtacggtaccgg

SEQ ID NO: 203322 - DNA, 588 bp, Homo sapiens
  misc_feature: GYAE6OF02IEYLA.15.57.F02.1.454.CMB.1.raw
tcagtctacgtagccacgaccggtgctcgatttagctcgatatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaaccacattgacgttggtgattataactttgtctcctggtaccaacaacacccaggacaaacgccccaaatcatcatttatgaagtctctaagccggcctcaggggttatctaatcgcttctcgtggctccaatctggcaacacggcctccctgacctctctggcctcagactgacggacgaggctgattattactgccatcataactagaaacgtagtaactactccttggttgggttttacggcgggtagggaccgtaagcgttcggtaaccgtccgtacggtaccacgaccccgtaaggtccgtaccgccccctcggtcctacttccgttaccttccccgtacctccgttccgacgtaaccgtagacgtcgacggtccggcgttcggccgaaggtccg

SEQ ID NO: 203323 - DNA, 728 bp, Homo sapiens
  misc_feature: GYAE6OF02F2MHY.15.57.F02.1.454.CMB.1.raw
  modified_base (251)..(251): a, c, t, g, unknown or other
  misc_feature (251)..(251): n is a, c, g, or t
tcagtctacgtagccacgaccggtgctcgatttagctcgatatagttgggtttgggggggtctcgaggaggcagcgctctcaggacatctccaccatggcctgggctctgctgctcctcaccctcctcactcagggcacagggtcctgggcccagtctcgccctgacctcacgcctgcctccgtgtcgtgggtcctccgtgacagtcgatcaccatcctctgcacgtcggaaccaactgttcgacgttggntattataactttgtctcgtcgtaccaacaacaccagacaacgccccaaagtcactctatttatagaacgtctacgtaacgccggcctacggaggggtactacgttaactcgtcttcctcgtcggtacctaccgtaagttcgtacgcgaaaccgtaccggtccccttacccggtcgtaacccgttctaccggtaccgtccctaccgaccgtacgttcggacgggaaccggtacgggtaccgttagtaacgttttaacgttacgttacgacccgttactaacccgtaagtttaaccgtaaaggtaaccgttaacggttaaccctaccgtttaccgggttggttttccggggtttaaccgggtaccgggaacgggtaaccgtacgtccggtacgttaccccggttacggtacggttacgacccggtaccgtaaccgtcgttaccccgccccgtacggtcctaccgttccgttacccccgg

SEQ ID NO: 203324 - DNA, 660 bp, Homo sapiens
  misc_feature: GYAE6OF02GA3JS.15.57.F02.1.454.CMB.1.raw
tcagtctacgtagccacgaccggtgctcgatttagctcgatatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattatactttgtctcctggtaccaacaacaccaggcaaacgccccaaactcatcatttatgaatctctaagcggccctgaggggtatctaatcgcttctctggctccaagtctggcaacaccggccctccctgacccgtctcgtcggccctcacgactaggaggacggaggctaggtatttacttactgccctactacaatataaggtaagttaagtactacttccgttggttcgggttttcgggaccgggtaacgggaccaacggtccgtacgtacccggttacccgtagggtaccgaccggtacccgtaacgggtccgtcccggtaccccccgttcggtaccctaccgttccgttcccggttaccccggcccccttcccgtcccggttactacccggttaacgtaccgttacggacgggcccggggtcttacgggaccgtaacggtaccgg

SEQ ID NO: 203325 - DNA, 654 bp, Homo sapiens
  misc_feature: GYAE6OF02GEUI6.15.57.F02.1.454.CMB.1.raw
tcagtctacgtagccacgaccggtgctcgatttagctcgatatagttgggtttgggggctttgcctgggctctgctgctcctcaccctcctcactcagggcacagggtcctgggcccagtctgccctgactcagcctgcctccgtgtctggtctcctggacagtcgatcaccatctcctgcactggaaccaacattgacgttggtagattattaactttgtcttcctgtaaccaacaaccaccagacaaacgacccccaaactcatctattatagtaagtctactaagccgccctcgagggtatctaatcgtcttctctgctccagtctcggacaacgacggtcctcccgtacgacctcctacgtcgcctccacgtactgacggacgagtctagtatttattacgtcgaccgtactctataagtagtaagtacgtactaccgttccgttggttcggttttcgggacggacggtaaccgtaacgtaccgtacggtaacccggttaccgttaggtacaccggtaccgtaacggcccgttaccgtccccgttccggtaccgtaccttccgttacccgttcccctaccccgttaccgttcctaacccgttaacgttacgtaccgttggaccggtccggacgttcggacgacggtaccg

SEQ ID NO: 203326 - DNA, 1006 bp, Homo sapiens
  misc_feature: GYAE6OF02HX7DJ.15.57.F02.1.454.CMB.1.raw
tcagtctacgtagccacgaccggtgctcgatttagctcgatatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgacttataactttgtctcctggtacaacaacaccaggacaaacgaccccaactacatctatttatagaagtctctaagcggccctacgacggggtattacgtaatccgtcttacctctcggccttacctaaagttcgtacggacctaaaccgaccgggtacccgtccccgtcggtaaccccggttccgttacccgtaccggggtaccccttaccccggtaaccggtaaccgttacgggtaaaccggggtaaccgggtaacgggggccgtttaaacgggttaacggttttaaaccttttaaccgggtttacccgggtaccctaaccccgtttaaccgttaaaccggtttaaacggttttaaaacgggtaaacggtttaaaccgggttaaaccctttaaaccccgtttcccggtttacggggtttttaccgggggtttttttaacccgggggtaccggggggttaaccggggtaaaaccccgggttaaacggggtaccgttaacccggggttaaacccccgggtttacccgggttttaaaaccggggtaccccgtaaaccggtaaacccccgggtaaaccggggtaccccggtttaacccccgggttcccccccgttttacccgggggtaacccctttaacccgtttcccgttttaccccggtttaccccccgttaacccccggttccccggtttaaccgggtacccccggttaaccggtttaaccggtaacccggttacggggttaacccggggccggggttaacccggttaccggggttaccggaacccgggtaacccgg

SEQ ID NO: 203327 - DNA, 725 bp, Homo sapiens
  misc_feature: GYAE6OF02IVDKZ.15.57.F02.1.454.CMB.1.raw
  modified_base (214)..(214): a, c, t, g, unknown or other
  misc_feature (214)..(214): n is a, c, g, or t
  modified_base (647)..(647): a, c, t, g, unknown or other
  misc_feature (647)..(647): n is a, c, g, or t
tcagtctacgtagccacgaccggtgctcgatttagctcgatatagttgggtttgggggctttgcctgggctctgctgctcctcaccctcctcactcagggcacagggtcctgggcccagtctgccctgactcagcctgcctccgtgtctgggtctcctaggacagtccgatactaccactctcctgcactaggaaccaactattgacgttggtnaattataacttttcgcttcgtgtaaccaactaacaccaggaccaaacgtacccccaaaactcaactctatttagtagaaggtcctactaacggccggaccctcggaaggggttaactacttaacgtaccgtctttcgttcgcgtaccgtacctaacggttaccgaggaccaaaccgtaccggtcctaccccgtacggtacccgttccgtcgttcggacccgttaccgacgtaccgtaggtaacgggaccgtaggccgttaggtaatttaaacgtcttaccgacgtaccttaccgtaagtaattaacgtaaggttaacttacgtactcgttagttggggtttaccggagggaccggtacgtaacgtacgtacccggtacctaccgtaagtcctaccggaccgaaccggttcgcccgtacccctcgggttaaccnccttacgttccgtccccgtccgttacccgtactccggtaagtacgtagtcggaacggtcgtacgtcgggacacggtac

SEQ ID NO: 203328 - DNA, 764 bp, Homo sapiens
  misc_feature: GYAE6OF02I763C.15.57.F02.1.454.CMB.1.raw
  modified_base (162)..(162): a, c, t, g, unknown or other
  misc_feature (162)..(162): n is a, c, g, or t
tcagtctacgtagccacgaccggtgctcgatttagctcgatatagttgggtttggggggggggtctcaggaggcagcgctctcaggacatctcccaccatggcctgggctcctgctgctcctcaccctcctcactcagggcacagggtcctgggcccagtcngccctgacctcacgcctgcctccgtgtctcgggtccttccgtggacagtcgactccacctatccgtcctgcactacggaaaccaacgattacggacggtttgggtgtaattacgtttaactttcgtcttaccgttacgggtaaccaaaccgaaacctaccccgaacggtaccaaaaccggaccccccaaaacctacctacgtaccttaagttttaactaggtaacgttacctagtaaccggtcccggtacctaccggtacggggttattaccgttaacgttccggtaccttctaccgttcgtaccgtacccgtaacgttcggtaccgtaccgaaaccggtaccgtcccgttcccgtacggttacccgtacgttccgtaccggtccctacccgacgacggtagggacggtaacggtaggtcgtagtacgttacgttacgtacggcccttaactactaacgttagtaaacggtaacgttacgttaccgttaccttacgtttcggttcgggtttacggacggtaacgaccgtagtcctacggtaccgtaccgtacgtcgacgtaccgacgtccgaccgtcccgtacgtcctaccgtcgttccccg

SEQ ID NO: 203329 - DNA, 722 bp, Homo sapiens
  misc_feature: GYAE6OF02JNJVD.15.57.F02.1.454.CMB.1.raw
  modified_base (186)..(186): a, c, t, g, unknown or other
  misc_feature (186)..(186): n is a, c, g, or t
  modified_base (204)..(204): a, c, t, g, unknown or other
  misc_feature (204)..(204): n is a, c, g, or t
  modified_base (301)..(301): a, c, t, g, unknown or other
  misc_feature (301)..(301): n is a, c, g, or t
tcagtctacgtagccacgaccggtgctcgatttagctcgatatagttgggtttggggggggggtcgtcaggaggcagcgctctcaggacatctccaccatggcctgggctctgctgctcctcaccctcctcactcagggcacagggtcctgggcccagtctgccctgactcagcctgcctaccgtntcgtggtctccgtggacngtcgatccgacctatcgtcctgcacgttcggaaccagtactggacgtttggcattatacttgtctctgacaacacacagacaacaccccaactcatntacttatagatctacgtaggccgtccgtacggacgggtactctaaccgttctaccttcttcgtacggtccgtaccgtaacgtcgtacggtacctaaccggacccgtacccgtcccgttacggtacccgttctccggtccggtaccctaccgaccgtaacggtagggtacgggtaacggaccgggttacacggtttaacttaacggtttacctaccgtacccacttactacgttaataacggttaattaaccggtaacgtttaccttaccggtttggtttcggggtttacgggtaccggtaaccggggtaactaacgggtcgttaaccgggtaccgtacccggttacggttaacgaacccggtaccggaccggttcgtacccgtcccggttacccgggtacctaccgttaccggttccccgg

SEQ ID NO: 203330 - DNA, 890 bp, Homo sapiens
  misc_feature: GYAE6OF02HIDKK.15.57.F02.1.454.CMB.1.raw
tcagtctacgtagccacgaccggtgctcgatttagctcgatatagttgggtttggggggggggtctcaggaggcagcgctctcaggacatctccaccatggcctgggctctgctgctcctcaccctcctcactcagggcacagggtcctgggcccagtctgccctgactcagcctgcctccgtgtcgtgggtctcctggactagtcgatccaaccatcctcctgcctacgtacggaaacctaactattggacggtttgggtagtaatttaacttaaaccgttttgtacctcccgttacggttaacccaaacctaaaccaaccccgaggaacctaaaaccggaccccccctaaaaacctccaacttaccttaattttaacgttacggtaaacgttccgttaaccgttaaacggccccgggtaccccgtaccggtaacggggggttaacttaccgtttaaacggttccgttaccgttttccttacgtcgggtaccctacccgtaaacgtttccggtacggacctaaccgacccggtcccttccctaccggtaccccgttcttccggtaccggtcccctacccgtaacgtaccgtacgggaacgggtaaccggtacgggtcttaacggttactttaacgtttaccgtaccgtaccctaccgttacgtaacttaagttaaaggtaaacgttaaccggttaaccttacccgttccgtttagggtttccggggttttaacggggaccggggtaaccgggtaacccgtaacggtccggttaaccggtaccccggttccggttaaccggtaccgaacccggtaacccggtaaccgggtcccttccccggtacccccggtttaccgggtaccctttacccgttcccgtttaccccccgg

SEQ ID NO: 203331 - DNA, 728 bp, Homo sapiens
  misc_feature: GYAE6OF02INPR0.15.57.F02.1.454.CMB.1.raw
  modified_base (332)..(332): a, c, t, g, unknown or other
  misc_feature (332)..(332): n is a, c, g, or t
tcagtctacgtagccacgaccggtgctcgatttagctcgatatagttgggtttgggggctttgcctgggctctgctgctcctcaccctcctcactcagggcacagggtcctgggcccagtctgccctgactcagcctgcctccgtgtctgggtctcctggacagtcgatccacctatcctcctgcacgtaggaaccaactattggacggttggtgtatttaataacttttgtacctccgtacggttaaccaaacaaaccacccaggacaaacgaccccaactcatctattatgaagtctacaagcgcctcgaggtactactactcgcttctntgctaccagtctcgacacctaccggcctcccgtagaccgtcgtcgtccggtccttacgacgtacgttagggacggtaacggtacggtactcgtaactttaacgtttaacgtcgtacccaaccttcaaggttaacttaaagtaacggtaaactttaccgttaccgttacccggttagggttttcgggtttaccgggtacggggtaaccgtaccgtaaaccggtcgtaccgtacccgggttctacgggttaccggacgtacccgacggtacccgtccgtaccccggttctaccgtacccgttccgtttacccgttacccccctaccgtcccttaccgtaccgttacggttaacggccttacgggaacggtccgggtacggtcggtacggaccgtacgg

SEQ ID NO: 203332 - DNA, 684 bp, Homo sapiens
  misc_feature: GYAE6OF02GGTAR.15.57.F02.1.454.CMB.1.raw
tcagtctacgtagccacgaccggtgctcgatttagctcgatatagttgggtttgggggggggtctcaggaggcagcgctctcaggacatctccaccatggcctgggctctgctgctcctcaccctcctcactcagggcacgagggtcctgggcccagtctgccctgactcagcctgcctcgtgtctgggtctcctggacagtcgatccaccatccgtcctgcactacggaaccaactagttgacgttggatattaattacgttgtctcgtgtaccaacaccaccgagacaaaccgaccccaatcatctattatagactactacgtaacgccgcctgagggtattactaagtcgtcttctcgtcgacctacgaagttcgtaggaccaacgccgtccctaccctcgtaccgtctaccgtccggtaccctaccgaaggtcgtacgggaacggtaacggacggtaccgttacttaactttaacgttaaccgtcgtacctacctaacgtattaaagtacgtaaagttaacgttaacttaccgttcgttacgggtttacgggtttacggacggtaacggtaacccgtaaggccttaacggacccgttaacggtaacggtaccgaaccgtacccggtaacggtacccgtccggtacccccgtaggtacccttaccgttaccgttacccccg

SEQ ID NO: 203333 - DNA, 661 bp, Homo sapiens
  misc_feature: GYAE6OF02JE27X.15.57.F02.1.454.CMB.1.raw
  modified_base (229)..(229): a, c, t, g, unknown or other
  misc_feature (229)..(229): n is a, c, g, or t
  modified_base (255)..(255): a, c, t, g, unknown or other
  misc_feature (255)..(255): n is a, c, g, or t
  modified_base (265)..(265): a, c, t, g, unknown or other
  misc_feature (265)..(265): n is a, c, g, or t
tcagtctacgtagccacgaccggtgctcgatttagctcgatatagttgggtttggggggggggtctcaggaggcagcgctctcaggacatctccaccatggcctgggctctgctgctcctcaccctcctcactcagggcacagggtcctgggcccagtctgccctgactcgagcctcgcctccgtgtcgttggggtcctccgtggaccagtcgatccaccatctccgtncactacggaaccaacattgcgttggntatatacttntctctcgtaccaacacaccgagacaacgaccccaaactcactactattacacgaagtctactaacgccggaccctcgggaggtactcgtaactcgtccttactcgcggtcctacagtctagacacgaccgtcctccgacgtaccgtctcgtcgacctccacgtacgaggtacggacggacgtctagtactttatacctcgacctacctatacgtaagtaggtaaacgtttacgtacctaaccgtttcggttaggttttccggggtttcgggaacggtaaccgggtaacgtacccgacgttacggtaccggttccgttaacggaccggtacccggtacgtaccggttcccgacccggttccccggtacggttaccctccgttccggtttacccccgg

SEQ ID NO: 203334 - DNA, 1034 bp, Homo sapiens
  misc_feature: GYAE6OF02I1LR1.15.57.F02.1.454.CMB.1.raw
tcagtctacgtagccacgaccggtgctcgatttagctcgatatagttgggtttgggggctttgcctgggctctgactgctcctcaccctcctcactcagggcacagggtcctgggcccagtctgccctgactcagcctgcctccgtagtctgggtctccgtggacgagtcgactcaacctattcctcctcgtaccaccgttacggaaaccctaacgtagtttcggacggtttgggtactaattttaacgttaaacgttttcgtccgttaccgttaccggtaaaccctaaaaccgaacccaaccccgtaaggaacccgtaaaaaccccgtaaccccccgtaaaactaccgtaacttaacttaaacgttttaactaggtaaacgttacccgtacggttaaacggccccggttacccgttaacgggtaaaggggtttaaccttattaaacggtttaccgttacccgttttaccgtaaccggtttcggggtacccccttaaaccggttaaacggttcccggtaaacggtaaccccgtaaaaccccggtccccggttacccccgttttccccggttacccggttaccccgggtttacctttaccgggtcccggtaccccgtttaaaccgaggttaaacccggttaacgggtaaaacggggtaccgggtaacggttacccggttaaggttaaacctttacggtaacccgtaccgtaacccggttaaccttaacgtaaacgtttaaacggtaacgggtttaaaacgtaccgtttaaaccggtttccttaacccggggttttacggtttaccgggggtttaaccggggcggggtttaacccggaacggttaccgttacccggtccgttaacccgggttaagtaaccgtaccggaccggtacccgtagggttccccgtccccggtacccgttcgtaacccgttccgttccccgttaccgtccccgttcccgtacggttaccgtaacgttcccgaacggtaccgtacgggtacgggtcgtaccggtacggaccgtacggaaccg

SEQ ID NO: 203335 - DNA, 712 bp, Homo sapiens
  misc_feature: GYAE6OF02GFMCO.15.57.F02.1.454.CMB.1.raw
  modified_base (236)..(236): a, c, t, g, unknown or other
  misc_feature (236)..(236): n is a, c, g, or t
  modified_base (280)..(280): a, c, t, g, unknown or other
  misc_feature (280)..(280): n is a, c, g, or t
tcagtctacgtagccacgaccggtgctcgatttagctcgatatagtttgggtttggggggggggtctcaggaggcagcgctctcaggacatctccaccatggcctgggctctgctgctcctccaccctcctcactcgagggcacgacgggtcctcgggcccagtcctcgccctgacctcacgcctcgcctccggtgtcgtcgggtcctccgaggactagtcgactcactctctccngcacgtacgaaccaactgttgtacgttgagtattacgttacttntcctcgtacgaaccaacaccaccgacgaacctaaccgacccctaactctaacttactaatttacgagtactctacgtacgccgtccgtacgtaggtactcgtaactcgtcttcgtccgcgtacctaccgtacgtcctacggactaaccgtaccccgtcctcccggttaccgtaccgttccgtcctaccgtccctaaccgagtacggtcgggaacggtacggtacgtacgtagttacgtttaacttccgtaccgtactcacgttagtaacgtaacggttaattaaccgtttacctactttacgggtcggttttacggggttcgaacgggttacggacccgtactccggtcgtaacccgtttcggaacgtacccgacccgtaaccggtcgtaccccgtccccgttccgtacgtaccgtccctccggttaccccg

SEQ ID NO: 203336 - DNA, 681 bp, Homo sapiens
  misc_feature: GYAE6OF02GIGM2.15.57.F02.1.454.CMB.1.raw
  modified_base (218)..(218): a, c, t, g, unknown or other
  misc_feature (218)..(218): n is a, c, g, or t
  modified_base (269)..(269): a, c, t, g, unknown or other
  misc_feature (269)..(269): n is a, c, g, or t
  modified_base (358)..(358): a, c, t, g, unknown or other
  misc_feature (358)..(358): n is a, c, g, or t
  modified_base (408)..(408): a, c, t, g, unknown or other
  misc_feature (408)..(408): n is a, c, g, or t
tcagtctacgtagccacgaccggtgctcgatttagctcgatatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaacactattgacgttggtgattattactttntcctctggtaccaacaaccaccaggacaaaccgccccaaatcatctatttntagtagtctactaagcggtccctgagggtatctaactcgtccttctactcggcttaccgaacgtcgtcgactaacgccggtcccttccncgtaccgttcctccgtcggtccctcgtaacgcgtacgggacgggaaccgnggtaccgtaggttaatttacgtttacgtccgtaccctaactacgtaattaaagtaaaggtaacgttaacgttaaccttacccgttccgtttagggtttccggttttacggggacgggtaccgggtacgtaacgccgttaccgcccggttacgttacgtacgaccgtaccgaacgtccgtccgaccccgttcgcgttcctccgttcccgttccctacccgtccgtaccggtcctacgtacgacttggaccggtcggacggtccggacaggtccg

SEQ ID NO: 203337 - DNA, 899 bp, Homo sapiens
  misc_feature: GYAE6OF02FMCXG.15.57.F02.1.454.CMB.1.raw
tcagtctacgtagccacgaccggtgctcgatttagctcgatatagttgggtttgggggctttgcctgggctctgctgctcctcaccctcctcactcagggcacagggtcctgggcccagtctgccctgactcagcctgcctcgtgtctgggtctcctggacagtcgactcaccattcctcctgccacgtaggaaaccaactattacggaccgtttggtagtatttaattaacgttttggtccttccgtaggttaaccccaaacaaccacccgacggaccaaaaccgaccccccaaatacctaacttaccgtaatttaactaggtaaacggttccttactaaacggtccggccccttcggaacgggttactacgttaagtccgtccttcttctcggtaccttacaaacggttctacgggtaccaaccgtaacggccccctttacccgtacgaccggtccttaccgtcggtccccgttacgaacgtaccgtacggtaacgggaacggtaacgggtacccttaggtaacgttttacgtttaccgtacgttccccgtaacgtttacccgaaagtttaagttaaacggtaaacggtttacgttaaaccgtttaccgtttaccctttacggggttttaccggggttttaccgggggttacgggtaacccggggtaaccgtaaccggttacccggtacggtttaccccggttacccggttaacgggtaccggaaccgggtacccgtaaacgggtcccgttacccccgggtccccccgtaggttcccaccccggtttcccgtttacccgttccccgtaccccgtacccttcccgggtaacccttaccggtaaccgtacggttacggaaccggtcccgggtacggttacggtaccggaaccggtccgg

SEQ ID NO: 203338 - DNA, 782 bp, Homo sapiens
  misc_feature: GYAE6OF02GFSU1.15.57.F02.1.454.CMB.1.raw
  modified_base (195)..(195): a, c, t, g, unknown or other
  misc_feature (195)..(195): n is a, c, g, or t
tcagtctacgtagccacgaccggtgctcgatttagctcgatatagttgggtttgggggctttgcctgggctctgctgctcctcaccctcctcactcagggcacagggtcctgggcccagtctgccctgactcagcctgcctccgtgtctgggtctcctggacagtcgatcaccatctcctgcactggaaccaacnttgacgttggtgatttataactttgtctcctggtaaccaacaaccacccgaggccaaaacgcccccaaatcatctattatgaagtctactaagccggccctgaggggtactctaactcgcttctcgtcggtcctccaagttcgtcggaccaaccgaccggtccctccccgtcgaccgttccttccgtccggcccttcccgacgtacctaggacgggacggaggtcctaggttaattagttaccgtacgtaccctaatcctataaacgttaaggtaacgttaaacgttaccttaaccgttccgtaggttttcggggttttaccgggaccggggtaaacgggtaacccgtaaggttacccgtacggttaaccccgggttaccggtttaacgggtaccctaccggaccccggtaaagggtccccgtacccggtaccccccgttcgggtaaccctaccgtttacccgttaccccgttcccccctaacccccgtttcccgtaacccggtaccccttaacggttaacccggttaacgtaccggtaacgggtcccgggggtacctacggggtaaccccgggtaggtaaccccgg

SEQ ID NO: 203339 - DNA, 699 bp, Homo sapiens
  misc_feature: GYAE6OF02IYZ20.15.57.F02.1.454.CMB.1.raw
  modified_base (127)..(127): a, c, t, g, unknown or other
  misc_feature (127)..(127): n is a, c, g, or t
  modified_base (146)..(146): a, c, t, g, unknown or other
  misc_feature (146)..(146): n is a, c, g, or t
  modified_base (252)..(252): a, c, t, g, unknown or other
  misc_feature (252)..(252): n is a, c, g, or t
  modified_base (325)..(325): a, c, t, g, unknown or other
  misc_feature (325)..(325): n is a, c, g, or t
tcagtctacgtagccacgaccggtgctcgatttagctcgatatagttgggtttggggggggggtctcaggaggcagcgctctcaggacatctcacatggcctgggctctgctgctcctcaccctctnactcagggcacagggtccngggcccagtctgccctgactcagcctgcctcgtgtctgggtctcgtaggacaggtcgaatcaccgtatctccgtgacacgtggaaaccagagttcgacgtttaggntacttaacgtaactttgtctcgtggtaacaactaacaccgtagacaacgtacccaaactcactactatttacngtaacgtctacgttaacgcggtaccctacgtaacggggtacttacgtaacgtccggtcttaacttccgtacggtcctacctaagtcggtaggtaccgaaaccgtcggtacccgtccgtacggtaccgttaaccgttcggttacggacccttaccgaacggttaccgtacggtaacggaacggtacggtaccgtagtaaactttacgttaacgtacgttaccaccgtactaactaatagtaaacgttacggtacctaaccgtcgttagttacgggtttggtacggaaggaaccgtaggctacggtaccgtagtaccggacgtaccggtacctacggtcctaaccggtcccgtcggtaactccggtccttacccgg

SEQ ID NO: 203340 - DNA, 652 bp, Homo sapiens
  misc_feature: GYAE6OF02HKG6O.15.57.F02.1.454.CMB.1.raw
  modified_base (369)..(369): a, c, t, g, unknown or other
  misc_feature (369)..(369): n is a, c, g, or t
  modified_base (402)..(402): a, c, t, g, unknown or other
  misc_feature (402)..(402): n is a, c, g, or t
tcagtctacgtagccacgaccggtgctcgatttagctcgatatagttgggtttggggggctttgcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctccgtggtaccaacaaccacccaggacaacgacccccaaactcattcatttatgaagtcttactaacgccggcccttacgaggggtactactaatcgacttctctggctcagtcgtgacacaccggcctctcgacgtctgtcggccnccagactgacggacgaggacctgacttattacncgtccactcattaacgtaagtaacgtaagtactaaccttcgttggtttgggtttccgggacgggtacggtaaccgtaagtcgtacgacccgttacgtacgtaccggacgacccgtaacggccgttcccgcccccgttacggtcctacgttccgtccgtttccccctaacccgttcccggtcccggtaccgttaaccggttaccgtaacgtacgggcggaccgggtccgtacggggaccgaagggtacccg

SEQ ID NO: 203341 - DNA, 318 bp, Homo sapiens
  misc_feature: GYAE6OF02IRQTM.15.57.F02.1.454.CMB.1.raw
  modified_base (275)..(275): a, c, t, g, unknown or other
  misc_feature (275)..(275): n is a, c, g, or t
  modified_base (309)..(318): a, c, t, g, unknown or other
  misc_feature (309)..(318): n is a, c, g, or t
tcagtctacgtagccacgaccggtgctcgatttagctcgatatagttgggtttgggatgagaacctatgaacattctgtaggggccactgtcttcaacacggcctccctgaccgtctctggcctccagactgaggacgaggctgatttattactgccactcatatagaagtagtactactcctgtggtttcggcggaggaccagctcgaccgtcctaggtcagcccaaggctcgcccctcggtcactctcgttccccaccctcctcgctacgtanaccgtgacggcgggctggacgaaggcgcagtagnnnnnnnnnn

SEQ ID NO: 203342 - DNA, 843 bp, Homo sapiens
  misc_feature: GYAE6OF02H269A.15.57.F02.1.454.CMB.1.raw
tcagtctacgtagccacgaccggtgctcgatttagctcgatatagttgggtttgggggctttgcctgggctctgctgctcctcaccctcctcactcagggcacacgggtcctgggcccagtctgccctgactcagcctgcctccgtgtctgggtctcctggacagtcgatcacctatctcctgcacgtaggaaccaagtacttggacggttggtagtaatttattaacgtttcgtcctcccgttacgaaccaaacaaccgtaccccgaaggaccaaaaccgaccccaaacgtcactactaatttagtacgtaagtccttactaacggccggtacccgtacggtacggggtaacttaaccgtaacgtccgttcttacgtccgtacggtacccttaccgtaaacgtccggttcgaacctaaccggaccggtcccttacccggtacgaccggttccttacggtacccgtaccctaccgtaacgtaacggtacggaaacgggtacggaaccgggtacttaacgttacgtttaactaaccgtttacccggtacctaaacccgtagtaaaaccgtttaaacggttaaaacggtaaacggtttaaaccgttaacctttaaccggttcccggtttggggtttttaaccggggtttacccggaaggggtaccggtaaacgaacgttacggaccgttaacccggtgttaaccggacgacccgtaaccggtacgtccgtaacccgtccccgtacgtacctacgttccgtacccttccccgtaccgtcgtacccgtagttaacccggtacgaccgtacggaccggccgggtcgtaacggtcccggtaggtaaccg

SEQ ID NO: 203343 - DNA, 802 bp, Homo sapiens
  misc_feature: GYAE6OF02HLZLG.15.57.F02.1.454.CMB.1.raw
  modified_base (135)..(135): a, c, t, g, unknown or other
  misc_feature (135)..(135): n is a, c, g, or t
  modified_base (170)..(170): a, c, t, g, unknown or other
  misc_feature (170)..(170): n is a, c, g, or t
  modified_base (199)..(199): a, c, t, g, unknown or other
  misc_feature (199)..(199): n is a, c, g, or t
  modified_base (213)..(213): a, c, t, g, unknown or other
  misc_feature (213)..(213): n is a, c, g, or t
tcagtctacgtagccacgaccggtgctcgatttagctcgatatagttgggtttggggggggggtctcaggaggcagcgctctcaggacatctccaccatggcctgggctctgctgctcctcaccctcctcactcngggcacagggtcctgggcccagtctgccctgactnagcctgcctcgtgtctggtctccgtgganagtcgatccacctntctcctgccgtactacggaaaccaactagtttacggaccggtttgggtattaagtttaactttaaccgttttcgtaccgttaccgttaccggtaacccaaacctaaacccgaaccccgacgggaaccaaaccccggacccccctaaaaccttaccaacgttaccttaatttacgtagtaacggttacctacgtaaccgggcccggtacccctagggtaacgggttacttaaccgttaacgtcggttaccttcgttccgtacggtctaccaaggtcgtacggacctaaacgccggtacccctccgtcggtacctccgttcggaccggtccctaccgacgtacgtaggacgtacggacgtatcgttaagttaccgttaccggtcctaacccgttacttaactaacgttaacgtaaggtaaaccgttaaccgttacctaccgttcgggtttacggtttccggggttttacggggaaccgggttacggtaaccgtacgttacgaccggttacccggttaccgtacggtaccaaccggttacccaccggtcccgtacccgtcccggttaccgtcccgtccttccttacccccgg

SEQ ID NO: 203344 - DNA, 661 bp, Homo sapiens
  misc_feature: GYAE6OF02INXYZ.15.57.F02.1.454.CMB.1.raw
  modified_base (217)..(217): a, c, t, g, unknown or other
  misc_feature (217)..(217): n is a, c, g, or t
  modified_base (237)..(237): a, c, t, g, unknown or other
  misc_feature (237)..(237): n is a, c, g, or t
  modified_base (250)..(250): a, c, t, g, unknown or other
  misc_feature (250)..(250): n is a, c, g, or t
  modified_base (264)..(264): a, c, t, g, unknown or other
  misc_feature (264)..(264): n is a, c, g, or t
tcagtctacgtagccacgaccggtgctcgatttagctcgatatagttgggtttgggggggggtctcaggaggcagcgctctcaggacatctccaccatggcctgggctctgctgctcctcaccctcctcactcagggcacgagggtcctgggcccagtctgccctgactcagcctgccctccgtgtcgtgggtcctccgtggacagtcgatccaacntctcgtgcacgtgaaaccanttaggacgttggnattatacttgctcngtacaacacacgagacaacgcccaaactcatctattatacagtactactaaggccgtacctagagggtactcgtaagtctcttctcgtacggtcctacgaacgttcgtcgtacaaccgtacggtccctcccgttagtacccgtccttcgtaccggtacccttaccgaacggttaacgtcggaagggtaccgaacggtctaagtactttaacgttctacgcctactacgtatagtaacggtaattaacgtactacgttcgttacgtttcgggtttacggacggtaacggtaagaccttacggtccgtaacccggtcgtaaccggtacgtaaccgacccggtaacggtcccgttcccggccccggtttaaccggtcctaccggtccttttaaccccggg

SEQ ID NO: 203345 - DNA, 621 bp, Homo sapiens
  misc_feature: GYAE6OF01AY58E.38.32.C10.1.454.CMB.1.raw
  modified_base (180)..(180): a, c, t, g, unknown or other
  misc_feature (180)..(180): n is a, c, g, or t
  modified_base (326)..(326): a, c, t, g, unknown or other
  misc_feature (326)..(326): n is a, c, g, or t
  modified_base (447)..(447): a, c, t, g, unknown or other
  misc_feature (447)..(447): n is a, c, g, or t
tcagtcgatcacgtcacgaccggtgctcgatttagtatagacatcaacacacaaaggggggggtctcaggaggcagcgctctcaggacatctccaccatggcctgggctctgctgctcctcaccctcctcacgtcgaggtcactaggtccgtggggccctaggtctaggccctgactcgngcctgcctcgtgtctgggtctcctggacagtggatcaccatctcctgcactggaaccagcagtgacgttggtaggttatgtactagtgttctccgtcggtaaccaacaaccaccccgaccaaacgcccccaaatcatcgatttagngaggtcaagttagtccggtccgttcggggttactaacgtcggttctcgtggtacctcgaagtcgtggcaacgacgccctccgtgaccctatctcgtggcctccgagcccgtggacggacgngtcctagtatacttacgcgctagctacagttactactagtccgatcactacgtcggttgggttcggttaccgggaccggggggtaactacggtaccggtaccggtacccgggttaccggttacgtaccggtacggacccggtaaccggcccgttacccggtccccgttaccggg

SEQ ID NO: 203346 - DNA, 527 bp, Homo sapiens
  misc_feature: GYAE6OF01DEUKN.38.32.C10.1.454.CMB.1.raw
tcagtcgatcacgtcacgaccggtgctcgatttagtatagacatcaacacacaaagggggggtctcaggaggcagcgctctcaggacatctccaccatggcctgggctctgctgctcctcacctcctcactcagggcacagggtcctgggcccagtctgccctgactcagcctgcctccgtgtctgggtctcctggacagtggatcaccatcctctgcactggaaccagcagtgacgttggtgttatgactatgtctcctggtaccaacaacacccgaccaaacgcccccaaactcatcgatttatgagtcagtaactcggccgttcggggttctaagtcggttctcgtcggctccaagtcgtggcaacaccggcctcctcgaccatctcgtggcctccgagccgtgacggaccgaggctgtattattactgcagctacatatactagcagctatcgacgttgggtcggtcgggcggggaccgtaggctcgccgtcgtaggactacgccaaggcctcgccccgtcgg

SEQ ID NO: 203347 - DNA, 506 bp, Homo sapiens
  misc_feature: GYAE6OF01D9BPE.38.32.C10.1.454.CMB.1.raw
tcagtcgatcacgtcacgaccggtgctcgatttagtatagacatcaacacacaaaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtggatcaccatctcctgcactggaaccagcagtgacgttggtggttatgactatgtctcctggtaccaacaacaccccgccaaagcccccaaactcatgatttatgaggtcagtaatcggcctcggggttctaatcggttctctggctcaagtctggcaacacggcctccctgaccatctctgggctccagcctgaggacgaggctgattattactgcagctcaatatactagcagcatcattgggtgttcgggcgggggaccaaggctggccgtcgtagtcagcccaaggctcgccccgtcgg

SEQ ID NO: 203348 - DNA, 538 bp, Homo sapiens
  misc_feature: GYAE6OF01EANJM.38.32.C10.1.454.CMB.1.raw
  modified_base (230)..(230): a, c, t, g, unknown or other
  misc_feature (230)..(230): n is a, c, g, or t
tcagtcgatcacgtcacgaccggtgctcgatttagtatagacatcaacacacaaaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtggatcaccatctcctgcactggaaccngcagtgacgttggtggttatgactatgtctcctggtaccaacaacaccccgccaaaagcccccaaactcatgatttatgagtcagtaatcggccttcggggttctaatcggttctctggcccaagtctggcaacacggcctcctgaccatctctggctccagcctgaggacgaggctgattattactgcagtctacatatactagctagcatcacgttgggtcgttcgggacggggggtaccaaggctaggaccgttccgtaacggttcacggtcccgaacgggcctccggcccccgtcggtaccccg

SEQ ID NO: 203349 - DNA, 569 bp, Homo sapiens
  misc_feature: GYAE6OF01DGUW6.38.32.C10.1.454.CMB.1.raw
tcagtcgatcacgtcacgaccggtgctcgatttagtatagacatcaacacacaaagggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtggatcaccatctctgcactggaaccagcagtgacgttggtggttatgactatgtctctgtacaacaacacccgaccaaacgccccaaactcatgtatttatgaggtcagtaactcggtccgttcggggtttactaacgttcggttctcgtgctacaagtctggctaacacggcctcctgaccatctctcggctccagcctggacggacgaggctgtattatactgcagctcataactactacgcacgctacttacgacgttgggttacggtccggggaccggggggtaaccaacggtcgtacggtacccggttccgtaacgggttcccacggaccccgaagggcccttccggccccccgtttccggg

SEQ ID NO: 203350 - DNA, 552 bp, Homo sapiens
  misc_feature: GYAE6OF01AHAQW.38.32.C10.1.454.CMB.1.raw
  modified_base (229)..(229): a, c, t, g, unknown or other
  misc_feature (229)..(229): n is a, c, g, or t
  modified_base (307)..(307): a, c, t, g, unknown or other
  misc_feature (307)..(307): n is a, c, g, or t
  modified_base (371)..(371): a, c, t, g, unknown or other
  misc_feature (371)..(371): n is a, c, g, or t
tcagtcgatcacgtcacgaccggtgctcgatttagtatagacatcaacacacaaagggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtggatcaccatctcctgcactggaaccngcagtgacgttggtggttatgactatgtctcctggtaccaacaacaccccgccaaacgcccccaaactcatgatttangaggtcagtaatccggcccgttcggggtttctaagtcggttctcgtggctccaagtctggcacncggcctcctgaccatctcgtcgggcctccgagtccctggacggacgtaggccttggatttattactgcagctactatactactagacagctactcgtacgttggggtcggttccggggcgggggaccaggtcgtacgcccgtccgtacggtcgacgcccgaggccctcggcccccgtccgg

SEQ ID NO: 203351 - DNA, 618 bp, Homo sapiens
  misc_feature: GYAE6OF01A8S6D.38.32.C10.1.454.CMB.1.raw
  modified_base (230)..(230): a, c, t, g, unknown or other
  misc_feature (230)..(230): n is a, c, g, or t
tcagtcgatcacgtcacgaccggtgctcgatttagtatagacatcaacacacaaaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtggatcaccatctcctgcactggaaccngcagtgacgttggtggttatgactatgtctcctggtaccaacaaccaccccgaccaaacgacccccaaactcatgtatttatgaggtcagtaactcggccgttggggtttctaagtcgttctcgtcggcctctaagtctggacaacgaccggtccctcctacgacccactccgtcgtcgggcctccgacgtccgtaggacggacggaggctagtattactacgtgactagctacaattactacgtagactacgactactacgtacggttggggtacggttccggggaccgggggtaacctaacggtccgttacggtacccggttacccgttacgggtacccgtaccggtaccccgtaagggtcccgtcccggtccccccggttaccgg

SEQ ID NO: 203352 - DNA, 593 bp, Homo sapiens
  misc_feature: GYAE6OF01AGITL.38.32.C10.1.454.CMB.1.raw
  modified_base (304)..(304): a, c, t, g, unknown or other
  misc_feature (304)..(304): n is a, c, g, or t
tcagtcgatcacgtcacgaccggtgctcgatttagtatagacatcaacacacaaaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtgatcaccatctcctgcactggaaccagcagtgacgttggtggtatgactatgtctctgtaccaacaacaccccgaccaaacgccccaaactcatgatttangaggtcagtaactcggccgtcggggttactaagtcggttctcgtggctcaagtctggcaacgaccgtcctccctgacctatctcgtcgggcctccgacgccctggacgggtacgaggtctagtaactttacttacgtgcacgtctacgtattaactactagacagactactacgtacggttgggtcggttaccggggacgggggaacctaacggtccgtacggtaccccggtcccgttaaggtacccgtacggaccccgtaagggtccctccggtccccccgttacggg

SEQ ID NO: 203353 - DNA, 884 bp, Homo sapiens
  misc_feature: GYAE6OF01A6PUP.38.32.C10.1.454.CMB.1.raw
tcagtcgatcacgtcacgaccggtgctcgatttagtatagacatcaacacacaaaggggggggtctcaggaggcagcgctctcaggacatctccaccatggcctgggctctgctgctcctcaccctcctcactcgagggtcacgagggtcctgggcccaggtctcgccctgactcgacgtcctcgcctcgtgtcgtcgggtcctccgtgacgagtcgactccgaccacgttccgtccgttgaccgtaccgtacggaaccagtcgtaggttcgtacggtttggttacggttatcggtaacgttagttccggttccttaccgttacggtaacccaaaccgtaaccccgtaacccccggtaaccgtaaaaccccggtaccccctaaacgttccgtaacgttacggttaacgtttacggtcggtaacgttaccgtaacggttaccggttcccgggtacccggtttacggggtttacctacggttccggtttccgtacggttcggtaccttacgtaacggttccgtacggtaccgtaaccgtaccggtacccttaccgtacgtaacccgtacgtttcccgtacggttaccgggtaccttacccggtacggtacccggttaagggtaccggtaacggtacggtacctttaccgggttaaacgttttaccgtaacggttcggtaccgttaaccgggtacctttaaccgtacgttaacccggttaacgtacgtaccgtagttacccttaacgggttccgttacggtttcggggtaaccggtccgggggaaaccgggttaccaccgggtttacgcccggttaacccggtacggttaaccggtaccggtaccgtacccgggaaccggttcccggtaccccgttccggtttaccg

SEQ ID NO: 203354 - DNA, 650 bp, Homo sapiens
  misc_feature: GYAE6OF01DJMM9.38.32.C10.1.454.CMB.1.raw
  modified_base (337)..(337): a, c, t, g, unknown or other
  misc_feature (337)..(337): n is a, c, g, or t
tcagtcgatcacgtcacgaccggtgctcgatttagtatagacatcaacacacaaaggggggggtctcaggaggcagcgctctcaggacatctccaccatggcctgggctctgctgctcctcaccctcctcactcagggcacagggtcctgggcccagtctcgccctgactcagcctgcctccgtgtctgggtctcctggacagtggatcaccatctcctgccactggaaccagcagtgacgttggtgttatgactatgtctcctgtaccaacaccaccccgaccaaaccgcccccaaactcatgtattatgagtcagtacgtcggccgttcgggttntagtcgtctcgtgctcgtaagtctcgtacacgaccggccctccgtgacctatcctacgtcggcctccgacgtcctaggacggacgacggtctagtatttacgtacgtgccgagtcctacgtaactacgttaacgtacgtacgacgtactattaccggttacggttcggggttacggggttaccgggggtacccggggggtaaccgtaacgggtccgttacccgggttacccggttacccggttacgggtacccgtacccgggtaaccccgtaccggggaccccgttacccggtccccccccggtttaaccggg

SEQ ID NO: 203355 - DNA, 876 bp, Homo sapiens
  misc_feature: GYAE6OF01BHK4Y.38.32.C10.1.454.CMB.1.raw
tcagtcgatcacgtcacgaccggtgctcgatttagtatagacatcaacacacaaaggggggggtctcaggaggcagcgctctcaggacatctccaccatggcctgggctctgctgctcctcaccctcctcactcagggcacagggtcctgggcccagtctgccctgactcagcctgcctccgtgtctgggtctccgtggacagtggatcactatctcctgcactggaaccagcagtgacagttggtactaatttaacgtaacttcttagttcttcggtaggttaaccaactaaccacccgacggaccaaccgaccccctaaactctaatttactttagtaggtacggtaccggtaacgtccggtacccctacgtaacgggttaactttaaccgttaaacgttccggtctttaccgttcgtttaccggtacccttaacccgtaacggtttaccgtacggggtaacccaaacccggtacccggggtaccccttccccgttaacggaacccctaacgtttcctaccgggttaccggtacccttacccggtaaggtacccgttagggaaccgggtaaccggaccgggttaccgtttaacggtaaccgttttaaccgttaaccgttcgggttaccttaacgggttttaacctaagtttaacccgtaaaccttaaaccgggtaaccgttaaccccgtttaacctttaccccgttttaccgtttaccggttttaccggttttaaaccccgggttacgggggttaacccggggtacggggttaacccggttacgggggttacccgtaaccccgggttaacccggtttaaccggtaccggtaaccccggtaacccggttaaccgggtccgttaacccccccgggg

SEQ ID NO: 203356 - DNA, 683 bp, Homo sapiens
  misc_feature: GYAE6OF01CG35F.38.32.C10.1.454.CMB.1.raw
tcagtcgatcacgtcacgaccggtgctcgatttagtatagacatcaacacacaaaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtggatcaccatctcctgcactggaaccaggcagtgacgttggtggttatgactatgtctcctggtaccaacaaccaccccgccaaacgcccccaaactcatgatttatgaggtacagtaactcggtccgttcggggtttactaacgtcggttctcgtcggtctaccgtaagtctggccaacgaccggcccttccctcgacctattcctcgtacgggcctccgacgccgtaggacggtacggacggtcgtagtaactttacttacgtcggacacgtcctactaagttaacttaacgtacgtcctaacgtccgtaacttaccgtaaccggttttgggggtacgggtttccggggggtaccggggggtaaacccgtaacgggtacccgttaccggggtaacccccggtttccggtaaccgggttaccgaacccgggtcccccgtaaaggggtccccttccccgggtcccccccgttacccgggg

SEQ ID NO: 203357 - DNA, 634 bp, Homo sapiens
  misc_feature: GYAE6OF01EVY23.38.32.C10.1.454.CMB.1.raw
  modified_base (203)..(203): a, c, t, g, unknown or other
  misc_feature (203)..(203): n is a, c, g, or t
  modified_base (324)..(324): a, c, t, g, unknown or other
  misc_feature (324)..(324): n is a, c, g, or t
  modified_base (478)..(478): a, c, t, g, unknown or other
  misc_feature (478)..(478): n is a, c, g, or t
tcagtcgatcacgtcacgaccggtgctcgatttagtatagacatcaacacacaaaggggggggtctcaggaggcagcgctctcaggacatctccaccatggcctgggctctgctgctcctcaccctcctcactcagggcacagggtcctgggcccagtctgccctgactcacgcctgcctccgtgtctgggtctccgtggacngtgatcaccatctcctgcacgtacggaaccagcgagtcgtacggttggtggttatgactatcgtctcctacgtaaccaaccaaccaccccgaccaaaccgccccaaactcatgtatttagnggtagtactagtactcggtcccgttacgggttactacgttcgttctcgtcggtctacgtagtcgacgacaaccgtccgcccttaccgtcgtacctacttccgtacggtcggcctccgacgtccgtaggacggcgacggcttagtatttagtacncgtactacgtactactattaactacgtacgacagtctactacgtacgggtttggggtcgggtaccgggggaaccgggtaccgtaacggtcgtaccggttacccggtcgttacgacccgaccggtacgaaccggtcccgtcccggccccgttaccgg

SEQ ID NO: 203358 - DNA, 638 bp, Homo sapiens
  misc_feature: GYAE6OF01AKVV0.38.32.C10.1.454.CMB.1.raw
  modified_base (199)..(199): a, c, t, g, unknown or other
  misc_feature (199)..(199): n is a, c, g, or t
  modified_base (253)..(253): a, c, t, g, unknown or other
  misc_feature (253)..(253): n is a, c, g, or t
tcagtcgatcacgtcacgaccggtgctcgatttagtatagacatcaacacacaaagggggggtctcaggaggcagcgctctcaggacatctccaccatggcctgggctctgctgctcctcaccctcctcactcagggcacagggtcctgggcccagtctgccctgactcagcctgcctccgtgtctggtctcctggacngtgatcaccatctcctgacactcggaaccagccaggtgtacggttggtggttangactagtgtctcctgtaccaacaaccaccccgaccaaacgcccccaaactcatcgatttatgagtcagtaactcggcccgtgggttctatcgttctcgtcggcttccagtctggcaacacggtccctcctcgaccgtatcctctcgggctccgacgtcccttggacggacggtaggccgtaggtaattacgtttaacgtcgtcgagtcctactaacttaataccttaagcctaagactaatccgtaacggtttgggttcggtttcgggggaacccgggggaccgtaacgggtcccgtacggttaccccggtacgttaaccgggtaccgaacccgggtacccccgtaacggggtcccgttccccggtaaccccccggtttcccggg

SEQ ID NO: 203359 - DNA, 779 bp, Homo sapiens
  misc_feature: GYAE6OF01DKZ2T.38.32.C10.1.454.CMB.1.raw
  modified_base (224)..(224): a, c, t, g, unknown or other
  misc_feature (224)..(224): n is a, c, g, or t
  modified_base (248)..(248): a, c, t, g, unknown or other
  misc_feature (248)..(248): n is a, c, g, or t
tcagtcgatcacgtcacgaccggtgctcgatttagtatagacatcaacacacaaaggggggggtctcaggaggcagcgctctcaggacatctccaccatggcctgggctctgctgctcctcaccctcctcactcgagggcacagggtcctcgggcccagtctcgccctgactcacgcctgcctccgtgtcgttgggtcctccgtaggacaggtcgatccaaccnttcctcctgccacgtacggaaccngcgtagtacggtacgtttgggtagttataggtacttacgttcgttccgtaccgtacggtaaccccaaaccgaaccccgaacccccgaacccaaaacccgaccccctaaacgtccgaattacgtttaatttacgaggtacggtactaagttaacgtcccggttaccgggtttacgggtttacgtacgttccgttccgtccgtaccggacccttagtccgtaccgaccgtaacgcccgtacccctccgtacgaccttacgtcctacggtccggctccgacggtccgtaggaccggacgtaggtaccgtttagttaacttacgttaccgtcgaaccgtacgttacctataacgttaacgtaacgtccgacgttaacacttaccgttacggttacgggtttgggggttccccgggacggggggtaaacccccgggtacttacgggaccccgttacgggttaaccccgtcgttacgggtacccgcccggtaacgggtacccgtacccggttcccccggtccccgtacggttacccc

SEQ ID NO: 203360 - DNA, 618 bp, Homo sapiens
  misc_feature: GYAE6OF01A44AL.38.32.C10.1.454.CMB.1.raw
  modified_base (311)..(311): a, c, t, g, unknown or other
  misc_feature (311)..(311): n is a, c, g, or t
tcagtcgatcacgtcacgaccggtgctcgatttagtatagacatcaacacacaaagggggggggtctcaggaggcagcgctctcaggacatctccaccatggcctgggctctgctgctcctcaccctcctcactcagggcacagggtcctgggcccagtctgccctgactcagcctgcctcgtgtctgggtctcctggacagtgatcacatctcctgcactggaaccagcagtgacgttggtggttatgactatgtctccgtggtaccaacaaccaccccgaccaaacgaccccaaactcaatgatttacnggagtcaagtaatcggccgtggggttactaacgtcggttctcgtggcctacgaacgtctacggacaaaccgacggtccctaccctcgacctatctacgtcgggctccacgtctaggaggacgtaggctagtattacgtactgacgagtacctacgtacttaactacgttaacgctagtacaacttacacggttgggttcgggttaccggggaccggggggtaccaacggtacggtacggtaacccggttacccgtacggttaccgacggacccgtaacgggtaccctccgggtccccccgtaccggg

SEQ ID NO: 203361 - DNA, 821 bp, Homo sapiens
  misc_feature: GYAE6OF01AKUVL.38.32.C10.1.454.CMB.1.raw
  modified_base (247)..(247): a, c, t, g, unknown or other
  misc_feature (247)..(247): n is a, c, g, or t
tcagtcgatcacgtcacgaccggtgctcgatttagtatagacatcaacacacaaaggggggggtctcaggaggcagcgctctcaggacatctccaccatggcctgggctctgctgctcctcaccctcctcactcagggcacagggtcctgggcccaggtctcgccctgactcacgcctcgcctccgtgtcgtcgggtctccgtggactagtggactcacctatcctccgtgcctacgtacggaaccngacgtagtggtacggttggtacgttatgtacttatcgtcctccgtacggtaacccaaccgtaacccgacccccgtaacccgaaacccgaccccctaaatccgtaacttacgttaacttttaggcggtaacggtctaaacggttaaccggttcccgggtaccccgggttttacggggtttaacctaacggtttcccggttaccgttaccgggtacccggtaccccgtaagggttccgttaacgggaaccctaacccggtacccggtcccctttacccgtaaccggtaccctacgttcccgtccggttaccgggcccttaccgacggtccgttagggaaccggtacggtcggtacttagttaactttacgtaccgcggactcgtactactaactacgtactacgacgtacgacttcgttaccggttacgggttgggtaccggggttacccggggaccgggggtaaacctacgggtaccccgggttcggtaaccccggtacggttaccgggacccgtaaccggtaccccgggttaaccgtccccggtacccccggttccccgttccggttaaccccg

SEQ ID NO: 203362 - DNA, 718 bp, Homo sapiens
  misc_feature: GYAE6OF01CTC1H.38.32.C10.1.454.CMB.1.raw
  modified_base (211)..(211): a, c, t, g, unknown or other
  misc_feature (211)..(211): n is a, c, g, or t
  modified_base (300)..(300): a, c, t, g, unknown or other
  misc_feature (300)..(300): n is a, c, g, or t
tcagtcgatcacgtcacgaccggtgctcgatttagtatagacatcaacacacaaaggggggggtctcaggaggcagcgctctcaggacatctccaccatggcctgggctctgctgctcctcacctcctcactcagggcacgagggtcctgggcccagtctcgccctgacctcagcctgcctccgtgtctggtctcctggacagtgatcacntctctgcactggaacagcagtgtacgttggtgttatgactatgtctctcgtaaccaacaaccacccgaccaaaccgccccaaatcatanatttatgagtctaagtacgtccggtccggttcgggttactaacgttcggttctcgtcgtccttacaagttcgacggtacaaccgaccggtcccctcccgtacggaccctattccgttccgtacggtcccctccgaacgtcccggtacggaacgggaccgggtacggtcgttaacggttaactttaagttaccgtacggtacccgtacgtaccgtacttaacgttaactaacggtagtaccaacggtacttaacggttaccgttacgggttcgggttaacggggtccgggggtaacccggggggtactaaccgggttcccgtaacgggttacccccggtttaccggtaaacgggttacccgtacccggtaaacccggtacccggttacccggtcccccggtacccccggtttacccggg

SEQ ID NO: 203363 - DNA, 754 bp, Homo sapiens
  misc_feature: GYAE6OF01B3O9W.38.32.C10.1.454.CMB.1.raw
  modified_base (246)..(246): a, c, t, g, unknown or other
  misc_feature (246)..(246): n is a, c, g, or t
  modified_base (366)..(366): a, c, t, g, unknown or other
  misc_feature (366)..(366): n is a, c, g, or t
tcagtcgatcacgtcacgaccggtgctcgatttagtatagacatcaacacacaaaggggggggtctcaggaggcagcgctctcaggacatctccaccatggcctgggctctgctgctcctcaccctcctcactcaggcacgacgggtcctgggcccagtctcgccctgacctcacgcctcgcctccgtgtcgtcggtctccgtggactagtggactcacctatcctcctgcctacgtacggaaccngacgtagtcggtacggtttggttagttagtagtacttagttcgttcctaccgtacgtaacccaaaccaaccccgaccccgaacccaaacccgacccctaaactcaatacgttatttacgngtaacggtacaacgtaccgtccggtacccggtttacggggtttacttaacgttccggttctcgttcggtacttaccgtacgttcgacggaacctaaccgccgtaccctaccgacgtacctaccgttctcggtacggtcctacccgacgtccgtaggaacggacgtagtactagtaactttacgtaccgtcgactcgtacttacgtaactaaacgttcgaacgtaccgtacacgttaccgtcggttaaccggtttgggggttaccggtacccggggggtaaccgggtaaccgtaccggttccgggtaacccggtacccggtttaaccgacggtaccccgtaaccgtacccggtaaccgtaccccggtccccgttaccccggttacccgg

SEQ ID NO: 203364 - DNA, 763 bp, Homo sapiens
  misc_feature: GYAE6OF01ASL5J.38.32.C10.1.454.CMB.1.raw
  modified_base (219)..(219): a, c, t, g, unknown or other
  misc_feature (219)..(219): n is a, c, g, or t
tcagtcgatcacgtcacgaccggtgctcgatttagtatagacatcaacacacaaaggggggggtctcaggaggcagcgctctcaggacatctccaccatggcctgggctctgctgctcctcaccctcctcactcgagggcacagggtcctgggcccagtctcgccctgactcagcctgcctccgtgtcgtgggtcctccgtggacagtcggatccaccntctcctagcctacgtacggaaccaggcgtagttcgacggttggtacggttatacggtactagtcgttccttccgtaggacccaactaaccacccccggaacctaaaccggcccccaaaactcaacgttacgtactttaagcgggtaacgtcgaacggtaactccggggtaccccggtttacggggtttactaacgttccggtttcctcgttaccggtccttacgtaacggttcgacggtacccaacgtacccggtccctacccgtcgtaacccgagtttcccgtacggttaccgggtcctaccggtaccgtccggtacgggacgggaacggtacggtctaacggttaacttaaccgttacctcgggacctacgaccttacgtacttaacgtactaccgactagtacgtactacgtccgggttagggtaccgggtttaccggggaccggggtaaacctcgggtactaccggggtacccttaaccggttcggtacccgtaacggaccccgggtaaggtccccttaccccgggcccgttaacccggg

SEQ ID NO: 203365 - DNA, 762 bp, Homo sapiens
  misc_feature: GYAE6OF01CTMIK.38.32.C10.1.454.CMB.1.raw
  modified_base (175)..(175): a, c, t, g, unknown or other
  misc_feature (175)..(175): n is a, c, g, or t
  modified_base (210)..(210): a, c, t, g, unknown or other
  misc_feature (210)..(210): n is a, c, g, or t
  modified_base (581)..(581): a, c, t, g, unknown or other
  misc_feature (581)..(581): n is a, c, g, or t
tcagtcgatcacgtcacgaccggtgctcgatttagtatagacatcaacacacaaagggggggggtctcaggaggcagcgctctcaggacatctccaccatggcctgggctctgctgctcctcaccctcctcacgtcagggcacgagggtcctgggcccagtctcgccctgactcncgcctcgccttccgtgtcgtgggtctccgtggacngtggactaccacctatcctacctgccacgtacggaacccagcaggttcggtacggttggttgtttacgtggtaacttagtcgttcctccgtacggtaaccaaccaaaccccgaccccgaacccaaaacccggaaccccctaaactcctaacgtacgttactttacgtggtaacgtacgtaacggttaaccggtcccgggtaccggtttacggggtttaacgtaaccgtttcggtttaccgttaccgtaccggtacccgtaacgtccgtacggtaccgaaccggacccgttcccgtaccgtaccgtaccctacgttccgtcggtccggtcctccgacgtcgtacggagtacgtaggtctagttacttagtcngtcgactcaactataacgttacacggtacacgtacgtctttacggttcgggtttacgggttacgggttacccgggggacgggtaaccggtaaccggtaccggtacgtaccccggttacggaccgttaccggacggtacccgaaccggtcccggttacccgcccccggtttacgtaccccgg

SEQ ID NO: 203366 - DNA, 652 bp, Homo sapiens
  misc_feature: GYAE6OF01BDBHE.38.32.C10.1.454.CMB.1.raw
tcagtcgatcacgtcacgaccggtgctcgatttagtatagacatcaacacacaaaggggggggtctcaggaggcagcgctctcaggacatctccaccatggcctgggctctgctgctcctcaccctcctcactcagggcacgagggtcctgggcccagtctgccctgactcagcctgcctccgtgtctgggtctcctggacagtgatcaccattctcctgcactggaaccagcagtgacgttggtgttatgactatgtctcctagtaccaacaaccaccccgacaaaccgacccccaaatcgactgtatttatggagtacagtacgtcggccgttcggggttactagttcggttctagtcgctcgagtctcggacacgtaccgtcctcccgtcgaccctatccgtccggtcggccttacccgacggttacccgacggaacgggaccggtacggtcgttacggtatttaccgtttacgtaccgcgtaccgtacttacaacttaacgtacgtacgaccagtactacgtaccttacggtttggggtacggtttccggggaacgggggtacctaaccgggttccgacggtacccgttaccggtacggtacctacccggaccgtaacccggtcccgttccggcccccgttaaccggg

SEQ ID NO: 203367 - DNA, 788 bp, Homo sapiens
  misc_feature: GYAE6OF01AF8DA.38.32.C10.1.454.CMB.1.raw
  modified_base (245)..(245): a, c, t, g, unknown or other
  misc_feature (245)..(245): n is a, c, g, or t
  modified_base (620)..(620): a, c, t, g, unknown or other
  misc_feature (620)..(620): n is a, c, g, or t
tcagtcgatcacgtcacgaccggtgctcgatttagtatagacatcaacacacaaaggggggggtctcaggaggcagcgctctcaggacatctccaccatggcctgggctctgctgcctcctcaccctcctcactcagggcacagggtcctgggcccagtcctgaccctgactcacgcctgccctcgtgtcgtgggtacctccgtggacaggtgactccacctatctccgtgaccacgtggaaccngtcaggtgacgtttggtaggttactgtactatcgttcctccgtcggtaaccaaaccgaacccgaccccccgaacgaaaacccgacccccctaaaactcgaacgttacggttatttagacggtacggtacaacggttaacgtcccgggtacccgggttttacggggtttacttaacggttccggttctcgtcgggtaccttacccgaagtttccggacgtaacccgtaaaccgtacccgggttacccctacccgtacgaaacccgttccgttacccgttccgggtaaccgggtccccttacgacccgggttacccgttaaggggaaccgggtaaccggacggttaccgttagttaacgtttaaccgtttcgaaccncggtaactccgtaacttagtaacttacgacgtaccggacttaggacttaccgtcggggtttcggaccgggtttacgggggaccggtaacccgtcgtacccgaccgggtacccgtacggttacggacccgtacacccgggttacgccgttccccggtaccccgttccgg

SEQ ID NO: 203368 - DNA, 800 bp, Homo sapiens
  misc_feature: GYAE6OF01BOZPL.38.32.C10.1.454.CMB.1.raw
  modified_base (231)..(231): a, c, t, g, unknown or other
  misc_feature (231)..(231): n is a, c, g, or t
tcagtcgatcacgtcacgaccggtgctcgatttagtatagacatcaacacacaaaggggggggtctcaggaggcagcgctctcaggacatctccaccatggcctgggctctgctgctcctcaccctcctcactcagggcacgagggtcctgggcccagtctgccctgactcagcctgcctccgtgtctgggtctcctggacagtgatcaccatctcctgcacgtggaaccngcagtgacggttggtagttatgtactagtgtcctccgtaggtaaccaacaaccgaccccgaccaaaccgacccccaaactcaagtgtagtttataggacgtactaagtaactccggtacccgttcggggtttactaacgttccggttcttcgtcgtacctaccgtaacggtcctacggaaccctaaacccggtaccggtccccttacccccgtacgtaacccctacgtttacccgtaccggttcggggtcccttaccccggtacggtaccccgttagggaaccgggaaccggtacgggtccgttaggttaacttttaactttaccggtacgtaccgtaccgtaaccttacgtaacgtttaactaaccgttacgaccgtacggtaaccgtaacgttaccgttacgggtttacggggttaccggggtttacccggggggaaccggggggttaaccctaacgggttacccggttacccgggttacccggttacccgggttaacgggtaccccggtaaccgggtaaccccgtaacgggtcccccggttccccggtccccccggtttaaccggg

SEQ ID NO: 203369 - DNA, 681 bp, Homo sapiens
  misc_feature: GYAE6OF01C0NSO.38.32.C10.1.454.CMB.1.raw
  modified_base (211)..(211): a, c, t, g, unknown or other
  misc_feature (211)..(211): n is a, c, g, or t
  modified_base (241)..(241): a, c, t, g, unknown or other
  misc_feature (241)..(241): n is a, c, g, or t
  modified_base (502)..(502): a, c, t, g, unknown or other
  misc_feature (502)..(502): n is a, c, g, or t
  modified_base (655)..(655): a, c, t, g, unknown or other
  misc_feature (655)..(655): n is a, c, g, or t
tcagtcgatcacgtcacgaccggtgctcgatttagtatagacatcaacacacaaagggggggggtctcaggaggcagcgctctcaggacatctccaccatggcctgggctctgctgctcctcaccctcctcactcgagggcacgtagggtcctagggcccagtctcgccctgactcagcctgcctcggtgtcgtggtctccgtgacagtgntacacctatctccgtgccacgtcggaaccngacaggtcggtacggttggttaggttagtcgacttagtgtcctaccgtacggtaacccaaactaaccccaacccccgaaccgaaacccgtaacccccctaaaactctaacgtagttaacgtttagtaggtacgtaccgtaaaggttaacggtccccggtcccgggtttacgggttaccttaacgttcggttctcgtcggacctaccgtaagtcgcgtaacaccgtccgtaccctccgtactacgactcgtcgtcggtaccncgtacgccgtaggacggtaacgcggtctattactttacgtacgtcgcgtacgtcactaatagtacagtcagtactgtccgtaggtcggttacgggtcgggaccgggtacgtacggtcgtaccggttccgtccggtacgacgtaccggtaccgnggaccccgtcccgggtaccttccggg

SEQ ID NO: 203370 - DNA, 505 bp, Homo sapiens
  misc_feature: GYAE6OF02HJUC2.38.32.C10.1.454.CMB.1.raw
  modified_base (229)..(229): a, c, t, g, unknown or other
  misc_feature (229)..(229): n is a, c, g, or t
tcagtcgatcacgtcacgaccggtgctcgatttagtatagacatcaacacacaaagggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtggatcaccatctcctgcactggaaccngcagtgacgttggtggttatgactatgtctcctggtaccaacaacaccccgccaaagcccccaaactcatgatttatgaggtcagtaatcggcctcggggtttctaatcggttctctggctcaagtctggcaacacggcctccctgaccatctctggctccagcctgaggacgaggctgattattactgcagctcatatactagcagcatcacttggtgttcgggcgggggtaccaaggctgaccgtcgtaggtcacgccaggctcgccccttcgg

SEQ ID NO: 203371 - DNA, 517 bp, Homo sapiens
  misc_feature: GYAE6OF02H5ELO.38.32.C10.1.454.CMB.1.raw
  modified_base (229)..(229): a, c, t, g, unknown or other
  misc_feature (229)..(229): n is a, c, g, or t
tcagtcgatcacgtcacgaccggtgctcgatttagtatagacatcaacacacaaagggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtggatcaccatctcctgcactggaaccngcagtgacgttggtggttatgactatgtctcctggtaccaacaacaccccgccaaagcccccaaactcatgatttatgaggtcagtaatcggccctcggggtttcaatcggttctctggctcaagtctggcaacacggcctccctgaccatctctggctcagcctgaggacgaggctggatttattactgcagctcattatactagcagcaatcacgttgggtgttcgggcgggggaccaaggccgtggaccgtccgtaggtcagcccgaaggcctcgccccttccgg

SEQ ID NO: 203372 - DNA, 503 bp, Homo sapiens
  misc_feature: GYAE6OF02GVDYV.38.32.C10.1.454.CMB.1.raw
tcagtcgatcacgtcacgaccggtgctcgatttagtatagacatcaacacacaaagggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtggatcaccatctcctgcactggaaccagcagtgacgttggtggttatgactatgtctcctggtaccaacaacaccccgccaaagcccccaaactcatgatttatgaggtcagtaatcggccctcgggggttctaatcggttctctggccccaagtctggcaacacggcctccctgaccatctctgggctccagcctgaggacgaggctgattattactgcagctcatatactagcagcatcacttggtgttcggcggggacaggctgaccgtctagtcagcccaaggctcgcccctggtcc

SEQ ID NO: 203373 - DNA, 518 bp, Homo sapiens
  misc_feature: GYAE6OF02IKO2Y.38.32.C10.1.454.CMB.1.raw
  modified_base (197)..(197): a, c, t, g, unknown or other
  misc_feature (197)..(197): n is a, c, g, or t
  modified_base (206)..(206): a, c, t, g, unknown or other
  misc_feature (206)..(206): n is a, c, g, or t
  modified_base (223)..(223): a, c, t, g, unknown or other
  misc_feature (223)..(223): n is a, c, g, or t
  modified_base (297)..(297): a, c, t, g, unknown or other
  misc_feature (297)..(297): n is a, c, g, or t
  modified_base (425)..(425): a, c, t, g, unknown or other
  misc_feature (425)..(425): n is a, c, g, or t
tcagtcgatcacgtcacgaccggtgctcgatttagtatagacatcaacacacaaagggggggtctcaggaggcagcgctctcaggacatctccaccatggcctgggctctgctgctcctcaccctcctcactcagggcacagggtcctgggcccagtctgccctgactcagcctgcctcgtgtctggtctctggacngtgatcacntctctgcactggaaccngcagtgacgttggtggttatgactatgtctctggtacaacaacacccgcaacgccccaaactcatcgatttacngaggtcagtaatcggccgtcggggttctaagtcggttctctggctcaagtctggcaacgacgcctccctgacctatctcgtcggctccgacgcctgacggacgaggctgtacttacttactgcagctnatatactagctagcatcacgttggtgtcggcggggaccaaggtccgtcgaccgtcgtaggtcgtacgcccgtacggactccgaccccgtccgg

SEQ ID NO: 203374 - DNA, 560 bp, Homo sapiens
  misc_feature: GYAE6OF02GV3HR.38.32.C10.1.454.CMB.1.raw
  modified_base (310)..(310): a, c, t, g, unknown or other
  misc_feature (310)..(310): n is a, c, g, or t
  modified_base (455)..(455): a, c, t, g, unknown or other
  misc_feature (455)..(455): n is a, c, g, or t
tcagtcgatcacgtcacgaccggtgctcgatttagtatagacatcaacacacaaaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtggatcaccatctcctgcactggaacccagcagtgacgttggtggttatgactatgtctcctggtaccaacaaccaccccgccaaacgcccccaaactcatgatttangaggtcagtaatcggcctcggggtttctaagtcgttctctggctcctaagtctggcaacgaccggcctccctgaccatcctcgtgggtcctccagcctggacgggacgaggctgtattagttactgcagctcatacttactacgnagctaatcgtaacgtttggggtgttccggggacggggtaccgtaaggccgtacggtaccgtccgttacggtccgacgccgaacggtcctccggcccccttaccgg

SEQ ID NO: 203375 - DNA, 636 bp, Homo sapiens
  misc_feature: GYAE6OF02JZP8S.38.32.C10.1.454.CMB.1.raw
  modified_base (189)..(189): a, c, t, g, unknown or other
  misc_feature (189)..(189): n is a, c, g, or t
  modified_base (241)..(241): a, c, t, g, unknown or other
  misc_feature (241)..(241): n is a, c, g, or t
  modified_base (246)..(246): a, c, t, g, unknown or other
  misc_feature (246)..(246): n is a, c, g, or t
  modified_base (312)..(312): a, c, t, g, unknown or other
  misc_feature (312)..(312): n is a, c, g, or t
  modified_base (328)..(328): a, c, t, g, unknown or other
  misc_feature (328)..(328): n is a, c, g, or t
  modified_base (577)..(577): a, c, t, g, unknown or other
  misc_feature (577)..(577): n is a, c, g, or t
tcagtcgatcacgtcacgaccggtgctcgatttagtatagacatcaacacacaaagggggggtcgtcgaggaggcgagcgctctcaggacatctccaccatggcctgggctctgctgctcctcaccctcctcacctcgacgggccactaggggtccctggggccccaaggtcctggcccctagactccngccctgcccttccggtgtctgggtccttccgtggacctaggtggactcaccnttccncctgcactggaacctgcagtggacgttggtcggttatgactatcgttctctggtacaacacacccnccaacgcccaactcanagtattactgacgtcagtacgtcggccttacggggtttctaatcggttctacgtggactccgaagtctgacctaacgccgtccgtccacgtacccgattcgtaccggtcggtccctaccggtagggttcggtagggaaccggcgtacgtgaccgttaacttgtcgtacgtccctacgacctagtcgggactacggtaggtacgggtttcggacggtacggtacgaacgtcggtaccgtcggtaaccgtnaacggtcccgtaggtccgccccgtggtacctcttaccgttcgtccctcccgtagttccg

SEQ ID NO: 203376 - DNA, 706 bp, Homo sapiens
  misc_feature: GYAE6OF02IR5ZK.38.32.C10.1.454.CMB.1.raw
  modified_base (191)..(191): a, c, t, g, unknown or other
  misc_feature (191)..(191): n is a, c, g, or t
  modified_base (209)..(209): a, c, t, g, unknown or other
  misc_feature (209)..(209): n is a, c, g, or t
  modified_base (229)..(229): a, c, t, g, unknown or other
  misc_feature (229)..(229): n is a, c, g, or t
tcagtcgatcacgtcacgaccggtgctcgatttagtatagacatcaacacacaagggggggtacgtacgaggaggcgagcgctctcaggacatctccaccatggcctgggctctgctgctctcacctcctcactcaggcacagggtcctgggccagtctgccctgactcagcctgcctcgtgtctgggtcnccgtggcagtggatcacntcctcctgcactcggaaccngcagtcgacgttggtggttatgtactagtgtctccgtggtaccaacgacaccccgccaaacgcccccgaaactcaactcgactttaagtcgtacgtactacgtaactccggtaccggttacggggtttccttaaacggttccggttaccttcggttacgggtccttaccggtaaaggttccgtcgggtacctaaccggtaccggtccccttacccgtacgggtacccttacgtttcgtacgggtcctacccgtacggtcccgttaggtacgggacggtaccgggcttacggtaactttacggtttacgtcgtacccgaggtacccttacgaactttaacgttaacctaggtaccacggtacctactacggttacgttacgggtcggtttaccggggcggggtaaccgtaggcgttccggaccgttcgaacgggttccgaacggttccgaacggtcctccggtcccccgtgttacccg

SEQ ID NO: 203377 - DNA, 652 bp, Homo sapiens
  misc_feature: GYAE6OF02F661Q.38.32.C10.1.454.CMB.1.raw
tcagtcgatcacgtcacgaccggtgctcgatttagtatagacatcaacacacaaagggggggggtctcaggaggcagcgctctcaggacatctccaccatggcctgggctctgctgctcctcaccctcctcactcagggcacagggtcctgggcccagtctgccctgactcagcctgcctccgtgtctggtctctggacagtgatcaccatctcctgcactggaaccagcagtgtacgttggtggttatgactatgtctccgtggtaccaacaaccaccccgaccaaacgcccccaaactcatgtatttagtgtagtcagtacgtacggtccggttcgggtttactaacgttcggttacttcgtcgtctaccgtacgtcgtcgtacaaccgaccgtccctccgtccgacacgttcctaccgtcggcctccgacgtccgtcggacgggtaccggaggtccgttaggttacttacgtttacgtcgtacgtacgtcttacgtacttaacgttaccgtacgaactacgactacttaccggtagtttcggggttgggttaccggggtacggggaccggtacggtaccgttaccggtacccggtaccgttacggaccgtaccggaccgtacggtccgtacccggtccccgtaccccgg

SEQ ID NO: 203378 - DNA, 708 bp, Homo sapiens
  misc_feature: GYAE6OF02JG8UD.38.32.C10.1.454.CMB.1.raw
  modified_base (130)..(130): a, c, t, g, unknown or other
  misc_feature (130)..(130): n is a, c, g, or t
  modified_base (243)..(243): a, c, t, g, unknown or other
  misc_feature (243)..(243): n is a, c, g, or t
  modified_base (361)..(361): a, c, t, g, unknown or other
  misc_feature (361)..(361): n is a, c, g, or t
tcagtcgatcacgtcacgaccggtgctcgatttagtatagacatcaacacacaaagggggggtctcgaggaggcagcgctctcaggacatctccaccatggcctgggctctgctgctcctcaccctcctnactcaggcacagggtcctgggcccagtctgccctgactcagcctgcctcgtgtctgggtctccgtggacacgtggattccaccgtattccgtcctgacctacgtggaaacccnggcagtcgtacgttggtgttatgactatgtctcgtggtacaacaaccacccgaccaaacgacccccaacgtacactgtaacttagtgagtcgagttaacgtcggccgttccgggtttntaacgttcggttactcgtcggtcccaagttctacgggcaacgtaccgtcccgtacctcggtaccacgttacctcgtcgggtaccctccgtaacgtcccgtcggtaacgggtaccggacggtccgtagtacgttaacgtttaaccgtcgtccgagtacccttcgaacgttacttaaccgtacgtaccgttaacgtaccgtaccgttaccgtacggtttacgggttcgggtttacccggggtacggggggttaacctaacgggtccggtaccggttaaccgtcccgttaccggtaacgaccggtaccccgaacgggtccgtacccggtacccccgttccggtaacccgg

SEQ ID NO: 203379 - DNA, 569 bp, Homo sapiens
  misc_feature: GYAE6OF02HHYNT.38.32.C10.1.454.CMB.1.raw
  modified_base (231)..(231): a, c, t, g, unknown or other
  misc_feature (231)..(231): n is a, c, g, or t
  modified_base (440)..(440): a, c, t, g, unknown or other
  misc_feature (440)..(440): n is a, c, g, or t
  modified_base (448)..(448): a, c, t, g, unknown or other
  misc_feature (448)..(448): n is a, c, g, or t
tcagtcgatcacgtcacgaccggtgctcgatttagtatagacatcaacacacaaaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtggatcacatcctcctgcacgtggaaccngcagtgacgttggtggttatgactatgtctcctggtaccaacaaccaccccgaccaaacgcccccaaactcatgatttatgaggtcagtaatcggcccgttcgggggtttctaagtcggttctcgtggtctcaagtctggacaacgacggcctccctgaccactctcgtcggccttcgacgccgtgacggacgaggctgtattattacngcagctanatatactagcacgctatccgtagttcggggtcggttcgggacgggggtacctaaggccgttacggtaacccgttccgtacggtaccgaccggacccgtacggtcctccggccccgttccgg

SEQ ID NO: 203380 - DNA, 548 bp, Homo sapiens
  misc_feature: GYAE6OF02IFOHR.38.32.C10.1.454.CMB.1.raw
  modified_base (231)..(231): a, c, t, g, unknown or other
  misc_feature (231)..(231): n is a, c, g, or t
tcagtcgatcacgtcacgaccggtgctcgatttagtatagacatcaacacacaaaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtggatcaccatctcctgcactggaacccngcagtgacgttggtggttatgactatgtctccttgtaccaacaacaccccgccaaacgcccccaaactcatgatttatgagtcagtaatcggcctcggggtttcaagtcgttctctggctcaagtctgcaacacggcctccctgaccatctctcgggctccacgcctgacggacggaggctgtatttattactgctacgctcgattattactagcagctatctacgttgggtgttcgggacgggggaccaaggtccgtaggacccgttacgttacggtcacggacccgaacggccgttaccggtcccccgtaccggg

SEQ ID NO: 203381 - DNA, 655 bp, Homo sapiens
  misc_feature: GYAE6OF02IUVOE.38.32.C10.1.454.CMB.1.raw
  modified_base (211)..(211): a, c, t, g, unknown or other
  misc_feature (211)..(211): n is a, c, g, or t
tcagtcgatcacgtcacgaccggtgctcgatttagtatagacatcaacacacaaagggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtgactcaccntctctgcactggaaccagcagtgacgttggtgtatgactatgtctcgtgtaccaacaccaccccgacctaaaccgaccccaaactcgtactacgtattttacgaggtacggtacctaagtaacgttcccggtacccggtttaccggggtttactaacgttcggtttcctcgtcgtccgtacctagttcgtcgtaccaaccgccgtaccctacctcgaacctagtctcgtaggcctccgtacgtccgtggacggtaacggacgtcgtacgttacttattaccgacgtcgacgtctactaagttactacgtaacgacgacgtctaacgtcttacgttcgggttccgggtacgggaccgggggtaactacggtacgtaccgtaaccggtccgttaacggtaccgtccgtaacccggacggtcccgttacccggtccccgttacccgg

SEQ ID NO: 203382 - DNA, 665 bp, Homo sapiens
  misc_feature: GYAE6OF02HUYKA.38.32.C10.1.454.CMB.1.raw
  modified_base (313)..(313): a, c, t, g, unknown or other
  misc_feature (313)..(313): n is a, c, g, or t
tcagtcgatcacgtcacgaccggtgctcgatttagtatagacatcaacacacaaaggggggggtctcaggaggcagcgctctcaggacatctccaccatggcctgggctctgctgctcctcaccctcctcactcagggcacagggtccctgggcccaggtcctgccctgactcagcctgcctccgtgtcgtgggtctccgtggacagtcggatcaccatctcctgcactggaaccagcaggtgtacgttggtgttatgactatgtctctgtaccaacacacccgacaacgccccaaactcatagtacttttanaggtacgtacaagtaacgtccgggtacccgttcgggggtttactaacgttcggttaccttcgtcggtactccgtaagtcgtacggacaacgacccgtcccgtcctagaccctagtctacgtcggaccttaccgacgtccgtcgtaacgggaccggtaggtcttaggtaacttttacgttacgttacgacgtacgtaccgttactaaacttataaccgtagacgtacgtactactaccgtagtttcggggtacggttacggggacgggggtaaccgtaacggccgtaccgtaccgttaccggtacggtacgtaccggacccggtaacggtcccgtacccgtccccggttaccg

SEQ ID NO: 203383 - DNA, 609 bp, Homo sapiens
  misc_feature: GYAE6OF02F0U5E.38.32.C10.1.454.CMB.1.raw
  modified_base (230)..(230): a, c, t, g, unknown or other
  misc_feature (230)..(230): n is a, c, g, or t
  modified_base (462)..(462): a, c, t, g, unknown or other
  misc_feature (462)..(462): n is a, c, g, or t
  modified_base (466)..(467): a, c, t, g, unknown or other
  misc_feature (466)..(467): n is a, c, g, or t
tcagtcgatcacgtcacgaccggtgctcgatttagtatagacatcaacacacaaaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtggatcaccatctcctgcactggaaccngcagtgacgttggtgttatgactatgtctctggtaccaacaaccaccccgacaaacgccccaaactcatgatttatgagtacagtaacgtccggcccgttcggggtttactaagttccggttactcgtggtcctacgtaagtcgtaggacctaaccgaccggtccctaccgtacgacctacttcctcgtcgggcctccgacgcctagacggtacgagcttagactttactcncgcnnctctatatacgtacacgagtactactacgttacgttcggggtcgttcggggaccggggtaaccgacggtaccgtcggtacccggtttaccgtagggtaccaccggtacccgaacggtccgttacccggtccccgttacccgg

SEQ ID NO: 203384 - DNA, 548 bp, Homo sapiens
  misc_feature: GYAE6OF02GRPKP.38.32.C10.1.454.CMB.1.raw
  modified_base (230)..(230): a, c, t, g, unknown or other
  misc_feature (230)..(230): n is a, c, g, or t
  modified_base (375)..(375): a, c, t, g, unknown or other
  misc_feature (375)..(375): n is a, c, g, or t
tcagtcgatcacgtcacgaccggtgctcgatttagtatagacatcaacacacaaaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtggatcaccatctcctgcactggaaccngcagtgacgttggtggttatgactatgtctcctggtaccaacaaccaccccgccaaacgcccccaaactcatgatttatgaggtcagtaatccggcccgttcgggggtttctaagttcggttctctggctccaagtctggcaacncggcctccctgaccatctcgtgggcctccacgcctgacggacgaggctgtaatttacttactgcagtctacatactactagcagcactcaacgttgggtcggttcgggcggggtacaaggtcgtacggacccgttcgtaggtcgacggacccgtaggcctccgccccgtccgg

SEQ ID NO: 203385 - DNA, 552 bp, Homo sapiens
  misc_feature: GYAE6OF02IT79Z.38.32.C10.1.454.CMB.1.raw
  modified_base (229)..(229): a, c, t, g, unknown or other
  misc_feature (229)..(229): n is a, c, g, or t
tcagtcgatcacgtcacgaccggtgctcgatttagtatagacatcaacacacaaaggggggggtctcaggaggcagcgctctcaggacatctccaccatggcctgggctctgctgctcctcaccctcctcactcagggcacagggtcctgggcccagtctgccctgactcagcctgcctcgtgtctgggtctcctggacagtggatcaccatctcctgcactggaaccngcagtgacgttggtggttatgactatgtctcctggtaccaacaaccaccccgccaaaacgcccccaaactcatgtactttatgagtcagtaatcggccgtcggggtttcagtcgttctctcgcccagtctgcaacacgactccctgaccatctctcggctccagccgtgaggacgaggctgaattattacgtgcagtcctacatatacacgtacagcattacacgtttggggtcgttcggggacgggggaacctacggcgtacggaccggttccgtacggtccgaccggtacccgaggtccgtcccggtccccgtcggtaccc

SEQ ID NO: 203386 - DNA, 617 bp, Homo sapiens
  misc_feature: GYAE6OF02HYYLL.38.32.C10.1.454.CMB.1.raw
  modified_base (308)..(308): a, c, t, g, unknown or other
  misc_feature (308)..(308): n is a, c, g, or t
tcagtcgatcacgtcacgaccggtgctcgatttagtatagacatcaacacacaaaggggggggtctcaggaggcagcgctctcaggacatctccaccatggcctgggctctgctgctcctcacctcctcactcagggcacagggtcctgggcccagtctgccctgactcagcctgcctccgtgtctggtctcctggacagtggatcaccatctcctgcactggaaccagcagtgacgttggtggttatgactatgtctcctggtaccaacaaccaccccgaccaaacgcccccaaactcatgatttangagtcaagtatccggcccgttcggggtttctaagttccggttctcgtggctaccaagtcgtcggacaacgacgccctacccgtgaccctatcctcgtcggtcctccgacgtctacggaggaacggaggtctagtatttacttactcgacgtacgccttacattaactacctagtacagtcctaataccgtacggtttggggttcggtttaccgggggaccgggggtaaccgaacggtccggtcggtaacccggttaccgtacgggtcctaaccggtccccgaaggtcccgtacccgtcccccgtaccgg

SEQ ID NO: 203387 - DNA, 731 bp, Homo sapiens
  misc_feature: GYAE6OF02I3RO4.38.32.C10.1.454.CMB.1.raw
  modified_base (306)..(306): a, c, t, g, unknown or other
  misc_feature (306)..(306): n is a, c, g, or t
tcagtcgatcacgtcacgaccggtgctcgatttagtatagacatcaacacacaaaggggggggtctcaggaggcagcgctctcaggacatctccaccatggcctgggctctgctgctcctcaccctcctcactcagggcacagggtcctgggcccagtctgccctgactcagcctgcctcgtgtctgggtctcctggacagtggatcaccatctcctgcactggaaccagcagtgacgttggtggttatgactatgtctcctggtaccaacaacaccccgaccaaacgcccccaatcatgatttangagtcagtaactccggcccgttcggggttctaatcggttctcgtcggcccaagtctgacacacgcctccgtgaccatcctacgtcgggtcctccgacgtccgtaggacgggaccggtaggtccgtaggttaacgtttaacgtttaccgttacggtaccaaacgggtcccttaaccgtaaagttaaccgttaaaccgtacggtacccgtaacgtaccttaacgttaccggttaacccggttttcggggggttaaccggtttacccggggggtaccgggggggtaaaccccgtaaacgggtaccccggttaaccgggttaaccccgggttacccggtttaacggggtaccccgtaaccgggtacccccggtaaaccggggtccccgtttacccccgggtacccccccggttccgggttaacccccgg

SEQ ID NO: 203388 - DNA, 631 bp, Homo sapiens
  misc_feature: GYAE6OF02GBVOV.38.32.C10.1.454.CMB.1.raw
  modified_base (216)..(216): a, c, t, g, unknown or other
  misc_feature (216)..(216): n is a, c, g, or t
  modified_base (226)..(226): a, c, t, g, unknown or other
  misc_feature (226)..(226): n is a, c, g, or t
  modified_base (246)..(246): a, c, t, g, unknown or other
  misc_feature (246)..(246): n is a, c, g, or t
  modified_base (296)..(296): a, c, t, g, unknown or other
  misc_feature (296)..(296): n is a, c, g, or t
tcagtcgatcacgtcacgaccggtgctcgatttagtatagacatcaacacacaaaggggggggtctcaggaggcagcgctctcaggacatctccaccatggcctgggctctgctgctcctcaccctcctcactcagggcacagggtcctgggcccagtctgccctgactcagcctgcctcgtgtctgggtcctctggacagtgatcaccatctccngcactgaccngcagtcgacgttggtgttangatatgtctctgtacaacaccacccaccaacgccccaatcatatatttangagtcaagtaacgtccggtcccgttcggggtttactacgttcggttctcgtcggtcctacgtacgtcaggaccaacgccgccttcccgacgacctcgtccgtcgtcggcctacgcgtccgtggacggacgtacgggtcttggttaatttacgttacgcgtacgtacgtctacttattacgtacgtacgacgtagacctacgttacgtcggtttcggggttacggtccggggggaaccgggtaaccgtaaggttcccgaccgggtacccgtttaccggtacgggtacccgccggaacccggtacggtccccggttaccccggccccggtttcccgg

SEQ ID NO: 203389 - DNA, 652 bp, Homo sapiens
  misc_feature: GYAE6OF02IYT16.38.32.C10.1.454.CMB.1.raw
  modified_base (208)..(208): a, c, t, g, unknown or other
  misc_feature (208)..(208): n is a, c, g, or t
  modified_base (214)..(214): a, c, t, g, unknown or other
  misc_feature (214)..(214): n is a, c, g, or t
  modified_base (225)..(225): a, c, t, g, unknown or other
  misc_feature (225)..(225): n is a, c, g, or t
  modified_base (534)..(534): a, c, t, g, unknown or other
  misc_feature (534)..(534): n is a, c, g, or t
  modified_base (543)..(543): a, c, t, g, unknown or other
  misc_feature (543)..(543): n is a, c, g, or t
tcagtcgatcacgtcacgaccggtgctcgatttagtatagacatcaacacacaaaggggggggtctcaggaggcagcgctctcaggacatctccaccatggcctgggctctgctgctcctcaccctcctcactcaggcacagggtcctgggcccagtctgccctgactcagcctgcctcgtgtctgggtctccgtgacagtgatcacntctctncactcggaccngcagtgtacgttggtgttatgactatgtctccgtaggtaccaacaaccaccccgtaccaaacccgtacccccaaactcactagtaatttagtcgacggtactagtaacgtccggtcccgttcggggtttactaacgttccggttctcgtcggtctaccgtaacgttcggtacgaccgaactaccggtccctacccgtagtaccctacgttccgtcgtaccggtctcccgtacgtcgtacgggacggtacgacgggttactacgttacgtttactacgtcgtaccgatcctcgttaaatccgttaacgtncgactactntccgtaggtttcggtcgggtaccggggaccgggtaacgtaacggtaccacgggttacccgtacgttacggacgtccgtaaccggacgtacccgcccgtcccgttaccgg

SEQ ID NO: 203390 - DNA, 661 bp, Homo sapiens
  misc_feature: GYAE6OF02I7ZSW.38.32.C10.1.454.CMB.1.raw
  modified_base (333)..(333): a, c, t, g, unknown or other
  misc_feature (333)..(333): n is a, c, g, or t
  modified_base (427)..(427): a, c, t, g, unknown or other
  misc_feature (427)..(427): n is a, c, g, or t
tcagtcgatcacgtcacgaccggtgctcgatttagtatagacatcaacacacaaaggggggggtctcaggaggcagcgctctcaggacatctccaccatggcctgggctctgctgctcctcaccctcctcactcagggcacagggtcctgggcccagtctcgccctgactcagcctgcctccgtgtctgggtctcctggacagtggactcaccatcctcctgacactcggaaccagcgagtcgacggttggtggttatgacttagtcgtctccgtaggtaaccaacaaccgaccccgaccaaaccgccccccaaactcgactacgtatttacngtacgtacgagtaagtccggtcccggttacggggttctaacgtcgttctcgtcgtcctactagtcgtgcaacgccgtcctcctcgaccagttcncgtcggtcctcgacgtccgtaggacggtcggacgcgttgtaactttattcgtcggtcaggtaccttcaattacgtactacacgtacgacttacgtaccgtacggtttcgggttacgggttaccggggaccgggggtaaccgtacgggttaccggtaccggtacccggtccggttaaccggtaccggtaaccgtcccgggtaacggtccccggttcccggtcccccggttaccgg

SEQ ID NO: 203391 - DNA, 795 bp, Homo sapiens
  misc_feature: GYAE6OF02I7N0R.38.32.C10.1.454.CMB.1.raw
  modified_base (265)..(265): a, c, t, g, unknown or other
  misc_feature (265)..(265): n is a, c, g, or t
tcagtcgatcacgtcacgaccggtgctcgatttagtatagacatcaacacacaaaggggggggtctcaggaggcagcgctctcaggacatctccacatggcctgggctctgctgctcctcaccctcctcactcagggcacgagggtcctgggcccagtctcgccctgacctcagcctcgcctccgtgtcgtgggtcctcctggacagtggatcaccatcctcctcgcaccgtaggaacccagcgagtgtacggttggtaggttangtactagtcgttcctccgtacggtaaccaaccaacccacccccgaacccaaacccgaccccctaaactcactagtactttagtggagtactaagttaccgtccggtcccggtttacggggtttactaacgttcggttcctcggtcgtacccttacgaacgttcgtacggtaccaaacccggtaccggtaccccttcccgtacgacccgtacgttcccttccggtcggtccctaccgtaccggaccggtcgggaacgggtaacccggagggtaccttagttaacgtttaaccgttagtccgtaccgtaccgtaccttaacgtaaacttacggttaacaccgggaacctacgtaccttaaagttcccggtttacggggtttacgggttccgggggttacccggggggaacggggtaacccccgttgggtaccccgtttaaaccggttacccggttaccggttaaccggtacccgtacccggtacccggtaaccgggttcccccgttacccccggttaccccggtttaacccg

SEQ ID NO: 203392 - DNA, 697 bp, Homo sapiens
  misc_feature: GYAE6OF02H4XCT.38.32.C10.1.454.CMB.1.raw
  modified_base (216)..(216): a, c, t, g, unknown or other
  misc_feature (216)..(216): n is a, c, g, or t
  modified_base (239)..(239): a, c, t, g, unknown or other
  misc_feature (239)..(239): n is a, c, g, or t
  modified_base (346)..(346): a, c, t, g, unknown or other
  misc_feature (346)..(346): n is a, c, g, or t
  modified_base (456)..(456): a, c, t, g, unknown or other
  misc_feature (456)..(456): n is a, c, g, or t
tcagtcgatcacgtcacgaccggtgctcgatttagtatagacatcaacacacaaaggggggggtctcaggaggcagcgctctcaggacatctccaccatggcctgggctctgctgctcctcaccctctcactcagggcacagggtcctgggcccagtctgccctgacctcagcctgcctccgtgtctgggtctccgtggacctagtgactcaaccnttcctcctgccacgtcggaaccngctagtcggtacgttggttggttatgtacttagtcgtcctccgttaggtaacccaacaacccaccccgacctaaacccgaccccctaaactctatacgtattttacncggtacgtactaagtaacgtccggtcccgttcggggtttactaggttccgttacgtcgtggtcctactaacgtcgtacgctaacgccggtaccctcccgtacgaaccctntccgtcgtaccggccttccgacgtccgtaggacggtcggacgtacgttacgttactttacttacgcgttacgacgtctactactaacgttacgacgtacctagtactacgtcgttaacgggttcgggttacgttaccggggggaccgggtaacctaacgggtcccttacggggtaacccctaccgtaccggtacggtacccgtaccggtaaccgggtcccttccccggtaccccgttcggg

SEQ ID NO: 203393 - DNA, 710 bp, Homo sapiens
  misc_feature: GYAE6OF02IOA3J.38.32.C10.1.454.CMB.1.raw
  modified_base (567)..(567): a, c, t, g, unknown or other
  misc_feature (567)..(567): n is a, c, g, or t
tcagtcgatcacgtcacgaccggtgctcgatttagtatagacatcaacacacaaagggggggggtctcaggaggcagcgctctcaggacatctccaccatggcctgggctctgctgctcctcaccctcctcactcagggcacagggtcctgggcccagtctcgccctgactcagcctgcctcgtgtcgtgggtcctccgtaggacaggtgactccacctattcctcctagccacgtacgggaacccagcgtaggtcggtacggtttggttggttatagtacttattcgtccttccgtaggtaacccaaaccgaacccacccccgaaccaaacccgtaccccccaaactccaacgtacgtaattttacgacggtaacggtactaaacggttaacgtcccgggtacccgggtttacggggtttactacggttccggtttcctcgttcggtccttacgtaacgttcggtcggacctaaccgccgtaccctcccgtacgacctacgtccgtcggtcggtcctccgacgtccgtaggacgggacgacggttcgtagttaactttactcgtanacgacgtctactattactacgtagcgactctacttcgttacgggttcggttacgggtccggggacgggtaccgacggtccggtacggtacccggtcgtacggtccgaccgtaccggaccggtccctacccgtcccgttaccgg

SEQ ID NO: 203394 - DNA, 700 bp, Homo sapiens
  misc_feature: GYAE6OF02FRC9F.38.32.C10.1.454.CMB.1.raw
  modified_base (234)..(234): a, c, t, g, unknown or other
  misc_feature (234)..(234): n is a, c, g, or t
  modified_base (295)..(295): a, c, t, g, unknown or other
  misc_feature (295)..(295): n is a, c, g, or t
tcagtcgatcacgtcacgaccggtgctcgatttagtatagacatcaacacacaaaaggggggggtctcaggaggcagcgctctcaggacatctccaccatggcctgggctctgctgctcctcaccctcctcactcagggcacagggtcctgggcccagtctgccctgactcagcctgcctccgtgtctgggtcctctggacaggtggatcaccatctcctgccactggaacccngacagtggtacgttggtggttatgtacttatgtcctaccgtggtaaccaacacccaccccnccaaacgcccccaaactcattagtatttagtgacgtgagtaagttccggccgtttcggggttactaagtccggtttctcgtggtcctacgtacgtcgtcggacctaaccgtacccggcccttcccgtacgtaaccctagttcccttacggtccgggtcctacccgaaccggtccgttcggaacgggtacggtagggtccgttagttaacgtttactttacgttccgacgtacgtccttactaataacttacggtactactaggacctaacgtcggttacggtttacgggttacggggttacccgggggaccgggggtaaccggaacggtaccgtacggtaacccggttcggtaacggttaccgaacggaccccggtaaggcccgtacccgttccccgtacccggg

SEQ ID NO: 203395 - DNA, 806 bp, Homo sapiens
  misc_feature: GYAE6OF02JIPST.38.32.C10.1.454.CMB.1.raw
tcagtcgatcacgtcacgaccggtgctcgatttagtatagacatcaacacacaaaggggggggtctcaggaggcagcgctctcaggacatctccaccatggcctgggctctgctgctcctcaccctcctcactcagggcacagggtcctgggcccagtctcgccctgactcagcctgcctccgtgtcgtggtctctggacagtggatcacatctctgcactggaaccagcagtgacgttggtgttatgactatgtctcgtcggtaccaacaccaccccgaccaaacgaccccaactccgatagtatttatggtaacgtacgtaagttaagtaccgggtccccggtttacggggttacttaacgttcggttcctcgtacggtccgtaccgtaagttccgttacggaccgaaaccgtaccccgggtcccttacccgtaccgtaacccgtacgttacccggtccgttcggggtaccccgttacccgaccgggttaccccggtagggtaacggggtaacccggtacgggttaaccgttaggttaaaccggtttttaactttaacccgggttataccgtaaacccggtccttaaccttaaacggttaaccttaaccggttaccgaaccgtacgtaacccgtaacggtttaccgtaacgggtttccggggttacggggttaccgggggacccggggggtaaccgaaacgggttccgtaaccgggttaccccggtaccgggtttaacggtacccgtaacgggtacccccggtaaacggtccccggtacccggttacccccccgttaaccgggg

SEQ ID NO: 203396 - DNA, 697 bp, Homo sapiens
  misc_feature: GYAE6OF02GCZZ2.38.32.C10.1.454.CMB.1.raw
  modified_base (130)..(130): a, c, t, g, unknown or other
  misc_feature (130)..(130): n is a, c, g, or t
  modified_base (209)..(209): a, c, t, g, unknown or other
  misc_feature (209)..(209): n is a, c, g, or t
  modified_base (227)..(227): a, c, t, g, unknown or other
  misc_feature (227)..(227): n is a, c, g, or t
tcagtcgatcacgtcacgaccggtgctcgatttagtatagacatcaacacacaaaggggggggtctcaggaggcagcgctctcaggacatctccaccatggcctgggctctgctgctcctcaccctcctnactcagggcacagggtcctgggcccagtctcgccctgactcagcctgcctcgtgtctgggtctctggacagtgatcacntctcctgcagtggaaccngcagtgacgttggtgttatgactatgtctcgtcgtaccaacaccacccgaccaaccgacccccaaactcatgtatttagtgagtctaagtacgtccggtcccgttcggggtttactacgttcgttctcgtcggccctagtcgtcgacgaacgccgtccctcccgtacgaccctattcctcgtcggtcctccgacgtccgtaggacggacggacggtaccgttagtactttaacgttaccgttcgtaccgtacgtacgtaactaacgttaacttaccgtaagtaccgacgtacttaaccgttacgttaccgggtttaggggttccggggtttaccgggggtaccggggggtaacctaaccgggtccggttaacccggtaccccgggtttacggtaacccgggttaccgtacccggaacccggttaacgggtccccccggttccggttcccccccggtacggtttaaccccg

SEQ ID NO: 203397 - DNA, 674 bp, Homo sapiens
  misc_feature: GYAE6OF02JJIEI.38.32.C10.1.454.CMB.1.raw
  modified_base (211)..(211): a, c, t, g, unknown or other
  misc_feature (211)..(211): n is a, c, g, or t
  modified_base (229)..(229): a, c, t, g, unknown or other
  misc_feature (229)..(229): n is a, c, g, or t
tcagtcgatcacgtcacgaccggtgctcgatttagtatagacatcaacacacaaaggggggggtctcaggaggcagcgctctcaggacatctccaccatggcctgggctctgctgctcctcaccctctcactcagggcacagggtcctgggcccagtctgccctgactcagcctgcctcgtgtctgggtctccgtggacagtggatcaccntcctctgcactggaaccngcagtgacgttggtgttatgactagtcgtcctcgtcgtaaccaacaccaccccgacaaaccgaccccaactcatgtatttagtgagtacagttaacgtccggtaccgttcggggttactagttcggttctcgtcgctactaagtcgtacggacaacgaccggtcctcccgtacgacccgtacttccgtcgtacgggtccctaccgtacggtcccgtacggtaacgggacggtacggtccgttacggttaactttacgtaccgtagtacctacggtccttaacgaacgtttaacacgttagtaccgtaacgtacttacgtacgttaaccgggtttggggttccgggttaccggggaacggggtacctaacggtaccgtacgggttacccgttacggtacgtacgaccggtaccgtaaccggtccgttacccggtccccgttaccgg

SEQ ID NO: 203398 - DNA, 651 bp, Homo sapiens
  misc_feature: GYAE6OF02IWBIQ.38.32.C10.1.454.CMB.1.raw
  modified_base (201)..(201): a, c, t, g, unknown or other
  misc_feature (201)..(201): n is a, c, g, or t
  modified_base (319)..(319): a, c, t, g, unknown or other
  misc_feature (319)..(319): n is a, c, g, or t
  modified_base (467)..(467): a, c, t, g, unknown or other
  misc_feature (467)..(467): n is a, c, g, or t
tcagtcgatcacgtcacgaccggtgctcgatttagtatagacatcaacacacaaaggggggggtctcaggaggcagcgctctcaggacatctccaccatggcctgggctctgctgctcctcaccctcctcactcgagggcacgagggtcctgggcccagtctcgccctgactcagcctgcctcgtgtctggtctcgtgacngtgatcaccatctcctgcactcggaaccagcagtcgtacggttggtaggttatgactatcgtctccgtacgtaaccaaccaccaccccgaccaaaccgaccccaactcatgtatttangacgtcaagtacgtccggtaccggtttcggggttactacgttcggttcctcgtccggtacccagtccgacgtaccaaccgtaccggccccttaccgacgtaccgtactcgttccgtggcccttaccgacggtccgtaggacgtacggngtactagtaccttactacgtcgataccgtcgtactaagtaacgttacgtagaccacggtactacgttacgtacggtttcggggtacgggttacccggggacggggtaccacgggtcgtacccggaccgttccgtacggtacccgacgaccggtacggtccctacccggtaccccggtctacccg

SEQ ID NO: 203399 - DNA, 598 bp, Homo sapiens
  misc_feature: GYAE6OF02HLP5X.38.32.C10.1.454.CMB.1.raw
tcagtcgatcacgtcacgaccggtgctcgatttagtatagacatcaacacacaaaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtggatcaccatctcctgcactggaaccagcagtgacgttggtggttatgactatgtctcctggtaccaacaacaccccgcaaacgcccccaaactcatgatttatgaggtcagtaatccggccctcggggtttctaagtcggttctcgtggctccaagtctggacaacacggcctaccctgacctagtctacgtcgggtctaccgagcctagacggacgaggctaggtaatttacgttactcgactagtcctacaacttaattaacctagactacgtctaagttcctaacgtttgggtcggttcggggtaccgggggaccgtaaggtccgtacggtaaccgttcccgtaagggtccaacggtcccgaacgggtccctcggtccccccgttaccggg

SEQ ID NO: 203400 - DNA, 842 bp, Homo sapiens
  misc_feature: GYAE6OF02GJ2GC.38.32.C10.1.454.CMB.1.raw
  modified_base (185)..(185): a, c, t, g, unknown or other
  misc_feature (185)..(185): n is a, c, g, or t
tcagtcgatcacgtcacgaccggtgctcgatttagtatagacatcaacacacaaaggggggggtctcaggaggcagcgctctcaggacatctccaccatggcctgggctctgctgctcctcaccctcctcactcagggcacagggtcctgggcccagtctcgccctgactcacgcctgcctcgtntcgtggtctcgtgactagtgactcacctatctcctgacacgtcggaaccagccgagttcgtacgttgggttggttaatgactattcgttcctccgtacggtaaccaaacctaacccaccccgtaccaaacccgaccccctaaacgtcacgttacggttaatttagtggtaacggttacgtaacgttaacggtcccggggttaccccggttttaccgggggttttacttaaacggttcccggttttaccgttcggtacggtcccttaccgtaacggttccgttacgggacccgtaaaccgtaccccgggtccccttcccgtaccgtaaccctacgtttacccgtccggtccgggtacccgttccccgtaacggttcccgtaaggggaaccggggtaccggaacgggtctttaacggttaacgttttaacctttaacgtccgacgtacgtacctacgttaaactttaacgtacgttaaccgggactacgtttaacctaaacggtttccgttaccgggttttcgggggttccgggttacccgggggggtaaccggggtacctaaccgggttccggttaacccgggtacccgttacgggttaaccggtacgtacccgggaaccccggtaccggtcccggttccccgtaccccgtttccggg

SEQ ID NO: 203401 - DNA, 729 bp, Homo sapiens
  misc_feature: GYAE6OF02GZC2R.38.32.C10.1.454.CMB.1.raw
  modified_base (162)..(162): a, c, t, g, unknown or other
  misc_feature (162)..(162): n is a, c, g, or t
  modified_base (219)..(219): a, c, t, g, unknown or other
  misc_feature (219)..(219): n is a, c, g, or t
  modified_base (241)..(241): a, c, t, g, unknown or other
  misc_feature (241)..(241): n is a, c, g, or t
tcagtcgatcacgtcacgaccggtgctcgatttagtatagacatcaacacacaaagggggggtctcgaggaggcagcgctctcaggacatctccaccatggccgtgggctctgctgctcctcaccctcctcacctcgagggcacagggtcctggcccagtcncgccctgactcagcctgcctcgtgtcgtgggtctccgtaggactagtggatccactnttctctagccagtacggaaccngcaggtcgtacggttggtggttatgacttagtcgttacctcgtacggttaacccaacaacccgaccccgaacctaaaccgaaccccctaaactctaacgtactaagtttaatacggtaagtacctaaggttaacgtcccggtccccggtttacgggtttaaccgtaaggtttcccggtttacgttccgtcgtacccgttaaccgtaagtttcccgtaggaaccaacccggtaccggtccctccgacgtacctactccgttacgtcggtccgtacctaccgtcgtacggtacggacggtacggtcgtacggttaactttagtactaagtccgaagtctactaacgtacttacgtacgacacgtacgtacttacggtacgtttacgggtcgggttaccgggcggggtaaccggtacggtaccggtacggtaccggttaaccgttaccggtacggaccgaccggaaccggtcgtcccgtccccggttaccg

SEQ ID NO: 203402 - DNA, 730 bp, Homo sapiens
  misc_feature: GYAE6OF02JA6KA.38.32.C10.1.454.CMB.1.raw
  modified_base (143)..(143): a, c, t, g, unknown or other
  misc_feature (143)..(143): n is a, c, g, or t
  modified_base (219)..(219): a, c, t, g, unknown or other
  misc_feature (219)..(219): n is a, c, g, or t
  modified_base (225)..(225): a, c, t, g, unknown or other
  misc_feature (225)..(225): n is a, c, g, or t
  modified_base (238)..(238): a, c, t, g, unknown or other
  misc_feature (238)..(238): n is a, c, g, or t
  modified_base (267)..(267): a, c, t, g, unknown or other
  misc_feature (267)..(267): n is a, c, g, or t
tcagtcgatcacgtcacgaccggtgctcgatttagtatagacatcaacacacaaaggggggggtctcaggaggcagcgctctcaggacatctccaccatggcctgggctctgctgctcctcaccctcctcactcagggtccanagggtcctcgggcccagtctcgccctgactcacgtcctgccttcgtgtctgggtctccgtagactgtgactcaccntctccngctacgtcgaccngcagtcggtacgttggtcgtatgtacgtnttctctcgtacgtaccaactaaccacccaccgtaacccgacccctaacacctagtacggttaactttacggtagtacggtaactaacggttaacggtcccggttacccgggtttaccgggtttacgtaacgttccggttcctcgttcggtccttacgtaacgttcgtacggaccgtaacgcccgtcctacccggtcctactacgtttccgccggttaacgggtccttaccgacggttacccgtaagggtaccgggtaacgtaccgggttcgtaaggtttacttacgttactacgcgttacgtactaactacgtactacgtcggaactcgtacgtaacgtccggtttaaggcgggttcggggtaccggggcggtaacccggtaagtcccggttaacgggccgttaaccgttaggtacccgaaccggttaccggaccggtacccgttcccggaccccgtttacgg

SEQ ID NO: 203403 - DNA, 635 bp, Homo sapiens
  misc_feature: GYAE6OF02FQ6H4.38.32.C10.1.454.CMB.1.raw
  modified_base (228)..(228): a, c, t, g, unknown or other
  misc_feature (228)..(228): n is a, c, g, or t
  modified_base (380)..(380): a, c, t, g, unknown or other
  misc_feature (380)..(380): n is a, c, g, or t
  modified_base (385)..(385): a, c, t, g, unknown or other
  misc_feature (385)..(385): n is a, c, g, or t
tcagtcgatcacgtcacgaccggtgctcgatttagtatagacatcaacacacaaaggggggggtctcaggaggcagcgctctcaggacatctccaccatggcctgggctctgctgctcctcaccctcctcactcagggcacagggtcctgggcccagtctgccctgactcagcctgcctccgtgtctggtctcctggacagtgatcaccatctcctgcactggaaccngcagtgacgttggtgtatgactatgtctcgtgtaccaacaccaccccgacaaaccgcccccaaatcatgtatttatggagtcagtaacgtccggtccggttcggggttactaacgtcggttctcgtgcctcagtctgcacgaccgcctccgngaccntcgtcgtggcctccgacgccgtaggtacggacggacggtctagttaactttacgttaacgtcgacgtacgtcctataccgttaatacgtaacgcaacgactataccgttaacggtttcggggttccgggtttaccggggggaccggggtaaccgtaacgggtccgttacccgggtacccggttaccggtacggtacccggtaccggaaccccggtacgggtacccgttccccggtaccccccggttccgg

SEQ ID NO: 203404 - DNA, 875 bp, Homo sapiens
  misc_feature: GYAE6OF02J1MQO.38.32.C10.1.454.CMB.1.raw
  modified_base (153)..(153): a, c, t, g, unknown or other
  misc_feature (153)..(153): n is a, c, g, or t
  modified_base (257)..(257): a, c, t, g, unknown or other
  misc_feature (257)..(257): n is a, c, g, or t
  modified_base (688)..(688): a, c, t, g, unknown or other
  misc_feature (688)..(688): n is a, c, g, or t
tcagtcgatcacgtcacgaccggtgctcgatttagtatagacatcaacacacaaagggggggggtctcgaggaggcagcgctcctcaggacatctccaccatggcctgggctctgctgctcctcaccctctcactcgaggcacgtacgggtcncgggacccagtcgtcgccctgacctacgacgtcctcgtacccgtccggtagtccggttcgggtcctaccgtacggtacgtagggtacggacttacccaaccgtnttcccgtcctagtacctacggtacgggaccaggtaccgtaggttaccggttacggtttcggtttaggtacgttaggtaacgttcgttcggttaccgtacccgttacgggtaaacctaaacccgaacccccggaccccggtaaaccccgaaaacccgtacccccgtaaactaccggtatccggtttaaattccggtaggtacggtaaccttaaggtaaccgggtacccgggttccgggggttaacggtttaaccgtaccgttcccggtcttaccggggtacgtacccacggttacggtaccgtaccgggaaccctaaccgtaaccccgggttcctaccggtaaccgtaaccgttccggttaccgtcgggtacccggttccgtaacccggtaccggttacggtaacgggtacggtaaccggtacgtaccggtntttaaaccgtacgtttaccggtaccgagttaccgtccgttaaacgttcgtaaccttacgacgtaccgtaacacgttacgttaccgtacgggttcggtaccgggaccggttacggaccgtaacggtcggtaaccgtcgtaccgtacgaccggttaccgacggttccgacggttccccgtaccgtaccg

SEQ ID NO: 203405 - DNA, 756 bp, Homo sapiens
  misc_feature: GYAE6OF02I6K9F.38.32.C10.1.454.CMB.1.raw
tcagtcgatcacgtcacgaccggtgctcgatttagtatagacatcaacacacaaagggggggggtctcaggaggcagcgctctcaggacatctccaccatggcctgggctctgctgctcctcaccctcctcactcagggcacagggtcctgggcccagtctgccctgactcagcctgcctcgtgtcgtcgggtctccgtggacagtggatcacctactcctcctgcacgtacggaaccagcagtggtacgtttgggtggttatacgtactattcgttcctccgtacggtaacccaaaccgaacccaaccccgacccaaacccgacccccaaactacatagtactttagaggtacgtactaagttaacggttccgggtcccgggtttacggggtttaccttaacggtttccggttccgttcgtcggtcccttaccgtaacgttcgtacggacctaacccgtaccggtccctacccgtcgtaccctacgtccgtacgtacggtccctaccgtcgtaccgtacggacggtacggacggtcttaaggtaactttacgttacgtcgtacgtacgtccgttactaacgttaaccttacgtaccgtagtacgtactacgttcgttacggggttcgggttccggggttaccgggggacccggggtaacggtaacccggtccgtaccggggtacccgttaccggtaccgggtaccgtacccggtacccggtaaccggtcccgtaccccggttccccgtacccggg

SEQ ID NO: 203406 - DNA, 687 bp, Homo sapiens
  misc_feature: GYAE6OF02IMFGT.38.32.C10.1.454.CMB.1.raw
  modified_base (200)..(200): a, c, t, g, unknown or other
  misc_feature (200)..(200): n is a, c, g, or t
  modified_base (257)..(257): a, c, t, g, unknown or other
  misc_feature (257)..(257): n is a, c, g, or t
tcagtcgatcacgtcacgaccggtgctcgatttagtatagacatcaacacacaaaggggggggtctcaggaggcagcgctctcaggacatctccaccatggcctgggctctgctgctcctcaccctcctcactcgagggcacgagggtcctgggcccagtctcgccctgactcagcctgcctcgtgtcgtgggtctccgnggacagtggatcactatcctctgcacgtcggaaccagcagtcgacgttggtggttangactatcgtcctcgtacgtaaccaacaaccaccccgaaccaaccgacccccaaactctatgtaatttagtaggtagtacgaagttaacgtccggtaccggttacggggtttactaacggttccgttacgtcgtcgtacctaccgtagtacgtacggacctaaccgtcccggtaccctccgtaccgacctacgtcgtacggtcggcctccgacgtccgtaggacgacgggtactgttagttaacttacgttacgcgtacgtacgtactacgtaattacgtacgtacgcagtacttacgtcggtaacgggtttgggttaccgggttaccgggggaccgggttaaccgaggttaccggaccggttaacccgttaccggtacggtaccgtaccggaacccggtacggtcccgttaccccggtccccgttaccgg

SEQ ID NO: 203407 - DNA, 683 bp, Homo sapiens
  misc_feature: GYAE6OF02GXVFL.38.32.C10.1.454.CMB.1.raw
  modified_base (238)..(238): a, c, t, g, unknown or other
  misc_feature (238)..(238): n is a, c, g, or t
tcagtcgatcacgtcacgaccggtgctcgatttagtatagacatcaacacacaaaggggggggtctcaggaggcagcgctctcaggacatctccacatggcctgggctctgctgctcctccaccctcctcactcagggcacagggtcctgggcccagtctcgccctgactcgagcctgccctccgtgtcgtgggtcctcgtggacaggtgactcactatctcctgcacgtcggaaccngactaggtacgttacggttggttgttagacgtatcgtcgtctccgtacgtaacaaccacccacccgaaccaacccgaccctaatcacttagtattacgacgtacgtacgtaacgtaccgtccggttccggttacgggttacttacgtcgttcgtacgtcgaccgttaccgtagtccgtacgaaccgtaccgtacccgtcccttaccgtacgtaccttcgttccgtcggtaccggtcctcgtacgtacggtacggtaccgggtacggacggtacgttagttacttacgttacgtacgtacgtacgtacttactacgtaacgttacgtaacgacgtacgtacgtcgtacgttcggttacgggtacgggtacggggacggtaccggcgtaccgaccggtaccgtacgtccgtacgaccggaccgaccggtccgtacccgttcccgtcg

SEQ ID NO: 203408 - DNA, 651 bp, Homo sapiens
  misc_feature: GYAE6OF02HVWLE.38.32.C10.1.454.CMB.1.raw
  modified_base (201)..(201): a, c, t, g, unknown or other
  misc_feature (201)..(201): n is a, c, g, or t
  modified_base (255)..(255): a, c, t, g, unknown or other
  misc_feature (255)..(255): n is a, c, g, or t
  modified_base (318)..(318): a, c, t, g, unknown or other
  misc_feature (318)..(318): n is a, c, g, or t
  modified_base (484)..(484): a, c, t, g, unknown or other
  misc_feature (484)..(484): n is a, c, g, or t
tcagtcgatcacgtcacgaccggtgctcgatttagtatagacatcaacacacaaagggggggggtctcaggaggcagcgctctcaggacatctccaccatggcctgggctctgctgctcctcaccctcctcactcaggcacagggtcctgggcccagtctgccctgactcagcctgcctcgtgtctgggtctccgtggacnggtggatcacatcctctgcacgtcggaaccagcagtgacgttggtgttatgatntcgtctccgtacggtaccaacaaccaccccgaccaaaccgcccccaaatcatagtactttagnggtagtcaagttacgccggtccggttcgggttactaagttcgttctcgtcgtctacaagtcgtagacaacgccggccctacctgtaccctatcgtcgtcgggtcctaccgcgtccgagggacgacggaagtcgtagtaactttatacgtcgacgtacgtccttaanacgttacgttaaacgtacggtacacggtaaccttcggtaccgtaacgggttttccggggtgggttacccggggggtaaccgggttaaccacgggttaccggtaccggtacccggttacgtacgtacggacccgtaccgacgggtcccgtacccgtcccggtaaccgg

SEQ ID NO: 203409 - DNA, 154 bp, Homo sapiens
  misc_feature: GYAE6OF01A6SA5.13.79.H02.1.454.CMB.1.raw
  modified_base (153)..(154): a, c, t, g, unknown or other
  misc_feature (153)..(154): n is a, c, g, or t
tcagtcacgtactacacgaccggtgctcgatttagtgtcacacgaagggaaagggacacgactggagattaaacgaactgtggctgcaccatctgtcttcatcttcccgccatctgatagtacgtgactgagcgggctggcaaggcgcatagnn

SEQ ID NO: 203410 - DNA, 153 bp, Homo sapiens
  misc_feature: GYAE6OF02F8E65.13.79.H02.1.454.CMB.1.raw
  modified_base (153)..(153): a, c, t, g, unknown or other
  misc_feature (153)..(153): n is a, c, g, or t
tcagtcacgtactacacgaccggtgctcgatttagtgtcacacgaagggaaagggacacgactggagattaaacgaactgtggctgcaccatctgtcttcatcttcccgccatctgatagtacgtgactgagcgggctggcaaggcgcatagn

SEQ ID NO: 203411 - DNA, 508 bp, Homo sapiens
  misc_feature: GYAE6OF01C8ZJZ.36.4.A04.1.454.CMB.1.raw
  modified_base (197)..(197): a, c, t, g, unknown or other
  misc_feature (197)..(197): n is a, c, g, or t
  modified_base (368)..(368): a, c, t, g, unknown or other
  misc_feature (368)..(368): n is a, c, g, or t
  modified_base (388)..(388): a, c, t, g, unknown or other
  misc_feature (388)..(388): n is a, c, g, or t
tcagtacgctgtctcacgaccggtgctcgatttagagtagtgatcagggggaggaactgctcagttaggacccagagggaaccatggaagccccagctcagcttctcttcctcctgctactctggctcccagatactaccggagaaattgtgttgacacagtctccagccaccctgtctttgtctccagggtaaagngccaccctctcctgcagggccagtcagagtgttagcagctacttagcctggtaccaacagaaacctggccaggcctcccaggctcctcatctatgatacatcctacagggccactggcatcccagcccaggttcagtggcaggtgggtctgggacagacttcactctcacntcagcagctagacctgaatntttgctagtttattactgtcagcagcgagaggtctttcgggcctagggacctaaaggtgatatacaaacgtactggtgctgctacattctgtcttcacttccttcccgctactctgaacg

SEQ ID NO: 203412 - DNA, 500 bp, Homo sapiens
  misc_feature: GYAE6OF01AULBT.36.4.A04.1.454.CMB.1.raw
  modified_base (196)..(196): a, c, t, g, unknown or other
  misc_feature (196)..(196): n is a, c, g, or t
  modified_base (417)..(417): a, c, t, g, unknown or other
  misc_feature (417)..(417): n is a, c, g, or t
tcagtacgctgtctcacgaccggtgctcgatttagagtagtgatcagggggaggaactgctcagttaggacccagagggaaccatggaagccccagctcagcttctcttcctcctgctactctggctcccagatactaccggagaaattgtgttgacacagtctccagccaccctgtctttgtctccaggggaaangccaccctctcctgcagggccagtcagagtgttagcagctacttagcctggtaccaacagaaacctggccaggcctcccaggctcctcatctatgatacatcctacagggccacgtggcactcccagccaggttcagtggcagtggtctgggacagacttcactctcacatcagcagcctagacctgaagtatttgctagtttatactgtcagcagcgagngtcgttcggcctagggaccaagtgatatacgaacgactgtgctgacactatctgtctcacttccttcccgacactcgtgaacg

SEQ ID NO: 203413 - DNA, 505 bp, Homo sapiens
  misc_feature: GYAE6OF01CPTY0.36.4.A04.1.454.CMB.1.raw
  modified_base (196)..(196): a, c, t, g, unknown or other
  misc_feature (196)..(196): n is a, c, g, or t
  modified_base (205)..(205): a, c, t, g, unknown or other
  misc_feature (205)..(205): n is a, c, g, or t
  modified_base (284)..(284): a, c, t, g, unknown or other
  misc_feature (284)..(284): n is a, c, g, or t
  modified_base (479)..(479): a, c, t, g, unknown or other
  misc_feature (479)..(479): n is a, c, g, or t
  modified_base (483)..(483): a, c, t, g, unknown or other
  misc_feature (483)..(483): n is a, c, g, or t
  modified_base (487)..(487): a, c, t, g, unknown or other
  misc_feature (487)..(487): n is a, c, g, or t
  modified_base (496)..(496): a, c, t, g, unknown or other
  misc_feature (496)..(496): n is a, c, g, or t
tcagtacgctgtctcacgaccggtgctcgatttagagtagtgatcagggggaggaactgctcagttaggacccagagggaaccatggaagccccagctcagcttctcttcctcctgctactctggctcccagatactaccggagaaattgtgttgacacagtctccagccaccctgtctttgtctccaggggaaangccaccctntcctgcagggccagtcagagtgttagcagctacttagcctggtaccaacagaaacctggccaggctcccaggcctcctnatctatgatacatcctacgagggccactggcatcccagccaggttcagtggcaggtggtctggggacagacttcactctcacatcagcagacctagaacctgaagtattttgactagtttattactgtcagcagcgagaggtcgtttcggccctagggaccaaagtcggaatacgtacaacgactgtgctgcacntctntctnactcctccncatctgacg

SEQ ID NO: 203414 - DNA, 697 bp, Homo sapiens
  misc_feature: GYAE6OF01C58LZ.36.4.A04.1.454.CMB.1.raw
  modified_base (198)..(198): a, c, t, g, unknown or other
  misc_feature (198)..(198): n is a, c, g, or t
tcagtacgctgtctcacgaccggtgctcgatttagagtagtgatcagggggaggaactgctcagttaggacccagagggaaccatggaagccccagctcagcttctcttcctcctgctactctggctcccagatactaccggagaaattgtgttgacacagtctccagccacctgttctttgtctccgaaggggaaancgcccaccctctccgtgcagggccagtcagagtgtagcagctacttagcctggtaaccaacgagaaacctggaccaggcctcccgaggcctcctcatctatgaatacactacctacgacgggccacgtggaccactcccgagccgtaggttccaggtcggcgtaggtcgggtctaggggacaggtacttcactctacgacatcagacacgcctaagtaacctaggtaagtacttttgacgtttaagtttaacttacgtcgtacagtccaggccgtaaggtcggttaccgtttccgggacccgtaaggggaaccctaaaagggggttcgaaacgttaagtaacccgaaaacgggtaaccgttcgggtacggggtaccttcggaacccggtaacccccttaagttcccggtttccggtttaaacccttttccctaaacccgttttcccccgttttaaccccccggacctttaacgttccccggttaagggaaaaccccggg

SEQ ID NO: 203415 - DNA, 543 bp, Homo sapiens
  misc_feature: GYAE6OF01EDPWI.36.4.A04.1.454.CMB.1.raw
  modified_base (195)..(195): a, c, t, g, unknown or other
  misc_feature (195)..(195): n is a, c, g, or t
tcagtacgctgtctcacgaccggtgctcgatttagagtagtgatcagggggaggaactgctcagttaggacccagagggaaccatggaagccccagctcagcttctcttcctcctgctactctggctcccagatactaccggagaaattgtgttgacacagtctccagccacctgtctttgtctccaggggaaanagccaccctctcctgcagggccagtcagagtgttagcagctacttagcctggtaccaacagaaacctggccaggctccaggctctcatctatgatacatcctacgagggccagtcggcactcccagccaggttcagtggctaggtgggtctggggacagtacttcactctcaccatcagcagcctaagacctagaagtattttgactagtttatacttgtacagcagcgagtcgtctttcggcctagggacctaaaggtgtaactaagtaccgaaacgtacgtggtcggctagacctacctagttctgttccttacacttcccttacccgactacttcgacgtaaacg

SEQ ID NO: 203416 - DNA, 530 bp, Homo sapiens
  misc_feature: GYAE6OF01DYWH8.36.4.A04.1.454.CMB.1.raw
  modified_base (196)..(196): a, c, t, g, unknown or other
  misc_feature (196)..(196): n is a, c, g, or t
tcagtacgctgtctcacgaccggtgctcgatttagagtagtgatcagggggaggaactgctcagttaggacccagagggaaccatggaagccccagctcagcttctcttcctcctgctactctggctcccagatactaccggagaaattgtgttgacacagtctccagccaccctgtctttgtctccaggggaaanagcccaccctctcctgcagggccagtcagagtgttagcagctacttagcctggtaccaacagaaacctggaccaggctcccaggcctcctcatctatgatacatcctacgagggccactggcatcccagccagttcagtggcaggtgggtctgggacagtacttcactctcaccatcagcagcctaagacctgaatattttgctagtttatacttgtcagcagcgagaggtcctttcggacccgtagggaacctaaaggtgtaatactacgaacgtacgtggtggcctgaccacctattctgttccttcacttccttcccgactatctagaacg

SEQ ID NO: 203417 - DNA, 519 bp, Homo sapiens
  misc_feature: GYAE6OF01BB58O.36.4.A04.1.454.CMB.1.raw
  modified_base (195)..(195): a, c, t, g, unknown or other
  misc_feature (195)..(195): n is a, c, g, or t
  modified_base (254)..(254): a, c, t, g, unknown or other
  misc_feature (254)..(254): n is a, c, g, or t
tcagtacgctgtctcacgaccggtgctcgatttagagtagtgatcagggggaggaactgctcagttaggacccagagggaaccatggaagccccagctcagcttctcttcctcctgctactctggctcccagatactaccggagaaattgtgttgacacagtctccagccaccctgtctttgtctccaggggaanagccaccctctcctgcagggccagtcagagtgttagcagctacttagcctggtaccaanagaacctggccaggcctcccaggctcctcatctatgatacatcctacgagggccactggcactccccagccaggttcaggtggcaggtgggtctgggacagtacttcactctcacatcagcagcctagaacctgaagtatttgctagtttattactgtcagcagcgagagtcttcggcccgtagggaccaaaggtgatatacgaaacgacgtgtaggctgacactatcttgttccttctacttccttacccgcctactctgaacg

SEQ ID NO: 203418 - DNA, 522 bp, Homo sapiens
  misc_feature: GYAE6OF01C7XKD.36.4.A04.1.454.CMB.1.raw
  modified_base (196)..(196): a, c, t, g, unknown or other
  misc_feature (196)..(196): n is a, c, g, or t
tcagtacgctgtctcacgaccggtgctcgatttagagtagtgatcagggggaggaactgctcagttaggacccagagggaaccatggaagccccagctcagcttctcttcctcctgctactctggctcccagatactaccggagaaattgtgttgacacagtctccagccaccctgtctttgtctccaggggaaangccaccctctcctgcagggccagtcagagtgttagcagctacttagcctggtaccaacagaaacctggccaggctcccaggctcctcatctatgatacatcctacagggccactggcattccagccaggttcagtggcagtgggtctgggacagacttcactctcaccatcagcagcctagaacctagaacgtatttgctagtttattactgtcagtcagcgagaggtctttcggccgtagggaccaaggtgatatacgaacgacgtgtagctaggaccagtctacgttcttacacgttccttcccgactattcgtcgaagtaccg

SEQ ID NO: 203419 - DNA, 516 bp, Homo sapiens
  misc_feature: GYAE6OF01CRJ42.36.4.A04.1.454.CMB.1.raw
  modified_base (196)..(196): a, c, t, g, unknown or other
  misc_feature (196)..(196): n is a, c, g, or t
  modified_base (421)..(421): a, c, t, g, unknown or other
  misc_feature (421)..(421): n is a, c, g, or t
  modified_base (511)..(511): a, c, t, g, unknown or other
  misc_feature (511)..(511): n is a, c, g, or t
tcagtacgctgtctcacgaccggtgctcgatttagagtagtgatcagggggaggaactgctcagttaggacccagagggaaccatggaagccccagctcagcttctcttcctcctgctactctggctcccagatactaccggagaaattgtgttgacacagtctccagccaccctgtctttgtctccaggggaaanagccaccctctcctgcagggccagtcagagtgttagcagctacttagcctggtaccaacagaaacctggccaggctcccaggctcctcatctatgatacatccaacagggccactggcgtcccagacaggttcagtggcaggtggtctggggacagacttcactctcaccatcagcagcctggagcctgaagattctgctagtttatactgtcagcagtcgttanagttggcctcgctctacgtttcggcggtacgggtccaaggtggagacgtacgaaacgtactggtcggctgacacctattctgttccttcnttccc

SEQ ID NO: 203420 - DNA, 587 bp, Homo sapiens
  misc_feature: GYAE6OF01CGL2B.36.4.A04.1.454.CMB.1.raw
  modified_base (196)..(196): a, c, t, g, unknown or other
  misc_feature (196)..(196): n is a, c, g, or t
  modified_base (206)..(206): a, c, t, g, unknown or other
  misc_feature (206)..(206): n is a, c, g, or t
  modified_base (369)..(369): a, c, t, g, unknown or other
  misc_feature (369)..(369): n is a, c, g, or t
  modified_base (378)..(378): a, c, t, g, unknown or other
  misc_feature (378)..(378): n is a, c, g, or t
tcagtacgctgtctcacgaccggtgctcgatttagagtagtgatcagggggaggaactgctcagttaggacccagagggaaccatggaagccccagctcagcttctcttcctcctgctactctggctcccagatactaccggagaaattgtgttgacacagtctccagccaccctgtctttgtctccaggggaaanagccaccctntcctgcagggccagtcagagtgttagcagctacttagcctggtaccaacagaaacctggccaggctcccaggctcctcatctatgatacatcctacaggccactggcactcccagccaggtcagtggcagtgggtcgtgggacagtacttcactctcaccatnaccccccgnacgcctaagaacctgtaagtattttgactagtttattacttgtcagcagcgagtacggtcgtttcggcccgtagggacctaaaggtggtaataacgtacgaaacggtaaccgtggtcggtacgtacgaccgtaaccgtattaccgttcggttacctttaccttaccgttcccgtttacccccgaccctaacgttccgtaggtaaaccgg

SEQ ID NO: 203421 - DNA, 503 bp, Homo sapiens
  misc_feature: GYAE6OF01B3UPN.36.4.A04.1.454.CMB.1.raw
  modified_base (198)..(198): a, c, t, g, unknown or other
  misc_feature (198)..(198): n is a, c, g, or t
  modified_base (425)..(425): a, c, t, g, unknown or other
  misc_feature (425)..(425): n is a, c, g, or t
  modified_base (492)..(492): a, c, t, g, unknown or other
  misc_feature (492)..(492): n is a, c, g, or t
tcagtacgctgtctcacgaccggtgctcgatttagagtagtgatcagggggaggaactgctcagttaggacccagagggaaccatttggaagccccagctcagcttctcttcctcctgctactctggctcccagatactaccggagaaattgtgttgacacagtctccagccaccctgtctttgtctccaggggaaanagccaccctctcctgcagggccagtcagagtgttagcagctacttagcctggtaccaacagaaacctggccaggctcccaggctcctcatctatgatacatcctacagggcccacgtggcatccccagccaggttcagtggcagtgggtctgggacagacttcactctcaccatcagcagcctagaacctgaagtattttgctagtttattactgtcagcagcgagnggtctttcggcccgtgggaccaagtgatatacaacgactgtgctgcacatctgtcttcatcttcccnctatctgaacg

SEQ ID NO: 203422 - DNA, 591 bp, Homo sapiens
  misc_feature: GYAE6OF01BYCYM.36.4.A04.1.454.CMB.1.raw
  modified_base (196)..(196): a, c, t, g, unknown or other
  misc_feature (196)..(196): n is a, c, g, or t
tcagtacgctgtctcacgaccggtgctcgatttagagtagtgatcagggggaggaactgctcagttaggacccagagggaaccatggaagccccagctcagcttctcttcctcctgctactctggctcccagatactaccggagaaattgtgttgacacagtctccagccaccctgtctttgtctccaggggaaangccaccctctcctgcagggccagtcagagtgttagcagctacttagcctggtaccaacagaaacctggccaggctcccaggctcctcatctatgatacatcctacacgggccactggcactcccagccaggttcaggtggcaggtgggtctggggacagtacttcactctcaccatcagcagcctaagaacctgaagtattttgacttagtttacttactcgttacagcaaggcgaggtacggtctttcgggcccgtaggggaaccctaaagggtcggtaacttaacgtacgaaacggtaaccgtgggtacggtacctacgaccgtaaccgtattccgttcgttaccttacctaccttcccgttacccccgtacctaacttccgtaggtaaaccg

SEQ ID NO: 203423 - DNA, 579 bp, Homo sapiens
  misc_feature: GYAE6OF01ASV38.36.4.A04.1.454.CMB.1.raw
  modified_base (196)..(196): a, c, t, g, unknown or other
  misc_feature (196)..(196): n is a, c, g, or t
tcagtacgctgtctcacgaccggtgctcgatttagagtagtgatcagggggaggaactgctcagttaggacccagagggaaccatggaagccccagctcagcttctcttcctcctgctactctggctcccagatactaccggagaaattgtgttgacacagtctccagccaccctgtctttgtctccaggggaaanagccaccctctcctgcagggccagtcagagtgttagcagctacttagcctggtaccaacagaaacctggccaggcctcccaggcctcctcatctatgatacatcctacagggccacgtggccgtcccagacaggttcagtggcaggtgggtctgggacagtacttcactctcaccatcagcagcctggacgtcctagaagtatttctgtactagttttattacgttggtacacgcctagtccgtttaacacggtttcggccctaccggtcttccgtacgtttcgggacggtacgggtaccaaggggtcggagacgtaccgaaaccggtacgttggtacggcgtacggacctaccgtattccgttagttccttcgtcttccccg

SEQ ID NO: 203424 - DNA, 520 bp, Homo sapiens
  misc_feature: GYAE6OF01AZZZP.36.4.A04.1.454.CMB.1.raw
tcagtacgctgtctcacgaccggtgctcgatttagagtagtgatcagggggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtctgggggaggcttggtccaggccgggggggtccctgagactctcctgtgcagcctctggattcatcttgagtagttattggatgacttgggtccgcaggctccagggagggctgcaggtgggtgccaacattaaggagatggaagtgagacatactatgtggactcgtgtgaagggccgattcaccatctccagagacaacgccaagaactcactgtatctgacaaatcgaacagcctagagaggcgaggacacggctgtgttaacgttacgtggtagcggaggggccaagtatagttgggtttcggcgtatttaag

SEQ ID NO: 203425 - DNA, 508 bp, Homo sapiens
  misc_feature: GYAE6OF01CN1MU.36.4.A04.1.454.CMB.1.raw
  modified_base (196)..(196): a, c, t, g, unknown or other
  misc_feature (196)..(196): n is a, c, g, or t
tcagtacgctgtctcacgaccggtgctcgatttagagtagtgatcagggggaggaactgctcagttaggacccagagggaaccatggaagccccagctcagcttctcttcctcctgctactctggctcccagatactaccggagaaattgtgttgacacagtctccagccaccctgtctttgtctccaggggaaangccaccctctcctgcagggccagtcagagtgttagcagctacttagcctggtaccaacagaaacctggccaggctcccaggcctcctcatctatgatacatcctacagggccactggcactcccagccaggttcagtgcagtggtctgggacagactcactctcacatcagcagcctaagacctagaagtatttgctagtttattactgtacagcagcgagtaggtcgtttcggccctagggacctaaaggtggatactacaacgaactgtagctgctacattctgtcttcactcctccgacactctgaacg

SEQ ID NO: 203426 - DNA, 580 bp, Homo sapiens
  misc_feature: GYAE6OF01D2J6A.36.4.A04.1.454.CMB.1.raw
tcagtacgctgtctcacgaccggtgctcgatttagagtagtgatcagggggtctcagagaggagccttagccctggactccaaggcctttccacttggtgatcagcactgagcacagaggactcaccatggaattggggctgagcttgggttttccttgttgctattttagaaggtgtccagtgtgaggtgcagctggtggagtcgtgggggaggcttgggtccgaggcccgggggggtccctgagacctctcctgtgcagcctctggattcattcttgagttagttattggatgacgtttgggccgcaggctccgaggggaacgggctggcgaggtgggtggaccaaacgagttaaaggaagagtaggaagtgaagacaatactatggtggactcgtggaggaacgggcctattccacctatctacagacgacaacgaccaagaactcactgtactctagacaaagtcgaacagccgtagagaggcgacggacgacgggctagtagttacgttcgtgtcggcggaacggggtaccaaacgttagttacgttaggggtttacggacgttaagtttaaacg

SEQ ID NO: 203427 - DNA, 531 bp, Homo sapiens
  misc_feature: GYAE6OF01CJ44V.36.4.A04.1.454.CMB.1.raw
  modified_base (192)..(192): a, c, t, g, unknown or other
  misc_feature (192)..(192): n is a, c, g, or t
  modified_base (370)..(370): a, c, t, g, unknown or other
  misc_feature (370)..(370): n is a, c, g, or t
  modified_base (374)..(374): a, c, t, g, unknown or other
  misc_feature (374)..(374): n is a, c, g, or t
  modified_base (397)..(397): a, c, t, g, unknown or other
  misc_feature (397)..(397): n is a, c, g, or t
  modified_base (465)..(465): a, c, t, g, unknown or other
  misc_feature (465)..(465): n is a, c, g, or t
  modified_base (477)..(477): a, c, t, g, unknown or other
  misc_feature (477)..(477): n is a, c, g, or t
tcagtacgctgtctcacgaccggtgctcgatttagagtagtgatcagggggaggaactgctcagttaggacccagagggaaccatggaagccccagctcagcttctcttcctcctgctactctggctcccagatactaccggagaaattgtgttgacacagtctcagccacctgtctttgctcagggtaaangccacctctcctgcagggccagtcagagtgttagcagctacttagcctaggtaccaaacagaaaacctgggaccaggcctacccaggcctcctcatctatgactacatcctacgacgggccactggcactcccagccaggttcaggtggcgaggtcgggtctgggacagcttcactcncacntcagcagcctagacctagaagtntttgactagtttactactgtcagtcaggcgaggcgtcgtttcggcccgtagggaaccaaaggtgatanacgaacgatggngctgacaccgtatcttctccttcacttcccgttacccgcttaactcgtgaaacg

SEQ ID NO: 203428 - DNA, 511 bp, Homo sapiens
  misc_feature: GYAE6OF01C7J5Y.36.4.A04.1.454.CMB.1.raw
  modified_base (194)..(194): a, c, t, g, unknown or other
  misc_feature (194)..(194): n is a, c, g, or t
  modified_base (471)..(471): a, c, t, g, unknown or other
  misc_feature (471)..(471): n is a, c, g, or t
  modified_base (476)..(476): a, c, t, g, unknown or other
  misc_feature (476)..(476): n is a, c, g, or t
  modified_base (501)..(501): a, c, t, g, unknown or other
  misc_feature (501)..(501): n is a, c, g, or t
  modified_base (505)..(505): a, c, t, g, unknown or other
  misc_feature (505)..(505): n is a, c, g, or t
tcagtacgctgtctcacgaccggtgctcgatttagagtagtgatcagggggaggaactgctcagttaggacccagagggaaccatggaagccccagctcagcttctcttcctcctgctactctggctccagatactaccggagaaattgtgttgacacagtctccagccaccctgtcttgtctccaggggaaangccaccctctcctgcagggccagtcagagtgttagcagctacttagcctggtacaacagaaacctggccaggctccaggctcctcatctatggtgcatccgagggacggccacgtggcatcccaagacaggttcagtggcaggtggtctgggacagacttcactctacaccatcagcacgctagaacctgaagtattttgactagtttattactgtacagtcagcgtagaggtcgttcggccttagggaccgaagtgaatatacaacgactgtgctncgacntctcgtactcactccttcccgactntcgngtaacg

SEQ ID NO: 203429 - DNA, 519 bp, Homo sapiens
  misc_feature: GYAE6OF01BZOM9.36.4.A04.1.454.CMB.1.raw
  modified_base (195)..(195): a, c, t, g, unknown or other
  misc_feature (195)..(195): n is a, c, g, or t
  modified_base (473)..(473): a, c, t, g, unknown or other
  misc_feature (473)..(473): n is a, c, g, or t
  modified_base (513)..(513): a, c, t, g, unknown or other
  misc_feature (513)..(513): n is a, c, g, or t
tcagtacgctgtctcacgaccggtgctcgatttagagtagtgatcagggggaggaactgctcagttaggacccagagggaaccatggaagccccagctcagcttctcttcctcctgctactctggctcccagatactaccggagaaattgtgttgacacagtctccagccacctgtctttgtctccaggggaaangccaccctctcctgcagggccagtcagagtgttagcagcttacttagcctaggtaccaacagaaacctggccaggcctcccaggcctcctcatctatgatacatcctacgagggccactggcatcccagccaggttcagtgcaggtggtctgggacagacttcactctcaccatcagcagcctagaacctgaagtatttgctagtttattacgtgtacagcagcgagaggtcttcggccctagggaaccaaggtgatacgtacgaacgtactggtcgntcgcacattcgtctcgttcacgttcctcccgactacttcngtaacg

SEQ ID NO: 203430 - DNA, 625 bp, Homo sapiens
  misc_feature: GYAE6OF01CF6F5.36.4.A04.1.454.CMB.1.raw
  modified_base (196)..(196): a, c, t, g, unknown or other
  misc_feature (196)..(196): n is a, c, g, or t
  modified_base (391)..(391): a, c, t, g, unknown or other
  misc_feature (391)..(391): n is a, c, g, or t
tcagtacgctgtctcacgaccggtgctcgatttagagtagtgatcagggggaggaactgctcagttaggacccagagggaaccatggaagccccagctcagcttctcttcctcctgctactctggctcccagatactaccggagaaattgtgttgacacagtctccagccaccctgtctttgctccgaggggaaanacgccaccctctcctgcgagggccagtcagagtgtagcagctacttagcctaggtaccaacagaacctggccaggctccgagctcctcatctatgatacactcctacgacggtaccacgtcggcactccccgagccgtaggttcgaggtggacgtaggtgggtacgtggggacaggtaccttcgacctcaccacnctacgagctacgcctaacgactgaagtatttgacttagtttaactcgtgtacgagtcgagcggtacgtcggtaccgtttcggacccgtaagggtaacctaaagggttcgtaagtacgtaacgaacggtacgttaggacgggtactaccggtaccctaaccgtagttaccgttccgttacctttacccgtactttcccccgttacccggtacctaacgttacgtaccggtaaacg

SEQ ID NO: 203431 - DNA, 692 bp, Homo sapiens
  misc_feature: GYAE6OF01C6U1O.36.4.A04.1.454.CMB.1.raw
  modified_base (197)..(197): a, c, t, g, unknown or other
  misc_feature (197)..(197): n is a, c, g, or t
  modified_base (483)..(483): a, c, t, g, unknown or other
  misc_feature (483)..(483): n is a, c, g, or t
tcagtacgctgtctcacgaccggtgctcgatttagagtagtgatcagggggaggaactgctcagttaggacccagagggaaccatggaagccccagctcagcttctcttcctcctgctactctggctcccagatactaccggagaattgtgttgacacagtctccagccaccctgttctttgtctccgaggggaaanagccaccctctcctgcgagggccagtcagagtgtagcagctacttagcctggtaaccaacgagaaacctggccaggctcccgaggcctcctcatctatgatacatccgtacagggcccacgtggccactccccaagcctaggttcaggtggcaggtcgggtcgtgggactaggtaccttcgacttctaccgaccaatccgacgcaacgcctaagaacctagtaaagttattttacgactttaagttttaactttacgacgttacgagtacgtacggacggtaaggngggttcccgttttccgggaccccggtagggtaacccgtaaagggttacggaaacgtttaaccgtaaccggaaaccgggttaacgttgggtaaccgggtcctaacgacccgtaaacccgtcgttttacccggttctttacccgtttacccgtaccctttaccccggttttaccccccacgttaacttcccgggttaacgtaaaacccggg

SEQ ID NO: 203432 - DNA, 773 bp, Homo sapiens
  misc_feature: GYAE6OF01E264H.36.4.A04.1.454.CMB.1.raw
  modified_base (259)..(259): a, c, t, g, unknown or other
  misc_feature (259)..(259): n is a, c, g, or t
tcagtacgctgtctcacgaccggtgctcgatttagagtagtgatcagggggaggaactgctcagttaggacccagagggaaccatggaagccccaggcctcagcttctcttccgtcctgctactctggctcccagatactaccggagaaattgtgttgacacagtctccagccaccctgtctttgtctccaggggaaagagccacccgtctcctgcagggccagtcagagtgttagcagctacttagcctggtaccaanagaaacctggaccaggcctcccgaggcctcctcatcctatgatacatcctacgacgggccctacgttgggacctaacgttccccgacgacccgtagggtttacacgggttcgggaccgtaggttgggggtaccgtagggggaacctacgggtacctttaccgaactttcctacccaacccgtaacttccgaaacgtcctaacgggtaccccttaacggtaaaccccttagggtaaacggtttagttttttacggtaacctttaaggttttttaacttaaccgtttggttacctaacggtaccaacgggtaccggtaagggtaaccgggttccgtttttacccggggacccccgttaaggggggaaacccctaaagggttcggtaaacttaacgtaaccggtaaaacgtacttggggtacggtcctaacggccaaccgttatttccgttcggtttaccctttaccgaaccgttttccccttacccccggacttaaccgttagaaaccggtaaccg

SEQ ID NO: 203433 - DNA, 522 bp, Homo sapiens
  misc_feature: GYAE6OF01AZZAJ.36.4.A04.1.454.CMB.1.raw
  modified_base (195)..(195): a, c, t, g, unknown or other
  misc_feature (195)..(195): n is a, c, g, or t
  modified_base (253)..(253): a, c, t, g, unknown or other
  misc_feature (253)..(253): n is a, c, g, or t
  modified_base (420)..(420): a, c, t, g, unknown or other
  misc_feature (420)..(420): n is a, c, g, or t
tcagtacgctgtctcacgaccggtgctcgatttagagtagtgatcagggggaggaactgctcagttaggacccagagggaaccatggaagccccagctcagcttctcttcctcctgctactctggctcccagatactaccggagaaattgtgttgacacagtctccagccaccctgtctttgctccaggggaaangccaccctctcctgcagggccagtcagagtgttagcagctacttagcctggtaccaanagaaacctggccaggctcccaggctcctcatctatgatacatcctacagggccactggcactcccagccaggttcagtggcagtgggtctgggacagacttcactctcaccatcagcagcctagaacctgaagtatttgactagtttaattctcgtcagcagcgagnggtccttcggcccgtagggaccaaagtggaatagtacaaacgacgtgtacggctggaccacatctcgtcttcacttccttcccgacctacttccgtgaaacg

SEQ ID NO: 203434 - DNA, 552 bp, Homo sapiens
  misc_feature: GYAE6OF01A77I5.36.4.A04.1.454.CMB.1.raw
  modified_base (197)..(197): a, c, t, g, unknown or other
  misc_feature (197)..(197): n is a, c, g, or t
tcagtacgctgtctcacgaccggtgctcgatttagagtagtgatcagggggaggaactgctcagttaggacccagagggaaccatggaagccccagctcagcttctcttcctcctgctactctggctcccagatactaccggagaaattgtgttgacacagtctccagccaccctgtctttgtctccgaggggaaangccaccctctcctgcagggccagtcagagtgttagcagctacttagcctggtaccaacagaaacctggccaggcctcccaggcctcctcatctatgatacatcctacacggggccactggccactccccagccctaggttcaggtggcaggtcgggtctggggacagtacttcactctacaccatcagcacgcctaacgaacctagaacgtattttgacttagtttattactgtacagcagcgagtcggtcgttcggcctagggacctaaggtgaatacgtacgaacgtactggtacgcgtagaccgactatcgtcgttcttctacttccttacccgacctattcgtagtaaccg

SEQ ID NO: 203435 - DNA, 607 bp, Homo sapiens
  misc_feature: GYAE6OF01BW65U.36.4.A04.1.454.CMB.1.raw
  modified_base (193)..(193): a, c, t, g, unknown or other
  misc_feature (193)..(193): n is a, c, g, or t
  modified_base (289)..(289): a, c, t, g, unknown or other
  misc_feature (289)..(289): n is a, c, g, or t
  modified_base (350)..(350): a, c, t, g, unknown or other
  misc_feature (350)..(350): n is a, c, g, or t
  modified_base (367)..(367): a, c, t, g, unknown or other
  misc_feature (367)..(367): n is a, c, g, or t
  modified_base (384)..(384): a, c, t, g, unknown or other
  misc_feature (384)..(384): n is a, c, g, or t
  modified_base (404)..(404): a, c, t, g, unknown or other
  misc_feature (404)..(404): n is a, c, g, or t
tcagtacgctgtctcacgaccggtgctcgatttagagtagtgatcagggggaggaactgctcagttaggacccagagggaaccatggaagccccagctcaacttctcttcctcctgctactctggctccagatactacggagaaattgtgttgacacagtctccagccacctgtctttgtctccgaggggaanacgccaccctctcctgcgacgggcctagtcagagtgttagcagtctacttagcctaggtaaccaacaagaaacctggaccagcctccgaggcctcncatctatgatacactcctacgacggccacgtggacactcccgagcctaggttcaggtcgcnggtcggtcgtagggacngtacttcgactcacacntcagcacgctagactgaatnttgacttagtttactacgtgtacacgtagacggtacgtagggtacgttccgttacccgggtcccggtaacgggtaaccgtaaacgggttgtaaacgtaacgtaaaccgtaaaccgttacgtaggttaggcctacggacctaccgtcttacgtcgttccttacgacttacccgtacccgactaatcgtaaacggtagtaaccgg

SEQ ID NO: 203436 - DNA, 699 bp, Homo sapiens
  misc_feature: GYAE6OF01ADIK1.36.4.A04.1.454.CMB.1.raw
  modified_base (196)..(196): a, c, t, g, unknown or other
  misc_feature (196)..(196): n is a, c, g, or t
tcagtacgctgtctcacgaccggtgctcgatttagagtagtgatcagggggaggaactgctcagttaggacccagagggaaccatggaagccccagctcagcttctcttcctcctgctactctggctcccagatactaccggagaaattgtgttgacacagtctccagccaccctgtctttgtctcgagggtaaangccaccctctcctgcagggccagtcagagtgttagcagctacttagcctaggtaccaacagaaacctggccaggcctccgaggcctcctcatctagtgactacactccctaacgcgggaccacgtcggacctactccccgagacccgtaagggtttccaagggtcggacgtagggttggggttacgtcggggaacctaggtaccctttccaccgtttccctacacccacttacgacgaccaacgtaccgtaacgaaccttaggtaaagttacgttttagaacgtttaacggttttaattaccggtagttaccgaaggaccgaggtaccggtaagggtaccggttccggtttaccgggccccgtaaggggaaacccgtaaagggtcgtaattaacgtaaaccgaacgtaacgttggtacggtccgtacgacctaccgtattcgtcggtttccttaccgttacgttccccgtttacccgaccttacgttaccgtaggtaaaccgg

SEQ ID NO: 203437 - DNA, 507 bp, Homo sapiens
  misc_feature: GYAE6OF01A99XY.36.4.A04.1.454.CMB.1.raw
  modified_base (196)..(196): a, c, t, g, unknown or other
  misc_feature (196)..(196): n is a, c, g, or t
  modified_base (254)..(254): a, c, t, g, unknown or other
  misc_feature (254)..(254): n is a, c, g, or t
  modified_base (498)..(498): a, c, t, g, unknown or other
  misc_feature (498)..(498): n is a, c, g, or t
tcagtacgctgtctcacgaccggtgctcgatttagagtagtgatcagggggaggaactgctcagttaggacccagagggaaccatggaagccccagctcagcttctcttcctcctgctactctgtctcccagatactaccggagaaattgtgttgacacagtctccagccaccctgtctttgtctccaggggaaangccaccctctcctgcagggccagtcagagtgttagcagctacttagcctggtaccaanagaaacctggccaggctcccaggctcctcatctatgatacatcctacaggccactggcatcccagccaggttcagtgcagtgggtctggggacagacttcactctcaccatcagcagcctagaacctgaagtattttgctagtttattactgtcagcaggcgaggtaggccgttttcggcccttagggaccaaaggtggatatacaacgaactgtgctgcacatctgtcttcatccttccgccntcgtgaacg

SEQ ID NO: 203438 - DNA, 696 bp, Homo sapiens
  misc_feature: GYAE6OF01BNJLA.36.4.A04.1.454.CMB.1.raw
  modified_base (196)..(196): a, c, t, g, unknown or other
  misc_feature (196)..(196): n is a, c, g, or t
  modified_base (432)..(432): a, c, t, g, unknown or other
  misc_feature (432)..(432): n is a, c, g, or t
tcagtacgctgtctcacgaccggtgctcgatttagagtagtgatcagggggaggaactgctcagttaggacccagagggaaccatggaagccccagctcagcttctcttcctcctgctactctggctcccagatactaccggagaaattgtgttgacacagtctccagccacctgtctttgctccgaaggggaaancgccaccctctcctgccagggccagtcagtagtgttagcagcttacttagccgtggtaaccaaacgacgaaacctgggacccaggcctacccgaggtccttcctcattcctatgtactacctactaccctaacggacgggtcccacgtggaccactccccgagacccgtaggttacaggtggccgaggttcggggcttaggggaactaggtaccttctaccgtctaccgaacctanccacgacgacgtaccttaacggaaccgttagtaacgtttcttttaggaactttacggttttaataccggttacgtaccaaggtcgaaggtcggtaagggtacggtttcccgttccgggacccggtacgggtaaaccgaagggtttacgaacgttaacaacggtaaaccgtacgttgggtacgtaccgttaccggaccgtacctagttcctacgttacttacctaacgttcccctacccgtaacctcgttaccgagggtaaaccg

SEQ ID NO: 203439 - DNA, 635 bp, Homo sapiens
  misc_feature: GYAE6OF01B7DH1.36.4.A04.1.454.CMB.1.raw
  modified_base (196)..(196): a, c, t, g, unknown or other
  misc_feature (196)..(196): n is a, c, g, or t
  modified_base (451)..(451): a, c, t, g, unknown or other
  misc_feature (451)..(451): n is a, c, g, or t
tcagtacgctgtctcacgaccggtgctcgatttagagtagtgatcagggggaggaactgctcagttaggacccagagggaaccatggaagccccagctcagcttctcttcctcctgctactctggctcccagatactaccggagaaattgtgttgacacagtctccagccaccctgtctttgtctccaggggaaanagccaccctctcctgcagggccagtcagagtgtagcagcttacttagccttaggtaaccaaaacctaaaaaccgtcggacccgacggcctacccgaggccctcctactactctagtgactactactcctacgacgggccacgtcggctactccacgccgtaggttcaggtcggcgtaggttcgggtcgtagggactaacggtaccttcgtacctctaccaacctactcacgcacgcctaagaaccgtagaagttntttagacttagtttactactgtactagcgagacgaggtacggttcgtttccgggacccgtacgggaacctaagggtacgtaactaaccgaaacgacgttcggtcgacgtcgaccctacctagtcttacgttacttcctaccttcccgttccccgtactacttaccgtacggaacgccgtaacgg

SEQ ID NO: 203440 - DNA, 858 bp, Homo sapiens
  misc_feature: GYAE6OF01BT318.36.4.A04.1.454.CMB.1.raw
tcagtacgctgtctcacgaccggtgctcgatttagagtagtgatcagggggtctcagagaggagccttagccctggactccaaggcctttccacttggtgatcagcactgagcacagaggactcaccatggaattggggctgagctgggttttccttgttgctattttagaaggtgtccagtgtgaggtgcagttggtggagtctgggggaggcttggtccagccggtgggggtccctgagctctcctgtgcagcctcgtggacttctacccttttagtaacttagttggatggtaggtttcggggtccccgtccgtcggcctccgaaggggtaacggggcccgtagggaggttcggggtcggacccaaacgtagtacgaggccgggagtacgggaagtggaaacgaaaactacgtaagtcggtagggtacgttcgtagggttagggaaacggggtcccgtaactttacccgaaccctacgttcccgtacccgaagggaaccgaaacccgaaacccggaacccgaaaacggtaaacccttacctaaccgtttcggtttttacccgtacggtaaaacctagttaacccgaacccgtaccggtaccccgttaagggaaccggaaccgggtaaccccggggtaaacggggttaccccggttacccggggttaccctttaccccgtttaaccggtttaaaccgttttaaccggttggttaccgggtaccgggtaaagggtaaacggggtaacgggggttacccttttaaccgggttttttaggggaacggttttacggttaacccgtttttaccccgtttacccccccggtttttaggttaacccgggttttaccggggggg

SEQ ID NO: 203441 - DNA, 720 bp, Homo sapiens
  misc_feature: GYAE6OF01C01M1.36.4.A04.1.454.CMB.1.raw
  modified_base (198)..(198): a, c, t, g, unknown or other
  misc_feature (198)..(198): n is a, c, g, or t
  modified_base (208)..(208): a, c, t, g, unknown or other
  misc_feature (208)..(208): n is a, c, g, or t
  modified_base (654)..(654): a, c, t, g, unknown or other
  misc_feature (654)..(654): n is a, c, g, or t
tcagtacgctgtctcacgaccggtgctcgatttagagtagtgatcagggggaggaactgctcagttaggacccagagggaaccatggaagccccagctcagcttctcttcctcctgctactctggctcccagatactaccggagaaattgtgttgacacagtctccagccaccctgtctttgtctccgaagggtaaangcccaccctntcctgcagggccagtcagagtgttagcagctacttagcctggtaccaacagaaaccctggccacggcctcccgaggcctcctcattctatgactactactcctacgagggccacgtggaccactaccccagcccgtaggttcgaggtggccgtaggttcggggtcgtacggggaactacggtacctttcgaaccttcctacgaccctaagtccgaacgacctaccggtaacccgttaacggtaacccgttaaggtaacgtttacgtttttacggaccgtttaaggttttttaacttacgttgttaaccgtagaccgtaaggtcggtaacggtacggttccggttttaccggggcccgttacggggaaacccgtaaagggttacgggtaattaaccgtaaccggtaaaccggtaacggttcggtacggtctacggacctaacccgtntttaccgttccgttaccgtttctaccgtttcccgttacccgtacctacgttacccgtggtaaaccg

SEQ ID NO: 203442 - DNA, 952 bp, Homo sapiens
  misc_feature: GYAE6OF01AUUYX.36.4.A04.1.454.CMB.1.raw
tcagtacgctgtctcacgaccggtgctcgatttagagtagtgatcagggggtctcagagaggagccttagccctggactccaaggcctttccacttggtgatcagcactgagcacagaggactcaccatggaattggggctgagcttgggttttccttgttgctattttagaaggtgtccagtgtgaggtgcagcgtgggtggagtcggtggggggaggtcgttgggtccgacgggcccgggggggttccctggacgaccttcctccgtggtcgccacgtccctcgtggtactttcattcgttaggaagttagtttagttggagttggtaacggtttcggggtcccgccgtacgggtccgtaccgggaagggggtaacgggggtccttggaccggtaggggttcgggggttacggaacccctaaaaggttaaaggtttaaaggggaaaggtaggttaaggggtaaaggttacgggaaagtaaaccgtaaagttaaccgttaggttacgggttacgggtacctttacggttaggggttaacgggtaaccggggtacccgttaagtttccccaaacccgttacgttacccccggttaacccggaaacgggtaaaccgaaaaccccggtaaaccccggtaaaccccgaaaaacgggtttaaccccttaaccggttaaaccgtttacggttaaaccgtttacccgttaacgggtaaaaacccttaaaaacggttaccggaaaaacccgtaccgggttaacccggttaaagggggaaaccggggtaaaccggggaaccgggtaaaccggggtaaacccggtaccgggttaccggtttagggtttaaccgtttaacccgtttaagggtccgggtaacggggacccggggtaacgggtaaccttaaacgttaggtttacgggttttaggggttaccgtaaaccgttagttttaaaacgg

SEQ ID NO: 203443 - DNA, 589 bp, Homo sapiens
  misc_feature: GYAE6OF01CXTVQ.36.4.A04.1.454.CMB.1.raw
  modified_base (307)..(307): a, c, t, g, unknown or other
  misc_feature (307)..(307): n is a, c, g, or t
  modified_base (395)..(395): a, c, t, g, unknown or other
  misc_feature (395)..(395): n is a, c, g, or t
  modified_base (429)..(429): a, c, t, g, unknown or other
  misc_feature (429)..(429): n is a, c, g, or t
  modified_base (451)..(451): a, c, t, g, unknown or other
  misc_feature (451)..(451): n is a, c, g, or t
tcagtacgctgtctcacgaccggtgctcgatttagagtagtgatcagggggaggaactgctcagttaggacccagagggaaccatggaagccccagctcagcttctcttcctcctgctactctggctcccagatactaccggagaaattgtgttgacacagtctccagccaccctgtctgtgtctccaggagaaagacgcccaccctctcctggtagggccagtcagagttgttagcagctaacttagcctggtaccagacaagaaacctggacctacggttcccaggctcatccattctatggtcncactccacgacggcctacgtggtactcccagtccctaccgtttagcggctaggtcggtacgtgggactagtacgttcacgtctccacngtcacgtcacgtcctgctagtctagtaaagtttntttgactttagtttacttactntacctaaacgtcgttaacagttcgacgtcgtacctcgtactacggttcggacgggacggtacgaaggtggaacagtaaccgaaaggtactgggtaacggtctacgactacgtacttcgtattcctctacgttcccccg

SEQ ID NO: 203444 - DNA, 781 bp, Homo sapiens
  misc_feature: GYAE6OF01BCMW0.36.4.A04.1.454.CMB.1.raw
  modified_base (193)..(193): a, c, t, g, unknown or other
  misc_feature (193)..(193): n is a, c, g, or t
  modified_base (201)..(201): a, c, t, g, unknown or other
  misc_feature (201)..(201): n is a, c, g, or t
  modified_base (226)..(226): a, c, t, g, unknown or other
  misc_feature (226)..(226): n is a, c, g, or t
  modified_base (249)..(249): a, c, t, g, unknown or other
  misc_feature (249)..(249): n is a, c, g, or t
  modified_base (278)..(278): a, c, t, g, unknown or other
  misc_feature (278)..(278): n is a, c, g, or t
tcagtacgctgtctcacgaccggtgctcgatttagagtagtgatcagggggaggaactgctcagttaggacccagagggaaccatggaagccccagctcagcttctcttcctcctgctactctggctcccagatactaccggagaaattgtgttgacacagtctccagccacctgtctttgctccgagggaangccacctntcctgcagggccagtcagagtgtancagctacttagcctggtaccaanagaaacctggccaggcctccaggcctccnctatctatgactacacttcctacgacgggccctacgtcggacctaacttccccgaaggtcccgaagggtttccaaggttcgggtaccgtagggttcggggtaccgtacgggggaacctaacgggtaccttttacgaaccgtttccgttaacccgaaccgtagttacccgaaacggtaccgtaaccgggtaccccgtttaaagggaaaccccgttaggtaaacgtttacgtttttacggaaccgtttaacggttttaactttaaccgttcgtaccgtaacgtccgtaacgggtaccggtaacggttaccgggtcccgttttaccggggaaccccgttacggggtaaaccgtaaacgggttacgggtaaacttaacgtaaccggtaaaacgtaaccgttggttaccggacgttaccggtaccgtaaccgtagttaccgtacggttacccttactaaaccgttcccgttaccccgaacccgttaattaccggtaacggtaaaccgg

SEQ ID NO: 203445 - DNA, 838 bp, Homo sapiens
  misc_feature: GYAE6OF01COISF.36.4.A04.1.454.CMB.1.raw
  modified_base (757)..(757): a, c, t, g, unknown or other
  misc_feature (757)..(757): n is a, c, g, or t
tcagtacgctgtctcacgaccggtgctcgatttagagtagtgatcagggggtctcagagaggagccttagccctggactccaaggcctttccacttggtgatcagcactgagcacagaggactcaccatggaattgggctgagcttgggttttccttgttgctattttagaagtgtccagtgtgaggtgcagcgtgggtggagtcggtgggggagtcgttggtccgagggcccgggggggttcctggacgtacctcctccgtgtcgcgacgtcctcgtggtacttctattcgttaggtaagtttagtttagttaggtagttcggtacggtttccggggtaccgaccgtacggtccgtaccgggtaagggggaacgggtcgtacggacggtaggggttcggggtacgaacctaaaacggttaaaggttaaaagggaaacggtaaggttaaggggaaaggttacggaaacggtaactaaacgtttaacgttaggttagggttaaccggtaccgtttacgggttacgggtaacgggtaaccggggttaccttaacgtttaccccgaaccggtttaactcccggtaaacggaaaagtaacccggaaaaccgtaaacccggtaacccgaaaaggttaaccctttcggaactttacggttaaccttcggtaaactaacgtaaacgtaccgaaacgtcgtaaccggagggaaacgggtcggaacggaaggtacccgtggtacgttaggttattaacggttccgngggaacccggacggggtaaccggtaacttaaggttacggtttacggttagggtttacggaaccctttaaagttttaaacgg

SEQ ID NO: 203446 - DNA, 761 bp, Homo sapiens
  misc_feature: GYAE6OF01ADOTM.36.4.A04.1.454.CMB.1.raw
  modified_base (217)..(217): a, c, t, g, unknown or other
  misc_feature (217)..(217): n is a, c, g, or t
tcagtacgctgtctcacgaccggtgctcgatttagagtagtgatcagggggaggaactgctcagttaggacccagagggaaccatgggaagcccccagcctcacgtcttctcttcctcctgctactcgtggcctcccagataccgtaccggaagtaaattgtgttgacacgagtcctccacgccctacctgttctttgtcctaccggaaggggaaancgcccaccctctccgtgcgacggccagtcagtagttgtacgcagtccttacgttacgccgttacggtaacccaaacgaacgaaacccgtcggaccgacggtccctacccgacggtccctcctactacttacgttagtacgtaactacctaccttaccctaacggaccgggaccctacggtcggacctaccgtaccccgacgccgtacggttcgtaggtcggacgtacgggtcgggtcgtacgggactacggtaccttaccgaccttccacctaccacgtacacgacacgtaccgtaacgaaccgtaacgtaagtttacgtttcgtacgtttaagttttactttacgttcggtacacgtacgacggtaccggtacggtacggttacccggtttcccggaccggttaacgggaaccgtaagggttacgtaactaacgtaaccgtaaaccgtacggttggtacgtactaccgacctaccggttattcgtccgtttaccttaacgttaccctttcccgttaccccgacttacgtcgtaacggtaaccg

SEQ ID NO: 203447 - DNA, 763 bp, Homo sapiens
  misc_feature: GYAE6OF01BNPYF.36.4.A04.1.454.CMB.1.raw
tcagtacgctgtctcacgaccggtgctcgatttagagtagtgatcagggggaggaactgctcagttaggacccagagggaaccatggaacgccccagctcagcttctcttcctcctgctactctgcctccagatacacggataattgtgtgacacgagtctaccagccctacccttgttctttcgtccgtaccggaaggggaaagccgccctaaccctctccgtgacgacgggaccaggtcaaggtaggttgttaacgctacgtaccttacgttcgccgttaacggaaccaaacgaacgtaaaccgtcggacccgaggtcccgtaccgacggtccttacctacgtacttctagtacgtactaacctacgtccccgtaacggaccgggtaccctacgaccggtaccaccgtccccgtaacggaccgtttacggttacgtaacgggtgggtacgtaggggttcggggtacgtacgggaacgtacgtcccttactacccgttccgtaccctactaccgtacgaccgtacgaaccgtaccgtaacgtacgtaacgttagtttaccgtttagtaccgtttaagtttacttcgtacgtcgtaaacgcggtacgacggtacggttcggttaccgtttccgggaacgtacggtaacggtaaggtagtacttaacgaacgtaccggtagtcgacggtctacggtaccgtactcgttctcgtttacctccgtacccgttcccttaccgtacgtacttcggtacgtaaacccgg

SEQ ID NO: 203448 - DNA, 805 bp, Homo sapiens
  misc_feature: GYAE6OF01BQZNH.36.4.A04.1.454.CMB.1.raw
  modified_base (157)..(157): a, c, t, g, unknown or other
  misc_feature (157)..(157): n is a, c, g, or t
  modified_base (190)..(190): a, c, t, g, unknown or other
  misc_feature (190)..(190): n is a, c, g, or t
tcagtacgctgtctcacgaccggtgctcgatttagagtagtgatcgagggggaggaactgctcagttaggacccagagggaaccatggaagccccagctcagcttctcttcctctgctactctggctccagatactaccggagaattgtgttgacanagtctcagccacctgtctttgtctcgagggaancgccaccctctccgtgcgagggccagtcagtagtgttacgcgacgtcttacgtacgccgtacggtaaccaacgaagtaaacccgtcggacccgacggtccctacccgtacggtcccttacctaccgtattaccttatacgtaacttaacctaccttacccgtaacggaccgggtaccctaccggtacggaccctaaccgttaccccgaaccggttacccgttaacggggttacctagggtccggtaccggtagggtttcggggtaccgttacggggactaccggttaccttaccgtacctacccgttaccgaacctagttaccgaacgtaccgtaaccgtaaccgtaacgtaaccgttacggtaagtttacgttttacgtacgtttaagtttaacttacgttcgtacgacggtcgtacggtacggtacggttacggttcccggtttaccggtacccggttaacgggtaaccgtaagggttacggttaaacgttaacgttaaccgtaaacggtcgttacggtacgtaccgttacgaccgttacgttacgttcgtttacgtaccgttaccttaccgttaccccggttcccaacggtttctaaccggtacgtaaaccg

SEQ ID NO: 203449 - DNA, 619 bp, Homo sapiens
  misc_feature: GYAE6OF01D0D0C.36.4.A04.1.454.CMB.1.raw
  modified_base (197)..(197): a, c, t, g, unknown or other
  misc_feature (197)..(197): n is a, c, g, or t
  modified_base (214)..(214): a, c, t, g, unknown or other
  misc_feature (214)..(214): n is a, c, g, or t
tcagtacgctgtctcacgaccggtgctcgatttagagtagtgatcagggggaggaactgctcagttaggacccagagggaaccatggaagccccagctcagcttctcttcctcctgctactctggctcccagatactaccggagaaatttgtgttgacacagtctccagccaccctgtctttgtctccaggggaaanagccaccctctcctgcngggccagtcagagtgttagcagctacttagcctggtaccaacagaaacctggaccaggcctcccaggcctcctcatctatgatacactcctacgacgggccacgtggacactcccgacgcctaggtttcaggtcgggacctaggttcggggtctaggggactaggtacctttccgacttctaccacctatccagcacgacctagaacctagtaagtagttttgactagtttattactgtcagcagacggagacggtccgtttccgggcccgtacggggaacctaaagggttggaacttacgtaacgtaacgtaacgtggtacggtacgtcgtaccgtaccttagttcgttcgttccttactaccgttaccccgttacccgaccttacgttccgtaggtaaaccgg

SEQ ID NO: 203450 - DNA, 827 bp, Homo sapiens
  misc_feature: GYAE6OF01B190Q.36.4.A04.1.454.CMB.1.raw
  modified_base (198)..(198): a, c, t, g, unknown or other
  misc_feature (198)..(198): n is a, c, g, or t
tcagtacgctgtctcacgaccggtgctcgatttagagtagtgatcagggggaggaactgctcagttaggacccagagggaaccatggaagccccagctcagcttctcttcctcctgctactctggctcccagatactaccggagaaattgtgttgacacagtctccagccaccctgttctttgtctccgaggggaaanacgccaccctctcctgcagggccagtcagagtgttagcagctacttagcctggtaccaacacgaaacctggccaggcctccgacggcctcctcactctatagactacactcctacgacgggtccacgtcggcactccccgagtcccgtaggttccaggttcgggacgtagggttcggggtcgtacggggacctaggtaccttccaccgttcctaccaaccctacgtaccgacgtaccgaacgtacccgtaacggtaacccgttaaggtaaacgtttacgttttacggtaaccttttaaggtttttaactttaaccgtttacggtttaaccgtaacgtaaccgttaaaggttaaagttaaacgttacggtaaacccggtaccggggttacccggtttaaccccgggggtttaaccggtttttaccgggggacccggggtaacggggggtaaccccgtaacgggtaccggttaacggggtaacggttaaaccgtaaacccggtaaaaaccgggtaaccggttacggggttaccgggtaccgttaccgggtacccctaacccggttaccgtttaccggttaccgttttacccgtttaacccgttacccgttttaccccggttacccccccgg

SEQ ID NO: 203451 - DNA, 681 bp, Homo sapiens
  misc_feature: GYAE6OF01DS4LY.36.4.A04.1.454.CMB.1.raw
  modified_base (198)..(198): a, c, t, g, unknown or other
  misc_feature (198)..(198): n is a, c, g, or t
tcagtacgctgtctcacgaccggtgctcgatttagagtagtgatcagggggaggaactgctcagttaggacccagagggaaccatggaagccccagctcagcttctcttcctcctgctactctggctccagatactaccggagaaattgtgttgacacagtctccagcccaccctgtctttgtctccgaaggggaaanagccaccctctcctgcgagggccagtcagagtgttagcagcttacgttagccgtacggtaaccaacgaacgaaacctggaccacggtctctaccgaggcctcctacatctatagactacactacctacggacggcctagtcggcactaccagcgtagtcgaggtggacgtagggtggttcgacggggactagtaccttacaccttcaccacctatacgagcaacgacctaacgaaaccttggtaaaattcgttttagaacgttattttacgttacgttagcgagacgtaaggcggtaaggtaccggttccgttaccgggacccggtaacgggtaaacgtaaacgggtcgaattaaccgtaacggtaaaccgttaacgttgggtacccggtataccggtaaaccttacctaacggtttcttacggtttacccgtttactaacccgtttccccggtttaacccaccgttaacgttccgtaaacgg

SEQ ID NO: 203452 - DNA, 749 bp, Homo sapiens
  misc_feature: GYAE6OF01DMDIX.36.4.A04.1.454.CMB.1.raw
  modified_base (200)..(200): a, c, t, g, unknown or other
  misc_feature (200)..(200): n is a, c, g, or t
  modified_base (255)..(255): a, c, t, g, unknown or other
  misc_feature (255)..(255): n is a, c, g, or t
  modified_base (281)..(281): a, c, t, g, unknown or other
  misc_feature (281)..(281): n is a, c, g, or t
tcagtacgctgtctcacgaccggtgctcgatttagagtagtgatcagggggaggaactgctcagttaggacccagagggaaccatggaagccccagctcagcttctcttcctcctgctactctggctcccagatactaccggagaaattgtgttgacacagtctccagccaccctgtctttgtctccgaaggggaaaacnccaccctctcctgcagggccagtcagagtgtagcagctacttgcctggtaccaanagaacctgccagcctccgagcctctnatctatgactcacttccagcggccagtcggccactcccaagtcccgtaaggtcaggtggactaggtcgggtcgtagggaacacggtacctttccaaccttcctaccaacccgtataccgacgtaccgtaaccggtcccgttaaacgtaacccgttaggtaaacgtttcgtttttacgacgttttaacgttttaacgtttaacgttcggttaccgacgtacggtaacggtccggtaaggtacgggtttcccgtttacccggggacccgtttacggggaaaccgtaaacggttcgggtaacttaacggtaacgtaaaaccggtacgttacggttaccggtaccgttacggacccgttaccgtaaccgtttccggtttaccggtttaacccgtttacccttaccggtttacccccgttacccccgttaaccgtaccgtttaacgtaaaccgggtaaccggttaaacccggg

SEQ ID NO: 203453 - DNA, 763 bp, Homo sapiens
  misc_feature: GYAE6OF01COM1C.36.4.A04.1.454.CMB.1.raw
tcagtacgctgtctcacgaccggtgctcgatttagagtagtgatcagggggaggaactgctcagttaggacccagagggaaccatggaagccccagctcagcttctcttcctcctgctactctggctcccagatactaccggagaaattgtgttgacacagtctccagccacccttgtctttgctccgaaggggaaacgcgcccaccctctcctgcgacgggccagtcagagtgtagcagctactagcctaggtaccaagacgaacctcggaccacggtcctcccgaggtcctcctacgacttcctatacgaacttacctaccttacccgtacgaccggggtacccaccgttcgggacctaccgttccccgaacggtcccgtaacggtttccgaagggttcgggacggtacgggttacggggtcctagggggaacctaacgggtaccctttaccgaaccttcccttaccaaccgtacgtaccgacggtaccgtacgtacccgtaaacgtaacccgtaggtaacgttacgttttacgaccgtttaagttttaacttaccgttgtacgtacggtacgagggtaccgaagggttaccggttcccgtttaccgggtacccggttaacgggaaacggttaacggtacggtaaacgttaacgtaaccggtaaacgtacggttcggtacggtaccgtacgtaccgccttagttccgttcgttacctcgttacccttacccgttcccaacttccgttcgtacgtaaaccgg

SEQ ID NO: 203454 - DNA, 655 bp, Homo sapiens
  misc_feature: GYAE6OF01EX6ZD.36.4.A04.1.454.CMB.1.raw
  modified_base (199)..(199): a, c, t, g, unknown or other
  misc_feature (199)..(199): n is a, c, g, or t
  modified_base (229)..(229): a, c, t, g, unknown or other
  misc_feature (229)..(229): n is a, c, g, or t
tcagtacgctgtctcacgaccggtgctcgattttagagtagtgatcagggggaggaactgctcagttaggacccagagggaaccatggaagccccagctcagcttctcttcctcctgctactctggctcccagatactaccggagaaattgtgttgacacagtctccagccaccctgtctttgtctccgaaggggaaanacgccaccctctcctgcagggccagtcagngtgttagcagctacttagcctggtaaccaaacagaacctgaaccaggcctcccaggcctcctacatctatgaactacactccgtacgacgggccacgtcggcactcccagcctaggttcagtggcgtaggtcgggtcgagggacaggtcttccactctaccaccatcgacgcctagtacctaacggtaacctagaacgttaagtttttacgacttaagttttaacgtttacgttacgtaccgtagtacgacggtacggtacggtacggtccgttttaccgggcccgttaaccggggaaaccgtaaggtacggtaacttaacgtaaccgaaaacggtaacgtacggtagacccgttagacccgtaccgtattccgttcgttaccgttctaccgttcccttacccacccgttaactcgtagtaaaccg

SEQ ID NO: 203455 - DNA, 764 bp, Homo sapiens
  misc_feature: GYAE6OF01CILNW.36.4.A04.1.454.CMB.1.raw
  modified_base (201)..(201): a, c, t, g, unknown or other
  misc_feature (201)..(201): n is a, c, g, or t
tcagtacgctgtctcacgaccggtgctcgatttagagtagtgatcagggggaggactgctcagttaggacccaggagggaaccatggaacgccccagctcagcttctcttcctcctgctactctgctcccagatactaccggagaattgtgttgacacagtcctcagcctacctgttctttgtccgtaccgaaggggaaanacgcccaccctctccgtgcgagggccagtcaggtagtgttaagctacgcttacgtttacgccgtacggtaaccaaagacgaaaccgtggacctacggcctaccgaggtcctcctactactctatagactacacttccgacgacggtccacgtcggactaccgtaccgcgtaccgtaggtcgtaggtcggtacgtaggttacgggtacgtcgggggaacctacgttaaccgttaccacctttacccgaccgtaacctacgtaccggaaccgaccgtaacggtaaccgttaacccgtaaaccgttaagttaaaccggtttacgttttacgtaaccgtttacggtttttaacttaacgttcgtacgaaccgtacgtacggacggtaccgggtacggtttacccggttacccgggacccgttaaggggaacccgttaagggaccggttaaagttaccgaaacgtaacgtacgtcggtagccggtacgtacccgtactaacgttcgttcgttacccgttacgtaaccgttcccgtttaccccacgtttacctaccgtaggtaaaccgg

SEQ ID NO: 203456 - DNA, 673 bp, Homo sapiens
  misc_feature: GYAE6OF01A2I74.36.4.A04.1.454.CMB.1.raw
tcagtacgctgtctcacgaccggtgctcgatttagagtagtgatcagggggtctcagagaggagccttagccctggactccaaggcctttccacttggtgatcagcactgagcacagaggactcaccatggaattgggctgagctgggttttccttgttgctattttagaaggtgtccagtgtgaggtgcagctggtggagtcgtgggggaggcttggtccaggccggggggtccctgagactctcctgtgcagcctctggattcatcttgagtagttattggatgacttgggtccgcgaggcctccgaggggaagggctggcgaggtgggtggaccaacgtaagttaagggaagagtaggaaagtgagacattaactatgtaggacttcgtggtaggaagggccctaattccgacctatcctaccgagaacgaaccaaacgccaaacgaacctacaactggtaactcgtagaacctaaagtacgaaaccaggtacccgtaggaacgggtacggaccggaacgggtaacccgaacgggtccgttacggttaggtttaacgttttaacccggtggggttaccgggaccggggtaaaccgggggtacccctaaaaaccggtttaggttaaccggtttaggggtttacgggtaacccgttaacgtttttaaaacgg

SEQ ID NO: 203457 - DNA, 679 bp, Homo sapiens
  misc_feature: GYAE6OF01BGJE6.36.4.A04.1.454.CMB.1.raw
  modified_base (197)..(197): a, c, t, g, unknown or other
  misc_feature (197)..(197): n is a, c, g, or t
  modified_base (307)..(307): a, c, t, g, unknown or other
  misc_feature (307)..(307): n is a, c, g, or t
tcagtacgctgtctcacgaccggtgctcgatttagagtagtgatcagggggaggaactgctcagttaggacccagagggaaccatggaagccccagctcagcttctcttcctcctgctactctggctcccagatactaccggagtaaattgtgttgacacagtctccagccacctgtctttgtctccgaggggaaancgccacctctcctgcgagggccagtcagagttgtagcagtcctattagccttaggtaaccaacagaaacccgtggacccaaggccctacccgaggtcctcctctatctangtaactacgactccctacgacgggcccagtcggcactcccgagctaggtcaggtgctaggtcggtcgtagggacaggtccttcgactccgtacaaccatccgaacgctaacgccttaagaacctagtaaacgttatttacgacttaaggtttaacttaccgtagttccagttacgaaggtcggtaaggtacggttccgttttaccgggacccgttaacggggtaaccgaaaagggttcggtaaacttaacgtaacccgtaaacggtaccggttaggtaccggtaccgtacggtaccctaaaccgtatttccggttcttaaccttcgtaaccctttccggtaaccccaccttaagtccgttacggaaaaccgg

SEQ ID NO: 203458 - DNA, 669 bp, Homo sapiens
  misc_feature: GYAE6OF01BALP7.36.4.A04.1.454.CMB.1.raw
tcagtacgctgtctcacgaccggtgctcgatttagagtagtgatcagggggaggaactgctcagttaggacccagagggaaccatggaagccccagctcagcttctcttcctcctgctactctggctcccagatactaccggagaaattgtgttgacacagtctccagccaccctgttctttgtctccgaggggaaagcgccaccctctcctgcgacgggccagtcaggagtgtagcagctacttacgcctaggtaaccaacgacgaaccgtggaccgacggtcctcccgacggcctcctcatctatgactactactaccctacgacgggcccacgtcggaccactcccgagtccgtacggttacaagggtcggacggtaggttcggggtacgtaggggacctacggtacctttccgaccgttcctaccaccgtactccgacgacgtaccgtaccgtaacgtaacctaggtaacttagttttcgaacgtttagtttaacttacgttcgtactacgtacgacggtcggtaaggtccggtacgtttccgggacccgtacgggaactaacgggtagtaacttaacgtaacgaacgtacggtagtcggactacgacctacgtacgttcgtcgtttactccgttacttccttacccgactctacgtagaaaccg

SEQ ID NO: 203459 - DNA, 726 bp, Homo sapiens
  misc_feature: GYAE6OF01C0O3S.36.4.A04.1.454.CMB.1.raw
  modified_base (560)..(560): a, c, t, g, unknown or other
  misc_feature (560)..(560): n is a, c, g, or t
tcagtacgctgtctcacgaccggtgctcgatttagagtagtgatcagggggtctcagagaggagccttagccctggactccaaggcctttccacttggtgatcagcactgagcacagaggactcaccatggaagttggggctgagcttgggttttccttgttgtctattttagaaggtgtccagtgtgaggtgcagcgtgggtggaggtcgtggggggaggtcgtttcgggtcccgacggggcccgggggggggttcccctggagtaccttcctccgtgtcgccacgcccttctgggatttcattcttgtaaggttagtttagttggagttgaccgttttggggtccccgccagggcctccggaggggaagggcgtgcgaggtgggtgaccaagagttaaggaagagtagggaaagtgagaacaagttactagtggtggtactcgtaggttgggaacgggtccgtatttacccgaccacttcctaccgagaacgaacgaaaccgacccaaacgtaacctaccgtaccgttagtacttcgtacgaactaaaagtcgaaacncggtaccgtaggaacggaacgggtacggaacgggaccgtaacgggtccgttaggttaggttaaactttcggtaggtacgggtccggggaaacgggggttaacccaaaccggtttatttaacgggttacggggtttttacgggtaaccgtttaaccgttttaaacgg

SEQ ID NO: 203460 - DNA, 679 bp, Homo sapiens
  misc_feature: GYAE6OF01A2ONM.36.4.A04.1.454.CMB.1.raw
tcagtacgctgtctcacgaccggtgctcgatttagagtagtgatcagggggaggaactgctcagttaggacccagagggaaccatggaagccccagctcagcttctcttcctcctgctactctggctcccagatactaccggagaaattgtgttgacacagtctccagccaccctgttctttgtctccgaggggaagcgccaccctctccgtgcgagggccagtcagtagttgttagcagtcttacgttacgccgttacggtaaccaaacgaacgtaaccgtcggaccgacggtcctacccgaggtccctacctctacttcctagtcgtaactactactaccgtacgacgggccctacgtcgactactcccgagccgtaggtcgaggtcggacgtggtcgggtcgtagggactacgtaccgtttcaccgttcctaccacctagccgacgcaacgtacctaagtaccgtagtaactttagtttcgacgtttaagttttactcgtagtacgagacgtacggacgtacgggtacgttccggttccggaccgttaaccgggaaacgtagggtacgaacttacgaaacgtaccgtaggttcggacgtaccgagacctaccgttgttaccgttacgttaccgtccgttaccttcccgtaccccgtattacgttacgaagtaaccg

SEQ ID NO: 203461 - DNA, 739 bp, Homo sapiens
  misc_feature: GYAE6OF01B3AP5.36.4.A04.1.454.CMB.1.raw
tcagtacgctgtctcacgaccggtgctcgatttagagtagtgatcagggggaggaactgctcagttaggacccagagggaaccatggaagccccagctcagcttctcttcctcctgctactctggctcccagatactaccggagaaattgtgttgacacagtctccagccaccctgtctttgtctccgaggggaaagcgccaccctctcctgcagggccagtcagagtgttagcagtctacttagccttggtaccaacgagaaacctcggaccacggcctaccgaggcctcctcatctatgatacactcctacgacgggaccacgtcggctacgtcccagccgtaggttcaggtggacgtaggttcgggtactggggacaggtactttacactaccgtaccaacctacgtaccacgaccgtaacgtacccgtaacgtaaaccgttaggtaaagtttacgttttacggaaccgtttaagttttaacgtttacttcggtacctacggtacgtacggtacggtaacggtacgggttacccgtttccggggtacccggttaacggggtaaacccggtaaagggttacggtaagttaacgtaaccggtaaaccggtaaacggttacgggttacggtacccgttacggtacccgtaaccgttagtttccgttacggtttaccctttaccgtacccgtttccccgtttaccccggtacctttacgttaccggttaacggtaaaccg

SEQ ID NO: 203462 - DNA, 802 bp, Homo sapiens
  misc_feature: GYAE6OF01AEQ0G.36.4.A04.1.454.CMB.1.raw
tcagtacgctgtctcacgaccggtgctcgatttagagtagtgatcagggggaggaactgctcagttaggacccagagggaaccatggaagccccagctcagcttctcttcctcctgctactctggctcccagatactaccggagtaattgtgttgacacagtctccagccctaccctgttctttgtctccgaaggggaaacgacgcccaccctctcccgtgaccgacgggaccacgtcgaggtagtgttagcagtacctacttacgccgtacggtaacccaacgaacgtaaacccgtcggaccgaacggcctaccccgacggtccccttaccctacctattaccttagtcgtaacttaccgtaaccttacccgtaaccggaccggggtacccaccggttcggacctaacccgtccccgacggtacccggtacggttaccgtaagggtcggtaccggtacgggttcggggtaccggtacgggaaccgtacgtaaccgttccacgttccctacaaccctatcccgacgaccgtaaccgtaccgtaacgtaacctacggtaacgttagtttaccgttacgtttacgtttacgtttacgtagtaccgtacggtacgacggtaccggtaacggtaccggttcccgggtttacccggtacccggtagggtaaaccgtaaggttacgtaacgtaacctaacggtaaacgagttacggtgccgttacgaccctacttaccgttacgttcgttacccttccttaccgtttaccccgttacccgacccgttaacgtccgtaacgtaacccgg

SEQ ID NO: 203463 - DNA, 707 bp, Homo sapiens
  misc_feature: GYAE6OF01A202W.36.4.A04.1.454.CMB.1.raw
  modified_base (197)..(197): a, c, t, g, unknown or other
  misc_feature (197)..(197): n is a, c, g, or t
tcagtacgctgtctcacgaccggtgctcgatttagagtagtgatcagggggaggaactgctcagttaggacccagagggaaccatggaagccccagctcagcttctcttcctcctgctactctggctcccagatactaccggagtaaattgtgttgacacagtcctccagcccacctgtctttgctccagggtaaancgcccaccctctcctgcgagggccaggtcagtagtgttagcagtcctacgttgcctggtaacccaacgacgaaacctggaccaggcctacccgaggtcctcctcattccgtatgactacactaccctagaccggccactcggcactcccgagcccgtaggttcgaggtcggcgtaggttcgggcgttacggggacacgggtccttccgactccgaccacctatacacggaccacggtacctaacggaacccgttaggtaacgttaagttttcgaactttacggtttttaactacggttcgtaccgtaggtaccgaggtacggtacgggttacgttcccgggtttaccgggacccggtaacgggaaccgtaaagggttcggtaaacttacgtaaccgtaaaccgtaacggttggtaccgtacgttacggacctaaccggttaccgttcgttaccgttcttacccgttagttaccccccgtttacgacccttacgttccgtaaggtaaacgg

SEQ ID NO: 203464 - DNA, 672 bp, Homo sapiens
  misc_feature: GYAE6OF01B90PD.36.4.A04.1.454.CMB.1.raw
  modified_base (171)..(171): a, c, t, g, unknown or other
  misc_feature (171)..(171): n is a, c, g, or t
  modified_base (207)..(207): a, c, t, g, unknown or other
  misc_feature (207)..(207): n is a, c, g, or t
  modified_base (245)..(245): a, c, t, g, unknown or other
  misc_feature (245)..(245): n is a, c, g, or t
  modified_base (357)..(357): a, c, t, g, unknown or other
  misc_feature (357)..(357): n is a, c, g, or t
  modified_base (387)..(387): a, c, t, g, unknown or other
  misc_feature (387)..(387): n is a, c, g, or t
  modified_base (415)..(415): a, c, t, g, unknown or other
  misc_feature (415)..(415): n is a, c, g, or t
  modified_base (488)..(488): a, c, t, g, unknown or other
  misc_feature (488)..(488): n is a, c, g, or t
  modified_base (653)..(653): a, c, t, g, unknown or other
  misc_feature (653)..(653): n is a, c, g, or t
tcagtacgctgtctcacgaccggtgctcgatttagagtagtgatcgagggggaggaactgctcagttaggacccagagggaaccatggaacgccccagctcagcttctcttcctcctgtctactctggctcccagatacgtaccggagtaaattgtgttgacacagttccnccagcctacctgttctttgcctaccgaggggaaacncgcccaccctctcctgcgaggccagtcagagtggtacnagtctaacttcgccgtagtaaccaacgacgaaccgcggaccgacggcctccgacggtcctcctactatcctatacgacttacgactaccgtaccgcggacctagtcgctacnccacgtcgtgtcgaggcgtcgaggttcggntcgggactaggcttcgactcaccactanacgcgtacgaccgtcttaacgaactaggtaacgttcgtttagttacgttacgttttaaaccttgtcgtaacgnggactaggacggaggtaacggttcccggttaccggtacccggagggtaaccctaagggtaggtaaaccctttagaaaaccggtacggttaccgtaggtccggttacccgaagtcccgaacttacggttcctttacgtacttccgaaacccgttccaacccggttnaacgtttgaacggaaaccg

SEQ ID NO: 203465 - DNA, 736 bp, Homo sapiens
  misc_feature: GYAE6OF01DAVHD.36.4.A04.1.454.CMB.1.raw
  modified_base (199)..(199): a, c, t, g, unknown or other
  misc_feature (199)..(199): n is a, c, g, or t
  modified_base (422)..(422): a, c, t, g, unknown or other
  misc_feature (422)..(422): n is a, c, g, or t
tcagtacgctgtctcacgaccggtgctcgatttagagtagtgatcagggggaggaactgctcagttaggacccagagggaaccatggaagccccagctcagcttctcttcctcctgctactctggctccagatactaccggataaattgtgttgacacagtctccagcccacctgttctttgctaccgagggtaaacgngccctaccctctcctgaccgacggcctaagtcgaaggtagttgtagcgtaggtcctacgtttacgccgttacgggtaaaccaaacaacggtaaacccgtggacccaacgggtcctaccccgaggtccctacctcgaacttcgtaatcgtactaactaccgttacgtaaccggcgggaccctaaccgtcggacctacctaccccgaggtacccttacgggttanacggtcggtacgtgggttacgggtccggaggggaaccctacggtaccttaccaccttacctacccgaacttaaccgacgtacgaccgtaacgtacccgtaaacggtacgtaaccggtaagttacgttttaacggtacgtttaattttaaacgttacgttacgtacgacgtacgtaggtaacggtaacggtcggtccgttccgggtaaccggtaccggaacgtaagtacgaactaacgtaacgtaacgtagtgtacgacgtcaacgtacctagtcttgtcccttatccgttacctcccgtatacgtcgtaagacg

SEQ ID NO: 203466 - DNA, 847 bp, Homo sapiens
  misc_feature: GYAE6OF01BUI6K.36.4.A04.1.454.CMB.1.raw
  modified_base (145)..(145): a, c, t, g, unknown or other
  misc_feature (145)..(145): n is a, c, g, or t
  modified_base (202)..(202): a, c, t, g, unknown or other
  misc_feature (202)..(202): n is a, c, g, or t
tcagtacgctgtctcacgaccggtgctcgatttagagtagtgatcaggggggaggaactgctcagttaggacccaggagggaaccatggaagccccagctcagcttctcttcctcctgctactctggctccagatactaccgganaaattgtgttgacacagtctccacgccaccctgttctttcgtcctccgaggggaaanacgccacctctcctgcagggccagtcagagttgttagcagtcctacgttacgtccttaggtaacccaaacgaacgaaacccgttgggaccctaagggtccctacccgaacggtccttacccgtataacgttctaagtcgaacttaacctaacttaccccgtaacgaccggggtacccctaggttaccggacctaaccgttccccgaacggtccccggttaacgggtttacccagggttcggacggttagggtcgggttacgtacgggggacctaagtacccgttcctaaccgtctacccgaaccgtataccgacggactaacgtaccgtaaacggtaccgtaagtaacgtttagtttcggaacctttaaggttttaacttacggttaggttaacacggtacgtaccgggtacggtaacggtaccggtttacccggtttaccgggacccggttaacgggtaaacccggtaagggttaccggaaatttaaccggtaaccgggtaaaacgttccggttagggtaccggttaccgtaccggtaacctaacccggttagtttaccccggttcgtttacccgtttaaccgttacccgtttacccccgtttacccgtacccgttaaccgttacggtttaacccggaaaccgg

SEQ ID NO: 203467 - DNA, 733 bp, Homo sapiens
  misc_feature: GYAE6OF01CO9OP.36.4.A04.1.454.CMB.1.raw
  modified_base (495)..(495): a, c, t, g, unknown or other
  misc_feature (495)..(495): n is a, c, g, or t
  modified_base (527)..(527): a, c, t, g, unknown or other
  misc_feature (527)..(527): n is a, c, g, or t
  modified_base (677)..(677): a, c, t, g, unknown or other
  misc_feature (677)..(677): n is a, c, g, or t
  modified_base (712)..(712): a, c, t, g, unknown or other
  misc_feature (712)..(712): n is a, c, g, or t
tcagtacgctgtctcacgaccggtgctcgatttagagtagtgatcagggggaggaactgctcagttaggacccagagggaaccatggaagccccagctcagcttctcttcctcctgctactctggcctcccagatactaccggagtaaattgtgttgacacagtctccagcccacctgttctttgtcctccgaaggggaaagacgaccaccctctcctggcgacgggccagtcagagttgttagcagacttacttacggccgtacggtaaccaaacgaacgtaaacccgtgggaccaacgggtccctacccgaggtccttccctactacgttcctaagtacgtaactacctacttaccctaacggaacggggaccctacggtcggacctactaccccgacgtacccggtacggttccaggttgggaccgtagggttacggggtcgtaggggaaccgtaacggtaacctttcacgttcctacacacttcgacgacncgtaacctaacggtaaccttaggtaaacgttnttttacggaacttttacggtttaacttcgtacgtacgaacggtacgtacgggacggtagtacgggttccgtttacccggcccgtaagggtaaccgtaaggtcgtaaactacgtaaccgaaaggtaccgtgtcgtactaccggctaacgtntttcacggttcctttacgtacgtcccccgtttacngttacctagtacggtaaaccg

SEQ ID NO: 203468 - DNA, 795 bp, Homo sapiens
  misc_feature: GYAE6OF01CNJO6.36.4.A04.1.454.CMB.1.raw
  modified_base (499)..(499): a, c, t, g, unknown or other
  misc_feature (499)..(499): n is a, c, g, or t
tcagtacgctgtctcacgaccggtgctcgatttagagtagtgatcgagggggaggaactgctcagttaggaccagagggaaccatggaagcccagctcagcttctcttcctctgctactctggcctaccagtatacgtaccggaagtaaagttgtgttgacaacgtcgtcctaccacgccctacccttggtttcctttcggtctaccggaagggggaaaacgaccgccctacccgtctaccgtggacgacgggcctaggtcgaaggtaggttaggttacgcgtaagtacttaccgttacggccgtacgtacgacggacaacggtaaccgtggaccgacggacctacccgtaacggtcctaccttacgacttactaggtcggtacactacctccgaccggacgtaccgtacgtgtaccggtcccgtacgggtccggttacggaggttcggaggtacggtggtcggtagggactaggtcgtacggaccgtccacgtaaccngtacgacgtcgaacggtccgtacgtaacgagtaggttacgtaacgttacgttacgttacgttaagtttttagtacgttcgtaacgttacgtacgtaagttaacgttaacggttaacggtccggttacccgttaccgggtttaccgttaaccgggtttcgggaaaccggttacgggtaacggtaacgggtaggtaaacgttaacgaaacgggttaacgtacggtaccgggtaggtaccgtacgtaccgtaacgttacgttacttccttaccgtttacgtccctttccgttaaccccg

SEQ ID NO: 203469 - DNA, 734 bp, Homo sapiens
  misc_feature: GYAE6OF01A630E.36.4.A04.1.454.CMB.1.raw
  modified_base (197)..(197): a, c, t, g, unknown or other
  misc_feature (197)..(197): n is a, c, g, or t
tcagtacgctgtctcacgaccggtgctcgatttagagtagtgatcagggggaggaactgctcagttaggacccagagggaaccatggaagccccagctcagcttctcttcctcctgctactctggctcccagatactaccggagaaattggtgttgacacagtctccagccaccctgtctttgctccgaggggaaancgcccaccctctcctgcgacgggcagtcagtagtgttagcagctactagcctggtaccaacagaacctggccacggcctaccgaggcctacctcacttctatcgataactactaccctacgtcgggaccctacgtcggaccacgtccccaggcctagggttcagggtcgcgtaggtcgggtcgaggactagtaccgttcacgttccgtaccaacgtacgttccacggacctacgtaccgtacggtaacccgttaggtaaacgttagttttacggtacctttaagttttacgttaacttcggtacgtacggtactacgggtaggtaaccgggtacggttaccggtttacccggaacccggttaacggggaaacccgtaaggttaccgggtaaacttacgttaaaccggaaccgtaaacggttcggagggttaccctaggtaacccgttaccgtacgtttaccggttaccgttaccgtttaccgtaccccgtttacccggttaccccacccgtttataaccccggttaacggtaaccgg

SEQ ID NO: 203470 - DNA, 708 bp, Homo sapiens
  misc_feature: GYAE6OF01CV3VP.36.4.A04.1.454.CMB.1.raw
  modified_base (149)..(149): a, c, t, g, unknown or other
  misc_feature (149)..(149): n is a, c, g, or t
  modified_base (355)..(355): a, c, t, g, unknown or other
  misc_feature (355)..(355): n is a, c, g, or t
  modified_base (446)..(446): a, c, t, g, unknown or other
  misc_feature (446)..(446): n is a, c, g, or t
tcagtacgctgtctcacgaccggtgctcgatttagagtagtgatcgagggggaggaactgctcagttaggacccaggacgggaaccatggaacgccccagctcacgcttctcttcctcctgctactctggctccagactactaccgganaaattgtgttcgacacagtctcacgccacctgtcttgctccgagggaatcgccaccctctccgtgcgacgggccagtcaagtgtcgttagcagtccttactagcctaggtaccaactaagaacctggaccacggcctccgagcctcctcatctatcgatcgtactctacgcggcctacgtgaccacgtccgacgccgaggttccgngtacggcgtaggtggtcgtcgggactacggtcttcgacctccactaccctatcagaccgtacgtacctaaacggacctaagttaacggttnttttaccggactttaagtttaacgtcgttacgtaccgtaggtaacgcggtcggtaacgtaccgggtttcccggtaccggggtacccgttaacggggaaaccgtaaagggttaccggtaacgttaactaaaccgggtaacccggtaaaggttccggtcccggttaacgtaccggaacccttacggtaccgtttcggttacccggttccttaacccgtccggtttacccctaccccgacttacggttaacgtaacgtaaaccgg

SEQ ID NO: 203471 - DNA, 806 bp, Homo sapiens
  misc_feature: GYAE6OF01D2YC8.36.4.A04.1.454.CMB.1.raw
tcagtacgctgtctcacgaccggtgctcgatttagagtagtgatcagggggaggaactgctcagttaggacccagagggaaccatggaagccccagctcagcttctcttcctcctgctactctggctcccagatactaccggagaaattgtgttgacacagtcctccacgccctaccctgttctttgtctaccgaaggggaaagacgcccaccctctcctgcgacgggccagtcagtagtgtagcagtcttacgtacgccgtacggtaaccaacgaacgaaaccgtcggaccgacggccctacccgaacggtcctcctacacttactaagtacgtaactaccacgttacccgtaacggaccggggtaccctacggttcggacctaacccgtaccccgaacggtacccgtacgggttaccgagggtcggaccggtagggttcgggtaccgtaggggactacgtcttcgacctcacacctatacacgacgtacgtacctaacgtacgtagtaacgtttctttacggactttaagttttacttaccggtgtaaccggtacgcgtaacgggccgtaaggttaccgggttcccgtttaaccgggacccgggttaagggaaaaccgttaacggggttcggtaaaccttaacggtaaacccgggtaaacggtttacgttacggggtacgggtaccctaacgggtaccccgtaaactttccggtttaccggtttacctttcccgtttaacccgtaccccgttttacccccggttaccccaaccggtttaaccttcgggtaaacgaaaacccggg

SEQ ID NO: 203472 - DNA, 808 bp, Homo sapiens
  misc_feature: GYAE6OF01EOTH9.36.4.A04.1.454.CMB.1.raw
tcagtacgctgtctcacgaccggtgctcgatttagagtagtgatcagggggaggaactgctcagttaggacccagagggaaccatggaagccccagctcagcttctcttcctctgcctactctcgctcccagactactaccggaagtaaattgtgttcgacactagtctccacgcccaccttgttctttcgtctccgaaggggaaacgtacgccctaccctcctcctcggaccggacggggtacctacggtaccgtaaggtacgttagttaacgccgtacgtacctttaaccgttacgtcccgttaacggtaaaccccaaacgtaaacgtaaaacccgttcggacccgacggcccttacccggtaacggtcccttcctacctaactaccgttaatacgttaactaaccgtaacttccccgtaacgggaccggtaccggtaccgtcgggacctaccgtacccgacgtaccggttcggtaacctaggggtcgaccgtagggttcggtacggtagggaacctacggtaccttaccgaccttacgtaccacctgtacgacgaccaacgtactaaccaaccgttagttacgttacttacgtacgtttactttacgtacgttacgacgtacgacgcgtacggtacggtaccgttccgtaccggtaccgtaacggtaacgtagttacgtaagttaaacgaacgtaacgtacggttcgaccgtctaaccgtcctaaccgtttacgttacgttccgtaaccgtttcccttaccgtttaccccaacccgttaccaacgtttacgaaaccgtaaccggg

SEQ ID NO: 203473 - DNA, 891 bp, Homo sapiens
  misc_feature: GYAE6OF01BBKGP.36.4.A04.1.454.CMB.1.raw
tcagtacgctgtctcacgaccggtgctcgatttagagtagtgatcagggggtctcagagaggagccttagccctggactccaaggtcctttccacttggtgatcagcactgagcacagaggactcaccatggaagttggggctgagtcgtttcgggtttttccttggttgtcttattttagaaggtgtccagtgtgaggtgcagtcgtggtgggaggtcggtgggggaggtcgttcgggtccggacggggtcccgggggggtccctggacgtaccgtcctccgtggtcgcgacgtccttcgtggtacttctacttcgtttaggtagtttagtttagttagggtacgtttcggtaccggttccggggtccccgccggaccgggtccgtaccgggaaggggggtacggggcgtcggaccgggtgggtcggggtacggaccaaagtaaggtaaggaagaagtagggaaagtcggaagaacgtacgttaacgttaggttcgggtacggtacgttacggttaggggtaacgggtaacccggggtcctttaaccttacccgtaacccgttaaccccgttccgtaaaccggaaaaccgggaacccgtaaaacccccgggtaaacccggaaacccgtaaaccgtaaccctttacccgggttaaacgtttcgggttaaaacccttcgtaaacccggtaaacgttaaaaccgggttaacgaacccgtaacgggtaccccggggttaagggaacccggggaacggtaacccggggaacggtaaccgggtccggttagtttaaacggttcggtttaaaccgtgggttacggggacggtacggggaacccgttactaaaggtttggtacgggtttagggttccttaacgttaaaccgttaaggg

SEQ ID NO: 203474 - DNA, 836 bp, Homo sapiens
  misc_feature: GYAE6OF01BXKEU.36.4.A04.1.454.CMB.1.raw
  modified_base (103)..(103): a, c, t, g, unknown or other
  misc_feature (103)..(103): n is a, c, g, or t
  modified_base (572)..(572): a, c, t, g, unknown or other
  misc_feature (572)..(572): n is a, c, g, or t
  modified_base (592)..(592): a, c, t, g, unknown or other
  misc_feature (592)..(592): n is a, c, g, or t
  modified_base (813)..(813): a, c, t, g, unknown or other
  misc_feature (813)..(813): n is a, c, g, or t
tcagtacgctgtctcacgaccggtgctcgatttagagtagtgatcagggggtctcagagaggagccttagccctggactccaaggcctttccacttggtgatnagcactgagcacagaggactcaccagtggaagttggggctgagtcgttgggttttccttgttgtcttaagtttttagaaaggtgtaccgagttgtagaggtgcagctgggtggagtcgtgggggagtcgttaggccgagggtcccggggggtcctaggacgacttctaccgtggtcgccgtacggcctcgttggacttacatcgttaggtaagtttagttagttacggtaagtcgttaaccggttcgggtcccctacggtacgggtaccgtcccgggaaagggggtacgggtaccgtagggaccgttaaggggtcggggttaacggaacccgttaaaagtaagggtttaaacgggaagtcgtaaggggaattcgggaaataacgtaaacgtttaacggtaagttcggggacgttaaccgtaggttaccgggtaaagggtaccgggtaacctacgttaacccgaaccgtnttacccgtacgaacggtaanaaccccgtaaacgaacccgtaaacggtaacttccgaacgtttacgtaacttaccgtaaggaactaaacgtacgaaccgtagggccttaacgggaaggacggaccccggaagggtacccgaacggtcgtttaggtaccccgtaatttaaccgggtgggttacgggacccggggaaacgttaaacccaacgggtttaaccgtttaggtttaccggggtttaanaccgtttaaaccctttaaacggg

SEQ ID NO: 203475 - DNA, 664 bp, Homo sapiens
  misc_feature: GYAE6OF01BKZC0.36.4.A04.1.454.CMB.1.raw
tcagtacgctgtctcacgaccggtgctcgatttagagtagtgatcagggggaggaactgctcagttaggacccagagggaaccatggaagccccagctcagcttctcttcctcctgcctactctggctcccagatactaccggagaaattgtgttgacacagtctccagccaccctgtctttgctccgaggggaagcgccaccctctccgtgcgacgggccagtcgagtagtgtagcagcttactagccgtacggtaccaacgacgaaccgtggaccaggcctaccgacggtcctcctacactctagtacgactactactccgtaacggacggcctacgtcggaccacgtccccgagtccgtaggttcgaggtcggtcgtaggttcggggtactggggaactacgtacctttaccgacgtcctaccgacctactcgacgacaacggtaccgtaacgtaccgttagtaacgttagtttcgtacgtttaggtttaacttcgttacgtacgacgaccgtagggtacgtaacgggttcggttacccgtttcccgggaccggtagggtaacccgtaagggtacgtaacttacgtaacgtaaccgtagttcggacgtcgtacgacgtacctagttctcgtactccgtactccgtacccatactgtagacg

SEQ ID NO: 203476 - DNA, 902 bp, Homo sapiens
  misc_feature: GYAE6OF01BI3PO.36.4.A04.1.454.CMB.1.raw
  modified_base (176)..(176): a, c, t, g, unknown or other
  misc_feature (176)..(176): n is a, c, g, or t
tcagtacgctgtctcacgaccggtgctcgatttagagtagtgatcgagggggtaggaactgctcagttaggacccagagggaaccatggaagccccagctcagcttctcttcctcctgctactctggcctcccagtatacgtaccggaataaacttgtgttgactacgtagttccnccaacgccctaccctgttcctttcgcctaccggaaggggaaactcgcccgaacccgttctccgtcgaccgtacggccctagtaccgaggtagttgttacgacgtagttccgttaacgttcggcccttaggtaaacccaaacgaacgtaaacccgtcggaacccgacggtccctacccgtaaggtccccttacccgtacctaactttaccgttaagtacgtaacgttaaccgtaaccgtaccccgtaaccgggaaccggtaccctaaccggttccggaacctaccccgttaccccgaacggttacccggttaacgggttacgtaagggttccggaccggttaagggtttccggggtacgtaacggggtaaccctaaggttacccttacaccgttcctaacccgacgtactacgacgtaccgtacgtaaccgtaacgaaccgttagtaacgtttagtttaacgtaacgtttaagtttaacgttacgtttacgtacgtaacgtacgtaaccggtaacggaaggtttacccgggttaccggtttacccgggtccggttaaaccggggtaccgttaaagggtaacggtttaaccggtaaaccttaacggaaaacggttaccgtcggggtacgtaccgtaacctaccgtacctagtttacccggtcgttaccgtttacccacccggtttacctaccccgttagttaacccgttaacgtaacgttaaccccgg

SEQ ID NO: 203477 - DNA, 749 bp, Homo sapiens
  misc_feature: GYAE6OF01EU7EC.36.4.A04.1.454.CMB.1.raw
  modified_base (103)..(103): a, c, t, g, unknown or other
  misc_feature (103)..(103): n is a, c, g, or t
tcagtacgctgtctcacgaccggtgctcgattttagagtagtgatcgagggggaggaactgctcagttaggacccagagggaaccatggaagccccagctcancttctcttcctcctgctactctgctccagatactaccggagaatgtgttgacacagtctccacgcccacccttgtctttagtcctaccgaggggaaacgacgccaccctctccgtgccgacggggccagtcagtagtcgttagcagcttaacgtacgtcctagggtaaacccaaacggtaactaaacccgtcggaccgaacggacctccccggaccggtcctacctacgacttccgtatcgtactaactactccctaacggcggggacctaccgtgccgtactacccgacgtaccgtaggttccgaggtcggtacggtacgggttcggtcggtagggaactacggtccttacgacccttccaaccacctactcgtacgaccgacgtacctaacggtaaccctaggtaacgtttagtttctaacgtttatttactttagtcgttacgacgtaccgtaacgtacgggacggttaccgggtcggtttcccgggtacggtaacggaccgggttaaggtacggttaacgtaacgtaacggtaaggacccggttggtacgtaccgtcgaccgtaaccgttaagttccttaccggttaccttacccttaccgttcccgttaccccgaacttcccgttaagtcccgtaaaacgg

SEQ ID NO: 203478 - DNA, 880 bp, Homo sapiens
  misc_feature: GYAE6OF01BXSY6.36.4.A04.1.454.CMB.1.raw
  modified_base (201)..(201): a, c, t, g, unknown or other
  misc_feature (201)..(201): n is a, c, g, or t
tcagtacgctgtctcacgaccggtgctcgatttagagtagtgatcaggggggaggaactgctcagttaggacccagagggaaccatggaagccccagctcagcttctcttcctcctgctactctggctcccagatactaccggagtaaattgtgttgacacagtctccagccacctgttctttgtctaccgaaggggaaancgcccaccctctcctgcgacgggccagtcagagttgttagctagtcttacgtagccgtacggaccaacacgaaccgtcggaccgacggtcctacccgaggtccttcctactactactagtacactaccacgttaccgtacggacggccacgtcggctactcccgacgtccgtagttacgcggtacggcgtacggtcggggtcgtacgggtacacggttacttacctaccttacctcaaccctagtaccgacgtaccgaacggtaccctaaggtaacccgttaaggtaacgtttacgtttacgtaccgttttaaacgttttacgttaccggtacgtaaccggtacggtaaccgtaacgggtaccgggtaacgggtttacccgggtttcccccgggtttttaaacccggggaccccggggttaaaccggggttaaaaccggtaacgggggtttaaaccgggtaaacgttttaaacccggtaaaaccgtaaaccggggtttaaccggttacgggttccgggttaaacccgtaccgggtaaacccctttaaccggtttaaccggttttcccggtttaaacccgtttacccgtttaaacccgttaccccggttttaaccccccgttttacccccggaacttttaaccccgggtttaaaccggggtaacggtaaaaacccccggg

SEQ ID NO: 203479 - DNA, 709 bp, Homo sapiens
  misc_feature: GYAE6OF01DEGIS.36.4.A04.1.454.CMB.1.raw
  modified_base (300)..(300): a, c, t, g, unknown or other
  misc_feature (300)..(300): n is a, c, g, or t
  modified_base (515)..(515): a, c, t, g, unknown or other
  misc_feature (515)..(515): n is a, c, g, or t
tcagtacgctgtctcacgaccggtgctcgatttagagtagtgatcagggggtctcagagaggagccttagccctggactccgaaggcctttccacttggtgatcagcactgagcacagaggactcaccatggaagttggggactgagcgttgggttttccttgttgcttattttagaaggtgtccagtgtggaggtgcagcgtggtggtacggtcgtggggggagcgttcgggttaccggagggtcccgggggggtccctggaagaccttctcccgtgtcgacacgcctcgtggtacttnattcttagtaatagttacgtgatgtacgttcggccgtacaggcctacggagggaacgggtctagcgtaagtggggtacgaccaaactagttaaaggaagtacggtaagtagtacgaagtactaataccgtatggtacgtaactgtaggtacgaaacgggtcaacttaccgacctatcctaaccgaagacaaaccggaaactaccgaactaacccncgtaacctgttacctaaccgactaaacgaagttaacaacgtaccgtacgtaggaacggcggaaccgaagggtacccgtaacgggttactaggttacggttacgttaaaccgtagggttcgggaaaccggtaacgggtacccctaaaagtttacgttaagggttttgggtaacttcccgttaaagtttaaaaggg

SEQ ID NO: 203480 - DNA, 630 bp, Homo sapiens
  misc_feature: GYAE6OF01APJ1F.36.4.A04.1.454.CMB.1.raw
  modified_base (144)..(144): a, c, t, g, unknown or other
  misc_feature (144)..(144): n is a, c, g, or t
  modified_base (198)..(198): a, c, t, g, unknown or other
  misc_feature (198)..(198): n is a, c, g, or t
  modified_base (285)..(285): a, c, t, g, unknown or other
  misc_feature (285)..(285): n is a, c, g, or t
  modified_base (299)..(299): a, c, t, g, unknown or other
  misc_feature (299)..(299): n is a, c, g, or t
  modified_base (356)..(356): a, c, t, g, unknown or other
  misc_feature (356)..(356): n is a, c, g, or t
  modified_base (372)..(372): a, c, t, g, unknown or other
  misc_feature (372)..(372): n is a, c, g, or t
  modified_base (378)..(378): a, c, t, g, unknown or other
  misc_feature (378)..(378): n is a, c, g, or t
tcagtacgctgtctcacgaccggtgctcgatttagagtagtgatcagggggaggaactgctcagttaggacccagagggaaccatggaagccccagctcagcttctcttcctcctgctactctggctcccagatactaccgganaaattgtgttgacacagtctccagcccaccctgtctttgtctccgagggggaanacgccaccctctcctgcagggccagtcagagtgtagcagctacttgcctggtaccaacagaacctggccaggcctcccgaggcctcncatctatgactacncttcctaacgaggccactggcactcccgagtcctaggttcaggtggcaggtgggtcngggaccaggtaccttnaccgtntacccactatccagcacgtcctaagaacctagtaagtagtttacgacgttatttattacttacgttacacgtctacggacggtacgttacggtaccgtttcccgggcccgtacgggaaccgtaaacgggttcggaacttacgtaccgaaacgtacgtcggtacgggtactcggacccgtaccgtagttccgtcgtttacccttaccttacgtttcccgttaccccgtacctacgttacccgtggtaaacccg

SEQ ID NO: 203481 - DNA, 503 bp, Homo sapiens
  misc_feature: GYAE6OF02F6XSX.36.4.A04.1.454.CMB.1.raw
tcagtacgctgtctcacgaccggtgctcgatttagagtagtgatcagggggaggaactgctcagttaggacccagagggaaccatggaagccccagctcagcttctcttcctcctgctactctggctcccagatactaccggagaaattgtgttgacacagtctccagccaccctgtctttgtctccagggtaaagagccaccctctcctgcagggccagtcagagtgttagcagctacttagcctggtaccaacagaaacctggccaggctcccaggctcctcatctatgatacatcctacagggccactggcatcccagccaggttcagtggcagtgggtctgggacagacttcactctcaccatcagcagcctagaacctgaagattttgctagtttattactgtcagcagcgagaggctttcggccctgggaccaaagtggatatacaaacgaactgtggctgcacatctgtcttcattcttcccgctactctagaacg

SEQ ID NO: 203482 - DNA, 512 bp, Homo sapiens
  misc_feature: GYAE6OF02H5CCA.36.4.A04.1.454.CMB.1.raw
  modified_base (366)..(366): a, c, t, g, unknown or other
  misc_feature (366)..(366): n is a, c, g, or t
  modified_base (483)..(483): a, c, t, g, unknown or other
  misc_feature (483)..(483): n is a, c, g, or t
tcagtacgctgtctcacgaccggtgctcgatttagagtagtgatcagggggaggaactgctcagttaggacccagagggaaccatggaagccccagctcagcttctcttcctcctgctactctggctcccagatactaccggagaaattgtgttgacacagtctccagccaccctgtctttgtctccaggggaagagccaccctctcctgcagggccagtcagagtgttagcagctacttagcctggtaccaacagaaacctggccaggctcccaggcctcctcatctatgatacatcctacagggccatggcatcccagccaggttcagtgcagtgggtctgggacagacttcacttctacaccntccagcagcctagaacctgaagtattttgctagtttatactgtacagcagcgagaggtcttcggccctagggaccaaaggtgaactatacgaaacgtactgtcggctagcacattcngttctcactccttcccgctatcagtaacg

SEQ ID NO: 203483 - DNA, 502 bp, Homo sapiens
  misc_feature: GYAE6OF02HKAUH.36.4.A04.1.454.CMB.1.raw
tcagtacgctgtctcacgaccggtgctcgatttagagtagtgatcagggggaggaactgctcagttaggacccagagggaaccatggaagccccagctcagcttctcttcctcctgctactctggctcccagatactaccggagaaattgtgttgacacagtctccagccaccctgtctttgtctccaggggaaagagccaccctctcctgcagggccagtcagagtgttagcagctacttagcctggtaccaacagaaacctggccaggctcccaggctcctcatctatgatacatcctacagggccactggcatcccagccaggttcagtggcagtgggtctgggacagacttcactctcaccatcagcagcctagaacctgaagattttgctagtttattactgtcagcagcgagaggctttcggccctgggaccaaagtggatatacaaacgaactgtgctgcacatctgtcttcacttctcccgcctactctgaacg

SEQ ID NO: 203484 - DNA, 496 bp, Homo sapiens
  misc_feature: GYAE6OF02FS5T3.36.4.A04.1.454.CMB.1.raw
  modified_base (197)..(197): a, c, t, g, unknown or other
  misc_feature (197)..(197): n is a, c, g, or t
  modified_base (419)..(419): a, c, t, g, unknown or other
  misc_feature (419)..(419): n is a, c, g, or t
  modified_base (446)..(446): a, c, t, g, unknown or other
  misc_feature (446)..(446): n is a, c, g, or t
tcagtacgctgtctcacgaccggtgctcgatttagagtagtgatcagggggaggaactgctcagttaggacccagagggaaccatggaagccccagctcagcttctcttcctcctgctactctggctcccagatactaccggagaaattgtgttgacacagtctccagccaccctgtctttgtctccaggggaaagngccaccctctcctgcagggccagtcagagtgttagcagctacttagcctggtaccaacagaaacctggccaggctcccaggctcctcatctatgatacatcctacagggccactggcatcccagccaggttcagtggcagtgggtctgggacagacttcactctcaccatcagcagcctagacctgaagtattttgctagtttattactgtcagcagcgagnggctttcggcctgggaccaagtgatanacaaacgactgtgctgcacatctctcttcatccttcccgcactctgaacg

SEQ ID NO: 203485 - DNA, 505 bp, Homo sapiens
  misc_feature: GYAE6OF02I149L.36.4.A04.1.454.CMB.1.raw
  modified_base (196)..(196): a, c, t, g, unknown or other
  misc_feature (196)..(196): n is a, c, g, or t
  modified_base (302)..(302): a, c, t, g, unknown or other
  misc_feature (302)..(302): n is a, c, g, or t
  modified_base (493)..(493): a, c, t, g, unknown or other
  misc_feature (493)..(493): n is a, c, g, or t
tcagtacgctgtctcacgaccggtgctcgatttagagtagtgatcagggggaggaactgctcagttaggacccagagggaaccatggaagccccagctcagcttctcttcctcctgctactctggctcccagatactaccggagaaattgtgttgacacagtctccagccaccctgtctttgtctccaggggaaanagccaccctctcctgcagggccagtcagagtgttagcagctacttagcctggtaccaacagaaacctggccaggctcccaggctcctcatctatgatacatcctanagggccactggcatcccagccaggttcagtgcagtgggtctgggacagacttcactctcaccatcagcagcctagaacctagaagtatttgctagtttattactgtcagcagcgagaggtcttcggccgtaggaccaagtggatatacaaacgactgtgcagccacatcgtgttcttctacttccttcccnctactctgaacg

SEQ ID NO: 203486 - DNA, 525 bp, Homo sapiens
  misc_feature: GYAE6OF02HNPJ8.36.4.A04.1.454.CMB.1.raw
tcagtacgctgtctcacgaccggtgctcgatttagagtagtgatcagggggaggaactgctcagttaggacccagagggaaccatggaagccccagctcagcttctcttcctcctgctactctggctcccagatactaccggagaaattgtgttgacacagtctccagccaccctgtctttgtctccaggggaaagagccaccctctcctgcagggccagtcagagtgttagcagctacttagcctggtaccaacagaaacctggccaggctcccaggctcctcatctatgatacatcctacgagggccactggcactcccagccaggttcagtggcaggtgggtctgggacagacttcactctcaccatcagcagcctagaacctgaagtattttgctagtttattactgtacagcagcgagacggtctttcggcccgttagggaccaaaggtggactaatacgaaacgaacgtgtggactggccaaccatctgttccttcacttcctcccgcctatctgaacg

SEQ ID NO: 203487 - DNA, 511 bp, Homo sapiens
  misc_feature: GYAE6OF02G9NH7.36.4.A04.1.454.CMB.1.raw
  modified_base (197)..(197): a, c, t, g, unknown or other
  misc_feature (197)..(197): n is a, c, g, or t
tcagtacgctgtctcacgaccggtgctcgatttagagtagtgatcagggggaggaactgctcagttaggacccagagggaaccatggaagccccagctcagcttctcttcctcctgctactctggctcccagatactaccggagaaattgtgttgacacagtctccagccaccctgtctttgtctccaggggaaagngccaccctctcctgcagggccagtcagagtgttagcagctacttagcctggtaccaacagaaacctggccaggctcccaggctcctcatctatgatacatcctacagggccactggcatcccagccaggttcagtggcagtgggtctgggacagacttcactctcaccatcagcagcctagaacctgaagtattttgactagtttattactgtcagcagcgagaggtctttcggcccgtgggaccaaagtggatatacaaacgactgtgctgacacatctcgttcttctactccttcccgctactctagtaacg

SEQ ID NO: 203488 - DNA, 518 bp, Homo sapiens
  misc_feature: GYAE6OF02HSD96.36.4.A04.1.454.CMB.1.raw
  modified_base (255)..(255): a, c, t, g, unknown or other
  misc_feature (255)..(255): n is a, c, g, or t
  modified_base (349)..(349): a, c, t, g, unknown or other
  misc_feature (349)..(349): n is a, c, g, or t
tcagtacgctgtctcacgaccggtgctcgatttagagtagtgatcagggggaggaactgctcagttaggacccagagggaaccatggaagccccagctcagcttctcttcctcctgctactctggctcccagatactaccggagaaattgtgttgacacagtctccagccaccctgtctttgtctccaggggaaagagccaccctctcctgcagggccagtcagagtgttagcagctacttagcctggtaccaanagaaacctggccaggctcccaggctcctcatctatgatacatcctacagggcccatggcatcccagccaggttcagtgcagtgggtctgggacngacttcactctcaccatcagcagcctagaacctgaagtattttgctagtttatactgtacagcagcgagaggtctttcggcccgtgggaacccaaaggtggattaactacgaaacgaactgtcggactggacacctatctgttcttctatccttcccgctatctgaacg

SEQ ID NO: 203489 - DNA, 567 bp, Homo sapiens
  misc_feature: GYAE6OF02I1Z6A.36.4.A04.1.454.CMB.1.raw
  modified_base (196)..(196): a, c, t, g, unknown or other
  misc_feature (196)..(196): n is a, c, g, or t
  modified_base (255)..(255): a, c, t, g, unknown or other
  misc_feature (255)..(255): n is a, c, g, or t
tcagtacgctgtctcacgaccggtgctcgatttagagtagtgatcagggggaggaactgctcagttaggacccagagggaaccatggaagccccagctcagcttctcttcctcctgctactctggctcccagatactaccggagaaattgtgttgacacagtctccagccaccctgtctttgtctccaggggaaanagccaccctctcctgcagggccagtcagagtgttagcagctacttagcctggtaccaanagaaacctggccaggcctcccaggctcctcatctatgatacatccctacgacgggccacgtggccactcccgagcctaggttcaggtcggcaggtgggtctggggacagtacttcactctcaccatcagcagcctaagaacctgaacgtagttttgacttagtttattacgtgtacagcagacgagtaggtcgtttccggccgtagggaacctaagggtggaacttacgtaacgaaacggtaacgtggtacggtactcgactaacctagttctgttaccttctacgttccttcccgactacttcgtagaacg

SEQ ID NO: 203490 - DNA, 496 bp, Homo sapiens
  misc_feature: GYAE6OF02GOF9T.36.4.A04.1.454.CMB.1.raw
  modified_base (418)..(418): a, c, t, g, unknown or other
  misc_feature (418)..(418): n is a, c, g, or t
  modified_base (457)..(457): a, c, t, g, unknown or other
  misc_feature (457)..(457): n is a, c, g, or t
tcagtacgctgtctcacgaccggtgctcgatttagagtagtgatcagggggaggaactgctcagttaggacccagagggaaccatggaagccccagctcagcttctcttcctcctgctactctggctcccagatactaccggagaaattgtgttgacacagtctccagccaccctgtctttgtctccaggggaaagagccaccctctcctgcagggccagtcagagtgttagcagctacttagcctggtaccaacagaaacctggccaggctcccaggctcctcatctatgatacatcctacagggccactggcatcccagccaggttcagtggcagtgggtctgggacagacttcactctcaccatcagcagcctagacctgaagtatttgctagtttattactgtcagcagcgagnggtcttcggcctgggaccaagtgatatacaaacgactgngctgcacatctgtcttcacttcctcccgctatctgaacg

SEQ ID NO: 203491 - DNA, 518 bp, Homo sapiens
  misc_feature: GYAE6OF02FT6CP.36.4.A04.1.454.CMB.1.raw
tcagtacgctgtctcacgaccggtgctcgatttagagtagtgatcagggggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtctgggggaggcttggtccagccgggggggtccctgagactctcctgtgcagcctctggattcatcttgagtagttattggatgacttgggtccgccaggctccagggaaggggctgcagtgggtggccaacattaagggaagatgggaagtgagacatactatgtggactctgtgaagggcgattcaccatctccagagacaacgccaaagaactcactgtatctgacaaatgaacagcctgagaggcgaggacacggctgtgtattactgtgcggaggggaccaacgtatagttgggtttaggcgtatttaacg

SEQ ID NO: 203492 - DNA, 578 bp, Homo sapiens
  misc_feature: GYAE6OF02JJUQZ.36.4.A04.1.454.CMB.1.raw
  modified_base (196)..(196): a, c, t, g, unknown or other
  misc_feature (196)..(196): n is a, c, g, or t
  modified_base (228)..(228): a, c, t, g, unknown or other
  misc_feature (228)..(228): n is a, c, g, or t
tcagtacgctgtctcacgaccggtgctcgatttagagtagtgatcagggggaggaactgctcagttaggacccagagggaaccatggaagccccagctcagcttctcttcctcctgctactctggctcccagatactaccggagaaattgtgttgacacagtctccagccaccctgtctttgtctccaggggaaanagccaccctctcctgcagggccagtcagagtnttagcagctacttagcctggtaccaacagaaacctggccaggctcccaggctacctcatcctatgatacactcctacacgggccactggcactcccagccctaggttccagtggcagtcgggtctgggacaggtacttcactctcacactcagcacgacctagaacctagaagtattttcgactagtttaacttactgttacagtcgaggccgaagtacggtccgtttccggccgtggaaccgaaagtcggatacgtacaaaccgagttacggtacggcttagcctaaccgtatacgttacgttactttaccgactttcctttaccccgaccttacgtaccttagaaacg

SEQ ID NO: 203493 - DNA, 739 bp, Homo sapiens
  misc_feature: GYAE6OF02JUVJ6.36.4.A04.1.454.CMB.1.raw
tcagtacgctgtctcacgaccggtgctcgatttagagtagtgatcagggggtctcagagaggagccttagccctggactccaaggcctttccacttggtgatcagcactgagcacagaggactcaccatggaattggggctgagcttgggttttccttgttgctattttagaagtgtccagtgtgaggtgcagctggtggagtcgtgggggaggcttggtccgaggccgggggggtccctgagactcgtcctgtgcagcctcgtgattcatcttgagtagttagtggatggtacttcgggtcccgccgacggtcctaccgaaggggaacggggcgtggacgtaggtgggtacgaccgaaacgtagttaaaggaagagttaggggaaagtggaacgaacgtaacgttaacgtaagtcggtacggtaccttcgtaggtagggtaaacggggtcccgtaatttacccaaacccgtagttacccgtacccgaaaggtaaccgtaaacccgaaaccggccccaaaaagggacctttaccgaaccgtttaggttaactccgtaacgacgtaaaaacttcggaaacctacgccggttaacgaagggccggtaacggaacggtaaccctaacgggtccgttaggtttacgttaacgttccgggttagtccgggaaccggggtaaccgggtaccctaaacgtttgtaacgggttttcggggtaggttaacccggtaattttaaacggg

SEQ ID NO: 203494 - DNA, 470 bp, Homo sapiens
  misc_feature: GYAE6OF02IEABL.36.4.A04.1.454.CMB.1.raw
  modified_base (261)..(261): a, c, t, g, unknown or other
  misc_feature (261)..(261): n is a, c, g, or t
  modified_base (273)..(273): a, c, t, g, unknown or other
  misc_feature (273)..(273): n is a, c, g, or t
  modified_base (278)..(278): a, c, t, g, unknown or other
  misc_feature (278)..(278): n is a, c, g, or t
  modified_base (285)..(285): a, c, t, g, unknown or other
  misc_feature (285)..(285): n is a, c, g, or t
  modified_base (314)..(314): a, c, t, g, unknown or other
  misc_feature (314)..(314): n is a, c, g, or t
  modified_base (322)..(322): a, c, t, g, unknown or other
  misc_feature (322)..(322): n is a, c, g, or t
  modified_base (326)..(329): a, c, t, g, unknown or other
  misc_feature (326)..(329): n is a, c, g, or t
  modified_base (331)..(332): a, c, t, g, unknown or other
  misc_feature (331)..(332): n is a, c, g, or t
  modified_base (334)..(334): a, c, t, g, unknown or other
  misc_feature (334)..(334): n is a, c, g, or t
  modified_base (336)..(336): a, c, t, g, unknown or other
  misc_feature (336)..(336): n is a, c, g, or t
  modified_base (338)..(338): a, c, t, g, unknown or other
  misc_feature (338)..(338): n is a, c, g, or t
  modified_base (340)..(341): a, c, t, g, unknown or other
  misc_feature (340)..(341): n is a, c, g, or t
  modified_base (343)..(343): a, c, t, g, unknown or other
  misc_feature (343)..(343): n is a, c, g, or t
  modified_base (345)..(345): a, c, t, g, unknown or other
  misc_feature (345)..(345): n is a, c, g, or t
  modified_base (347)..(348): a, c, t, g, unknown or other
  misc_feature (347)..(348): n is a, c, g, or t
  modified_base (354)..(354): a, c, t, g, unknown or other
  misc_feature (354)..(354): n is a, c, g, or t
  modified_base (356)..(357): a, c, t, g, unknown or other
  misc_feature (356)..(357): n is a, c, g, or t
  modified_base (359)..(360): a, c, t, g, unknown or other
  misc_feature (359)..(360): n is a, c, g, or t
  modified_base (367)..(367): a, c, t, g, unknown or other
  misc_feature (367)..(367): n is a, c, g, or t
  modified_base (369)..(369): a, c, t, g, unknown or other
  misc_feature (369)..(369): n is a, c, g, or t
  modified_base (372)..(372): a, c, t, g, unknown or other
  misc_feature (372)..(372): n is a, c, g, or t
  modified_base (374)..(374): a, c, t, g, unknown or other
  misc_feature (374)..(374): n is a, c, g, or t
  modified_base (382)..(382): a, c, t, g, unknown or other
  misc_feature (382)..(382): n is a, c, g, or t
  modified_base (384)..(384): a, c, t, g, unknown or other
  misc_feature (384)..(384): n is a, c, g, or t
  modified_base (386)..(387): a, c, t, g, unknown or other
  misc_feature (386)..(387): n is a, c, g, or t
  modified_base (389)..(389): a, c, t, g, unknown or other
  misc_feature (389)..(389): n is a, c, g, or t
  modified_base (395)..(395): a, c, t, g, unknown or other
  misc_feature (395)..(395): n is a, c, g, or t
  modified_base (418)..(418): a, c, t, g, unknown or other
  misc_feature (418)..(418): n is a, c, g, or t
  modified_base (423)..(423): a, c, t, g, unknown or other
  misc_feature (423)..(423): n is a, c, g, or t
  modified_base (430)..(430): a, c, t, g, unknown or other
  misc_feature (430)..(430): n is a, c, g, or t
  modified_base (432)..(432): a, c, t, g, unknown or other
  misc_feature (432)..(432): n is a, c, g, or t
  modified_base (434)..(434): a, c, t, g, unknown or other
  misc_feature (434)..(434): n is a, c, g, or t
  modified_base (443)..(443): a, c, t, g, unknown or other
  misc_feature (443)..(443): n is a, c, g, or t
  modified_base (461)..(461): a, c, t, g, unknown or other
  misc_feature (461)..(461): n is a, c, g, or t
  modified_base (467)..(467): a, c, t, g, unknown or other
  misc_feature (467)..(467): n is a, c, g, or t
tcagtacgctgtctcacgaccggtgctcgatttagagtagtgatcagggggagggaacgtgctcagttaggacccagagggaaccatggaagccccagctcagcttctcttcctcctgctactctggctcccagattacaccggagaaattgtgttgacacaggtctccagcctaccctgtctttgctccgaaggggaaagagccaccctctccgcgcagggccaagtcatacgtgttagcagctacttaggcctgaccanagaacctgcagnttccngcttcanatcatggatacatccgacaggcccattgntaaacccngtcnnnngnngngngngnngntncnncacacncnncnncacacananatntntatatatntnannangagagngtcgtcgtcgacgaacgagatanacaanaagtagngngngcgacactntctctctactctcctccnctctanacg

SEQ ID NO: 203495 - DNA, 548 bp, Homo sapiens
  misc_feature: GYAE6OF02G5L83.36.4.A04.1.454.CMB.1.raw
  modified_base (196)..(196): a, c, t, g, unknown or other
  misc_feature (196)..(196): n is a, c, g, or t
  modified_base (255)..(255): a, c, t, g, unknown or other
  misc_feature (255)..(255): n is a, c, g, or t
tcagtacgctgtctcacgaccggtgctcgatttagagtagtgatcagggggaggaactgctcagttaggacccagagggaaccatggaagccccagctcagcttctcttcctcctgctactctggctcccagatactaccggagaaattgtgttgacacagtctccagccaccctgtctttgtctccaggggaaanagccaccctctcctgcagggccagtcagagtgttagcagctacttagcctggtaccaanagaaacctggccaggcctcccaggcctcctcatctatgatacatcctacagggccactggcatcccagccaggttcaggttggcaggtggggtctgggacagacttcactctcaccatcagcagcctagactgaatatttgactagtttatactgtcagctagcgagacggtccgtttcgggcccttaggggacctaaaggtggtaatataaccgaaacgtaacgtggtgctgaccgaccgtattcctcgtctttacactttccgttccccgaccttctaccgtagtaaccgg

SEQ ID NO: 203496 - DNA, 666 bp, Homo sapiens
  misc_feature: GYAE6OF02HWBBI.36.4.A04.1.454.CMB.1.raw
tcagtacgctgtctcacgaccggtgctcgatttagagtagtgatcaggggggaggaactgctcagttaggacccagagggaaccatggaagccccagctcagcttctcttcctcctgctactctggctcccagatactaccggagaaattgtgttgacacggtctccagccaccctgttctttcgttctccgaggggaaagagccaccctctcctcgcgagggccagtcagagtgttagcagcttacttacgccgtacggtaccaacaagaaacctcggaccgaggcctcccgacggctcctcatctatgatacactcctacgacgggccacgtcgcactcccgacgaccgaggttcgaggtacggcgtagggtcggtcggtagggacgagtacctttcactcctaccaccactacgacacgacgtacctagaaaccctaggaaagtttacttttgacttaagtttaacttacgtcgttacacggcgaaggcgaaggtacgggttccgtttaccgggacccgtacggggtaaacctaaagggtcggaacttaacgtaacctaaaaacgggtagttggtacgggccttacgacctaacccgttattcccgtttagttcctttaccgtaccgtttccctcccggtacctacgttacacggtaacgacg

SEQ ID NO: 203497 - DNA, 606 bp, Homo sapiens
  misc_feature: GYAE6OF02HJT1A.36.4.A04.1.454.CMB.1.raw
  modified_base (196)..(196): a, c, t, g, unknown or other
  misc_feature (196)..(196): n is a, c, g, or t
tcagtacgctgtctcacgaccggtgctcgatttagagtagtgatcagggggaggaactgctcagttaggacccagagggaaccatggaagccccagctcagcttctcttcctcctgctactctggctcccagatactaccggagaaattgtgttgacacagtctccagccaccctgtctttgtctccaggggaaangccaccctctcctgcagggccagtcagagtgttagcagctacttagcctggtatcaacaaaaagctggccaggctccaggctctcatctatgatgcttcaaaggccctggcatccaacaggttcagtgccagtggtctgggacagacttcactctcaccatcagcagcctagacgcctagaacgtattttgctaacttttagttactgttacaaactacgtcgtaacctaaacgtgggtaccggtacgtttcggaccgtaaaggggaccctaaagggtacgaacgggttaccaaaacggtaaacgttggtacgggaccttaggcctaacccgtaagttccttacggttcctttacctaacgttcccgtttaccccggacccttacgttaccttacggtaaagtaacccgg

SEQ ID NO: 203498 - DNA, 548 bp, Homo sapiens
  misc_feature: GYAE6OF02H5CAZ.36.4.A04.1.454.CMB.1.raw
  modified_base (195)..(195): a, c, t, g, unknown or other
  misc_feature (195)..(195): n is a, c, g, or t
  modified_base (378)..(378): a, c, t, g, unknown or other
  misc_feature (378)..(378): n is a, c, g, or t
  modified_base (503)..(503): a, c, t, g, unknown or other
  misc_feature (503)..(503): n is a, c, g, or t
tcagtacgctgtctcacgaccggtgctcgatttagagtagtgatcagggggaggaactgctcagttaggacccagagggaaccatggaagccccagctcagcttctcttcctcctgctactctggctcccagatactaccggagaaattgtgttgacacagtctccagccaccctgtctttgtctccaggggaanagccaccctctcctgcagggccagtcagagtgttagcagctacttagcctggtaccaacagaacctggaccaggctccaggctcctcatctatgatacatcctacgacgggcccacgtggcctactccccagcccgtaggttccaggtggcaggtgggtctgggacagacttcactctacacntcagcagactagaacctgtaatatttgactagtttacttagtgactagacaggcgagtacggtccgtttcggccgtagggtaccaaggtcgtaactacgtaacgaaacgtacgtgtgactgaccncacttcgacgttccttatactcctcccgacctactcctagtaacg

SEQ ID NO: 203499 - DNA, 596 bp, Homo sapiens
  misc_feature: GYAE6OF02I35RY.36.4.A04.1.454.CMB.1.raw
  modified_base (196)..(196): a, c, t, g, unknown or other
  misc_feature (196)..(196): n is a, c, g, or t
  modified_base (302)..(302): a, c, t, g, unknown or other
  misc_feature (302)..(302): n is a, c, g, or t
  modified_base (407)..(407): a, c, t, g, unknown or other
  misc_feature (407)..(407): n is a, c, g, or t
tcagtacgctgtctcacgaccggtgctcgatttagagtagtgatcagggggaggaactgctcagttaggacccagagggaaccatggaagccccagctcagcttctcttcctcctgctactctggctcccagatactaccggagaaattgtgttgacacagtctccagccaccctgtctttgtctccaggggaaangccaccctctcctgcagggccagtcagagtgttagcagctacttagcctggtaaccaacagaaacctggccaggctcccaggctcctcatctatgatacatcctanagggtcccattcggccacgtcccagcccaaggttcaggttgccgtagtgggtctgggacaggtcttcactctacaccatcacgtcaggtcctaagacctgaagtntttgactagtttatactgttcgagtcgagcgaggtcggtccgtttaccggccgtacgggtaaccgtaagtacggtaactacgtaacgaaacggtaactaggttacggcttacgccgtaacctactacgttacgttcgttaccgtaactttccgttaccccgaccgttacgttaccgttaggtaaaccgg

SEQ ID NO: 203500 - DNA, 510 bp, Homo sapiens
  misc_feature: GYAE6OF02HWYR0.36.4.A04.1.454.CMB.1.raw
  modified_base (195)..(195): a, c, t, g, unknown or other
  misc_feature (195)..(195): n is a, c, g, or t
  modified_base (254)..(254): a, c, t, g, unknown or other
  misc_feature (254)..(254): n is a, c, g, or t
  modified_base (395)..(395): a, c, t, g, unknown or other
  misc_feature (395)..(395): n is a, c, g, or t
  modified_base (467)..(467): a, c, t, g, unknown or other
  misc_feature (467)..(467): n is a, c, g, or t
  modified_base (477)..(477): a, c, t, g, unknown or other
  misc_feature (477)..(477): n is a, c, g, or t
  modified_base (498)..(498): a, c, t, g, unknown or other
  misc_feature (498)..(498): n is a, c, g, or t
tcagtacgctgtctcacgaccggtgctcgatttagagtagtgatcagggggaggaactgctcagttaggacccagagggaaccatggaagccccagctcagcttctcttcctcctgctactctggctcccagatactaccggagaaattgtgttgacacagtctccagccaccctgtctttgctccaggggaaangccaccctctcctgcagggccagtcagagtgttagcagctacttagcctggtaaccaanagaaacctggccaggctcccaggctcctcatctatgatacatcctacgagggccacgtggcactcccagccaggttcagtggctaggtcgggtctgggacagacttcgactctcaccatcagcagcctagaacctgaagtntttgcttagtttatctgtcagcagcgagcggtcgttcggccgtaggaccaagtggacttagacaaacgatgngctgacactntctgtcttcacttccttcccnctactcagaacg

SEQ ID NO: 203501 - DNA, 570 bp, Homo sapiens
  misc_feature: GYAE6OF02INNJH.36.4.A04.1.454.CMB.1.raw
  modified_base (345)..(345): a, c, t, g, unknown or other
  misc_feature (345)..(345): n is a, c, g, or t
  modified_base (376)..(376): a, c, t, g, unknown or other
  misc_feature (376)..(376): n is a, c, g, or t
  modified_base (380)..(380): a, c, t, g, unknown or other
  misc_feature (380)..(380): n is a, c, g, or t
  modified_base (429)..(429): a, c, t, g, unknown or other
  misc_feature (429)..(429): n is a, c, g, or t
  modified_base (513)..(513): a, c, t, g, unknown or other
  misc_feature (513)..(513): n is a, c, g, or t
  modified_base (521)..(521): a, c, t, g, unknown or other
  misc_feature (521)..(521): n is a, c, g, or t
tcagtacgctgtctcacgaccggtgctcgatttagagtagtgatcagggggaggaactgctcagttaggacccagagggaaccatggaagcccccagctcagcttctcttcctcctgctactctggctcccagatactaccggagaaattgtgttgacacggtctccagccaccctgtctttgtctccaggggaagagccaccctctcctgcagggccagtcagagtgttagcagctacttagcctcggtacaacagaaacctggccaggcctccccaggctcctcatctatgactacatcctaacgagggccacgtggcactcccagccgaggttcagtcggcnggtggtcgtggacgagacttcactctacacntcancagcctagacctagaagtatttggacttaagtttacttactagtcagtnacgcgtagacggtccgttaccgggccgtagggaaccctaaggtagtataactacgaaacgacttggtggtcctcgaccaccgtnttaccgtnttccttccgtaacttcccttacccggtcctacttaccgtagaacgtacg

SEQ ID NO: 203502 - DNA, 593 bp, Homo sapiens
  misc_feature: GYAE6OF02IQR6S.36.4.A04.1.454.CMB.1.raw
  modified_base (197)..(197): a, c, t, g, unknown or other
  misc_feature (197)..(197): n is a, c, g, or t
tcagtacgctgtctcacgaccggtgctcgatttagagtagtgatcagggggaggaactgctcagttaggacccagagggaaccatggaagccccagctcagcttctcttcctcctgctactctggctcccagatactaccggagaaattgtgttgacacagtctccagccaccctgtctttgtctccgaggggaaanagccaccctctcctgcagggccagtcagagtgttagcagctacttagcctggtaccaacagaaacctggccaggcctcccgaggcctcctcatctatgatacatcctacgacgggccactggcactcccagccaggttcaggtggctaggtgggtctgggacagtacttcactctcaccatcagcacgccctagaacctgaagtattttgacttatttattacgtgtcagcagcgagtaggtccgtttccggcccgttagggaaccctaaagggttgtaacttacgtaaccgtaaaaccggtacgttggtacggtctcggacctaccgtaattccgttacgttacctttaccgtacgtttcccttaccccgaccttacgttaccgtagtaaaccgg

SEQ ID NO: 203503 - DNA, 828 bp, Homo sapiens
  misc_feature: GYAE6OF02IDCUR.36.4.A04.1.454.CMB.1.raw
tcagtacgctgtctcacgaccggtgctcgattttagagtagtgatcagggggagggaactgctcagttagggacccacgtagggaacccagtggtaacgaccccgagcttccaagtcgtttctcttcctcctgcttactctaggctcccgagactacctaccggaggaaatttgggtgttggacactaggtttcctccgagcctacccttgtctttgtctaccgtaggggtaagagccaccctctcctggcagggccagggtcagtagtcgttagcgaggtcctacgtagccttggtaccaagtacgaacctagggcctaaggtcgtaccctacggtcctccgttactaacgtcgtatacgtataccgtacgttaccccgtaacgacggggccctacgtacgggacgacgttacccgagaccgtagggtttccaggtacgactaaggttcgggtcgtaggggacacgtaacctttacaaccgtctaacgtacctagtaccgtagaccgacggtaccttaacggtaaaccccgtacgtaacggtaagttttacggaccttaacggtttaacttaacgttacgttaccgtagtaccgtaggtccggtaagtacggttaccgtttaccgggtaccccggttaacgggggtaaccctaaaaggggttacgggtaattaaccggttaaccgtaaaaaccggttaaccgttcgggttaacggttaccgttaacggttaccgtaacccggttagttacccggttacggttacccgtttacgtacggtttaccccggttacccgtacccgttaacgttacccgttagtaaaccggg

SEQ ID NO: 203504 - DNA, 571 bp, Homo sapiens
  misc_feature: GYAE6OF02IXQSN.36.4.A04.1.454.CMB.1.raw
  modified_base (196)..(196): a, c, t, g, unknown or other
  misc_feature (196)..(196): n is a, c, g, or t
tcagtacgctgtctcacgaccggtgctcgatttagagtagtgatcagggggaggaactgctcagttaggacccagagggaaccatggaagccccagctcagcttctcttcctcctgctactctggctcccagatactaccggagaaattgtgttgacacagtctccagccaccctgtctttgtctccaggggaaanagcccaccctctcctgcagggccagtcagagtgtagcagctacttagcctggtaccaacagaacctggccaggcctcccgaggctcctcatctatgatacactcctagacgggccacgtggcatcccagccaggttcaggtggcgtaggtgggtctgggacagtacttcactcacaccatacacgacacgcctaagaacctgaaagttattttgacttaacgtttattacgtgtacgagcaggcgaggtcggtcgtttccgggacccgttacgggacgtaaaggtcggtataacgtaacgaaacggtaatgtacggctagacctaacgtattctgttaccttgaccttccgttccccgactacgttacagtaacg

SEQ ID NO: 203505 - DNA, 605 bp, Homo sapiens
  misc_feature: GYAE6OF02JBB15.36.4.A04.1.454.CMB.1.raw
  modified_base (196)..(196): a, c, t, g, unknown or other
  misc_feature (196)..(196): n is a, c, g, or t
  modified_base (418)..(418): a, c, t, g, unknown or other
  misc_feature (418)..(418): n is a, c, g, or t
tcagtacgctgtctcacgaccggtgctcgatttagagtagtgatcagggggaggaactgctcagttaggacccagagggaaccatggaagccccagctcagcttctcttcctcctgctactctggctcccagatactaccggagaaattgtgttgacacagtctccagccaccctgtctttgtctccaggggaaanagccaccctctcctgcagggccagtcagagtgttagcagctacttagcctggtaccaacagaaacctggccaggctcccaggctcctcatctatgatacactcctacgagggccactggcactcccagccctagttcagtggcaggtgggtctgggacagcttcactctacaccactcagccagcctagaacctgaagtattttgacttagtttatactgtnagcagcgaagtcggtccgtttcgggcccgttacggggaaccctaaagggtcggaacgtttactaacgtaaaaccggtaacgttacggtacggtacgttacggacccaaccgttaacttcggttagttaccttttaccgtaccttttcccgttaccccgtaccctaagtttacccgtaggtaaaccgg

SEQ ID NO: 203506 - DNA, 540 bp, Homo sapiens
  misc_feature: GYAE6OF02GG3HY.36.4.A04.1.454.CMB.1.raw
  modified_base (196)..(196): a, c, t, g, unknown or other
  misc_feature (196)..(196): n is a, c, g, or t
  modified_base (411)..(411): a, c, t, g, unknown or other
  misc_feature (411)..(411): n is a, c, g, or t
  modified_base (436)..(436): a, c, t, g, unknown or other
  misc_feature (436)..(436): n is a, c, g, or t
  modified_base (440)..(440): a, c, t, g, unknown or other
  misc_feature (440)..(440): n is a, c, g, or t
tcagtacgctgtctcacgaccggtgctcgatttagagtagtgatcagggggaggaactgctcagttaggacccagagggaaccatggaagccccagctcagcttctcttcctcctgctactctggctcccagatactaccggagaaattgtgttgacacagtctccagccaccctgtctttgtctccaggggaaanagccaccctctcctgcagggccagtcagagtgttagcagctacttagcctggtaccaacagaaacctggccaggctcccaggcctcctcatctatgatacatcctacgagggccacgtggcactccccaagccgtagggtttcaggtcggcaggtggggtcgtcggggacaggtcttacactctcacctatcagcacgcctaagacctagaagtntttgactagtttacttactgtcagnacgngagcgtcttcggccgtaggacaagtgatactaacaaacgtatggtacgctgaccactactcgtgttccttactacttcccttcccgctactcgtagaacg

SEQ ID NO: 203507 - DNA, 593 bp, Homo sapiens
  misc_feature: GYAE6OF02INJE3.36.4.A04.1.454.CMB.1.raw
  modified_base (475)..(475): a, c, t, g, unknown or other
  misc_feature (475)..(475): n is a, c, g, or t
  modified_base (528)..(528): a, c, t, g, unknown or other
  misc_feature (528)..(528): n is a, c, g, or t
tcagtacgctgtctcacgaccggtgctcgatttagagtagtgatcagggggtctcagagaggagccttagccctggactccaaggcctttccacttggtgatcagcactgagcacagaggactcaccatggaattggggctgagcgtggttttcgtgttaggcgtatttagaaggtgtccagtgtgagtgcagctggtggagtcgtgggggagcttggtccaggccgggggggtccctgagactctcctgtgcagcctctggattcatcttgagtagttatggatgacttgggtccgccagggtcctccgaggggaacgggctgcgtaggtgggtggaccaacagttaaggaagagtaggaagtgagtacatactagtgtaggacttcgtgtagacgggtcctattaccgacctatctaccgaagtacgaacaacgtacaaagaactcaactgtaatctagactaaagcgaaacncgccgtagacggagaccggaggtaaccgacgggtctaggttactagttaccgnggtacggtaccgggacgggtacctaagttaagtttacggtgggtttacggaccttaagtttaacg

SEQ ID NO: 203508 - DNA, 623 bp, Homo sapiens
  misc_feature: GYAE6OF02I6Q5C.36.4.A04.1.454.CMB.1.raw
  modified_base (329)..(329): a, c, t, g, unknown or other
  misc_feature (329)..(329): n is a, c, g, or t
tcagtacgctgtctcacgaccggtgctcgatttagagtagtgatcagggggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccgaggccgggggggtccctggagactctcctatgcagcctctggattcatcttgagtagttattggatgtacgttgggtcccgccgaggctccggaggggacggggcnggacgaggtgggtggccaaacgtagtaaaggaagagtaggaagtgagacatactagtgtggactcgtgtagaaggggcctattccaactatctccgagaacacgaacgacccaaagacctactacgtagtactctagaacctaaagtgaaacgacgtccgtagagggacgggacggaaaggaccgacgggactaggttgttaaacttcgtacgggttcggaacggggtaaccgggaccttaaacgttagtttaacgggtttcgggtttaacgggtaccgttaaacttttaacgg

SEQ ID NO: 203509 - DNA, 834 bp, Homo sapiens
  misc_feature: GYAE6OF02GWUSF.36.4.A04.1.454.CMB.1.raw
  modified_base (199)..(199): a, c, t, g, unknown or other
  misc_feature (199)..(199): n is a, c, g, or t
tcagtacgctgtctcacgaccggtgctcgatttagagtagtgatcaggggggaggaactgctcagttaggacccagagggaaccatggaagccccagctcagcttctcttcctcctgctactctggctcccagatactaccggagaaattgtgttgacacagtctccagccaccctgtctttgtctccgaaggggaaancgccaccctctcctgcagggccagtcagagtgttagcagctacttagcctggtaaccaacaagaaacccgtggaccacggcctcccgaggcctccacatctatagtaactaccattccctaacgacggggcctacgtcgggacctacgtcccgacggtaccgtaagggtttacaagggttcgggaccgttagggttcggggttacgtacgggggtaaccaacgggtactttaccaaccgtttcctaaccaacccgtactacggacgaccgtaacggtaccccttaacggtaaaccgttaggtaaacgtttaacggttttacggtaccgttttaaacgttttaacgtttaaccgtcggttacgaacggtaccgtaagggtaccggtaaacgggttacggggttacccttttcccggggggaacccggttaaccggggggtaaaacccgtttaaaacgggggttaaggttaaaccggtttaaccgtaaaacccggtaaaaccggttaaacggtcggggttaaccggaccgttaacggtacccggtaaccgttacctttacggttaccggttaccgtttacgttacccgtttccgggttaaccccctcgttaaccgttacccggttaaggaaacccgg

SEQ ID NO: 203510 - DNA, 730 bp, Homo sapiens
  misc_feature: GYAE6OF02JIPUB.36.4.A04.1.454.CMB.1.raw
  modified_base (194)..(194): a, c, t, g, unknown or other
  misc_feature (194)..(194): n is a, c, g, or t
tcagtacgctgtctcacgaccggtgctcgatttagagtagtgatcagggggaggaactgctcagttaggacccagagggaaccatggaagccccagctcagcttctcttcctcctgctactctggctccagatactaccggagaaattgtgttgacacagtctccagccacctgtctttgtctccaggggaaanagccaccctctcctgcagggccagtcagagtgttagcagctacttagcctaggtaccaacagaaacctggccaaggctcccaggctcctcatctatgatacaatcctacgaggccaactggaccactacccagccccgtagggtttccaaggtggacctagggttcggggtacttacggggaactaacggactttaccaacttccctacaaacccgtagttaccgaacggtccaaccgtaccctaaacggtaaacccgtaggtaaacggttaagtttttacgaccgtttaagttttaagtttaaccgttggttaccgtaaggaccgtaacgaccgggtaaagtacggggttaccttttacccggggaccgttacggggtaaaccctaaagggttaccggtaaacgttttacgaaaccgtaaaaccggtaaccgttagggtcgggtactacgggaccctaacccgtaacttcgttaaccggttaccttaccgtacgtttacccgttccccgaaccgtaccttacgtacggtaaaccg

SEQ ID NO: 203511 - DNA, 837 bp, Homo sapiens
  misc_feature: GYAE6OF02I02JZ.36.4.A04.1.454.CMB.1.raw
  modified_base (198)..(198): a, c, t, g, unknown or other
  misc_feature (198)..(198): n is a, c, g, or t
tcagtacgctgtctcacgaccggtgctcgatttagagtagtgatcagggggaggaactgctcagttaggacccagagggaaccatggaagccccagctcagcttctcttcctcctgctactctggctcccagatactaccggagaaattgtgttgacacagtctccagccaccctgtctttgtctccgagggggaaanagccaccctctcctgcgagggccagtcagagtgtagcagctattacgcctggtaccaacgacgaaaccgtggaccaggccctcccgacggcctcctcatcctatgactacactacctacgacgggcccacgtcggaccacgtcccgacggaccgtaggttacaggttcggacgtaggtcggggtacgtaggggaacctacggtaccttcgacctcctaccaacctactacgacgacgacggtaccctaaacgtaacccgtaggtaaacgtttacgttttagtaaccgtttaagttttaacgtttaaccgttacgttaccggtaacggtaccggtaacgggtaccgggtaacgggttaccgggttcccggtttttacccgggacccgggtttaaccggggtaaacccgttaaaggggtttacggtaaacgtttaaaccggttaaaacccggtaaaaacccgggtttaaacgttacggggttaccgggttaacccgttacggtaaccccgttaaacccggttaccttttacccggtttaccgggtttaacccttttaaccggtttaacccccgtttacccccggtttacccccggttaaccccgtttaccggttttaaccggttaccggtaaaaccccggg

SEQ ID NO: 203512 - DNA, 598 bp, Homo sapiens
  misc_feature: GYAE6OF02JFZRS.36.4.A04.1.454.CMB.1.raw
  modified_base (192)..(192): a, c, t, g, unknown or other
  misc_feature (192)..(192): n is a, c, g, or t
  modified_base (344)..(344): a, c, t, g, unknown or other
  misc_feature (344)..(344): n is a, c, g, or t
  modified_base (549)..(549): a, c, t, g, unknown or other
  misc_feature (549)..(549): n is a, c, g, or t
tcagtacgctgtctcacgaccggtgctcgatttagagtagtgatcagggggaggaactgctcagttaggacccagagggaaccatggaagccccagctcagcttctcttcctcctgctactctggctcccagatactaccggagaaattgtgttgacacagtctccagccacctgtctttgctcaggggaangccacctctcctgcagggccagtcagagtgtagcagctacttagcctggtaccaacacgaaacctggaccaggcctacccgaggcctcctcattctactgactacatccctacacgggccacgtggcactcccgagcctaggttcagtcggnaggtcgggtctacggggcacgtacttcactcgtcacactcagcagccctaagaacccgtagtaacgttatttgacttagtttactacgtgtacgtagccaaggcgtacggtacggttccggtttccgggaccgtacggggtaaaccaaggggttacgaagttaacgtaacgaaacgtaccgtggttacgcgttacgcctaaccgnttcgttcttacttacgtccttacgtccccgtactcgtacgtagtaaccg

SEQ ID NO: 203513 - DNA, 833 bp, Homo sapiens
  misc_feature: GYAE6OF02I6GA3.36.4.A04.1.454.CMB.1.raw
tcagtacgctgtctcacgaccggtgctcgatttagagtagtgatcagggggaggaactgctcagttaggacccagagggaaccatggaagccccagctcagcttctcttcctcctgctactctggctcccagatactaccggagaaattgtgttgacacagtctccagcccaccctgtctttgtctccaagggtaaagagcccaccctctccctgcgacgggccctagtcagagttcgttagcagctacttacggcctggtaccaacagaacctggccaggcctcccgaggctcctcatactatgatacctactacctacgaaggggtcccacgttcgggacctacgtaccccacggtccgtaacgggttccaaggttcgggacgtaacgggtttcggggtaccgttacgggggaacctacgggtaacctttcgaacctttacccgtacctaacccgagttcccgtaacgggactaaccggtacccgtaaaccgggtaaacccggttagtaaaccggtttaagttttcggaaccgttttaaacgggttttactttaaccggtcggttaacttacggtaccgaacggtacgggtaacgggtaaccgggtttcccgggttttaccgggtacccgggttaaccggggtaacccgtaaaaggggtttccggtaaacttacggttaaaacccggaaaacgttaaccgggttacggggtacggtacccgtttaacggaccctaacccgttaagtttccggttaaccgtttaccgttacccgtttaacggtttccccgtttaacccgaccccgttaaggttaccgttacggtaaaccggg

SEQ ID NO: 203514 - DNA, 979 bp, Homo sapiens
  misc_feature: GYAE6OF02HBFWW.36.4.A04.1.454.CMB.1.raw
tcagtacgctgtctcacgaccggtgctcgattttagagtagtgatctaggggggaggaacgtgcgtcaccgttacggacccgtacgagggaacctatggaagtccccagctcagcttctcttcctcctgctactctggctcccagattacgtaccggagaaattgttggttttcgtacgtacagttactttaccgagcccacccttgttctttggtctccgaggggaaagtacggccgaccctcgtccggtgcgtacgggccaggtcgagggtacgttgttagcacgtccttacgttacgccgtacggtaccctaacgaacggaaaacccttcgggaccccgtaagggaccctttaccccgtaacgggtcccttaccccttacctaacgttacccgttaagttcggggtaaaccttaacccgtaacggttacccccttaaccggaaccggggggtaaccccgtaaccggtttacgggggaaccttaaccgttcccccgtaaccggtcccgtaaacggggttttaaccgtaacggggttaacgggtaccgtaagggttacgggggttaaccggtttaacgggggaaactaaacggtttaccctttacgtaaccgttacctaacccgtaacccttacggttaaccgaacgggtacaacggtacccttaaccggaaacccttaggtaaaccgttaacgttttacggactttaaacgttttaaccttaaacgtacgttaccaggttaccgtaacggtacggtaacggtacgggttcccgtttaccgggaccccggttacggggaaacccgttaaaggggtcggttaacgttaccgtaaaccggtaaaccggtaacgtttggttaacggtaccttaggaacccgttaaccggtaacgttaccggttacggttaaccgtttacggtaccgttttacccggttaccccgggttaccgttacggttacccggtaacggtaaaccggg

SEQ ID NO: 203515 - DNA, 647 bp, Homo sapiens
  misc_feature: GYAE6OF02IR912.36.4.A04.1.454.CMB.1.raw
  modified_base (200)..(200): a, c, t, g, unknown or other
  misc_feature (200)..(200): n is a, c, g, or t
  modified_base (345)..(345): a, c, t, g, unknown or other
  misc_feature (345)..(345): n is a, c, g, or t
  modified_base (397)..(397): a, c, t, g, unknown or other
  misc_feature (397)..(397): n is a, c, g, or t
  modified_base (601)..(601): a, c, t, g, unknown or other
  misc_feature (601)..(601): n is a, c, g, or t
tcagtacgctgtctcacgaccggtgctcgatttagagtagtgatcaggggggagggaactgctcagttaggacccagagggaaccatggaagccccagctcagcttcctcttcctcctgctactctggctcccagatactaccggagaaattggtgttgacacagtctccagccaccctgtctttgtctccaggggaaanagccaccctctcctgcagggccagtcagagtgttagcagctacttagcctggtaccaacacgaaactggccaggcctcccaggctcctcatactatgatacatcctaacacgggccaactggcatcccagccaggttacagtgcngtggtctggggacacgacttacacttctacacctatcagcacgtaccgtaanaacctagtaaacgtattttacgactaagttttaactttaaccgtagtacgaagtacgacggacgaaggtaccgggtcgttttcccggacccggttaacggggaaaccctaaaaggttggaattaacgttaacccgaaaaacgttaacgtacgggtacgggtaccgtaggtacccgaaacccttagtacctcggtttacctttanaccgttttcccgttacccccgtacctacgttaccgtaggtaaaccg

SEQ ID NO: 203516 - DNA, 718 bp, Homo sapiens
  misc_feature: GYAE6OF02ISP1E.36.4.A04.1.454.CMB.1.raw
  modified_base (196)..(196): a, c, t, g, unknown or other
  misc_feature (196)..(196): n is a, c, g, or t
tcagtacgctgtctcacgaccggtgctcgatttagagtagtgatcagggggaggaactgctcagttaggacccagagggaaccatggaagccccagctcagcttctcttcctcctgctactctggctcccagatactaccggagaaattgtgttgacacagtctccagccaccctgtctttgtctccaggggaaanagccaccctctcctgcagggccagtcagagtgttagcagctacttagcctggtaccaacagaaacctggaccaggcctcccgacggcctcctcctagtctatacgatacacttcctaacgagggacccaactcggcacgtaccccgagcccgagggtttacaggtcggacgtaggtggggtccgttacggggaacctacggtacccttcgaaccttccgtaccaaccctagtccgaacggtccaacggtacctaaacggtaaacccgttaaggtaaacgtttacttttcggtacgtttaagtttaaccgtttacgtacgttacgtaacgtacgaggtaccggaaggtacggtccgtttaccgggcccgttacgggaaccgtaaaggttacggaacttaacgttaaaccgaaaccggtaaacgttccggtacggtaccgtggtacccgtaacgttcgtacccgtttgttaacccgttttccacgtttcccctttacccggacctacgtttacctacggaaccg

SEQ ID NO: 203517 - DNA, 677 bp, Homo sapiens
  misc_feature: GYAE6OF02IBBGX.36.4.A04.1.454.CMB.1.raw
  modified_base (193)..(193): a, c, t, g, unknown or other
  misc_feature (193)..(193): n is a, c, g, or t
  modified_base (254)..(254): a, c, t, g, unknown or other
  misc_feature (254)..(254): n is a, c, g, or t
  modified_base (383)..(383): a, c, t, g, unknown or other
  misc_feature (383)..(383): n is a, c, g, or t
tcagtacgctgtctcacgaccggtgctcgatttagagtagtgatcagggggaggaactgctcagttaggaccagagggaaccatggaagccccagctcagcttctcttcctcctgctactctggctcccagatactaccggagaaattgtgtgacacagtctccagccaccctgttcttgtctcgaggggaangccaccctctcctgcgaggccagtcagagtgttagcagctacttagccgtaggtaaccaanaacgaacctcggccaaggcctacccgaggtcctcctacattcgtatcgtaatacctattaccgtacgacgggccaacgtcggacacgtccgagccgtaggttccaggtggacaggtgggtactcggganacgtacttcgacttcactaaccatacgagcctacgtacctaacgtaaccgtaagtaacgttaattttaggacttaagttttacgtacttacgtacgaacgtacgaaggtccgaaggtcggttaccgtttcccgggacccggtaagggtaaacccgtaaagggttcgaacgttaacgtaacgaaaaaccggtacgttcggtacgggtacttaacggccctaaaccttagttccgttacgtttaccgttacctacgttaccccttacccggacttaacgttaccgtaaggaaccgg

SEQ ID NO: 203518 - DNA, 736 bp, Homo sapiens
  misc_feature: GYAE6OF02JGAPN.36.4.A04.1.454.CMB.1.raw
  modified_base (491)..(491): a, c, t, g, unknown or other
  misc_feature (491)..(491): n is a, c, g, or t
tcagtacgctgtctcacgaccggtgctcgatttagagtagtgatcagggggtctcagagaggagccttagccctggactccaaggcctttccacttggtgatcagcactgagcacagaggactcaccatggaattgggctgagcgttgggttttccttgttgtcttattttagaaggtgtccagtgtgaggtgcagcgtggtggagtcgtgggggagtcgttggtccgacgggcccggggggtccctggacgtacctccgtccgtggtcgcacgcctcgtggattcattcgttagaagttagttagttggtaattggtacgtttcgggtcccgtccgaggtcctccggaaggggaagggctaggcgtagggtcgggtagaccgaaacgtaagttaaaagggaagtaaggtaggtaaagtggaacgtaacgtaattacttaagtggtacgtaacttcgtaggtagggaacggtccgtaattaccaaaccgtntacccgacgtaagaacgaaacgaacccgaccaaagtaacctctaacgttagtactacgacactaaaacgtaggaacctaacggtacccgtaggaacggaaacgggccgaaaagggacccgtaaccgggaagttttacgtaacgtttaaagttcccggttaggaccgggtaaaccggggacggttaaccccaagttttaacgttaacgggttggttttaaccgggtaacttaaccgttttaaacgg

SEQ ID NO: 203519 - DNA, 611 bp, Homo sapiens
  misc_feature: GYAE6OF02F0GM9.36.4.A04.1.454.CMB.1.raw
  modified_base (197)..(197): a, c, t, g, unknown or other
  misc_feature (197)..(197): n is a, c, g, or t
  modified_base (225)..(225): a, c, t, g, unknown or other
  misc_feature (225)..(225): n is a, c, g, or t
tcagtacgctgtctcacgaccggtgctcgatttagagtagtgatcagggggaggaactgctcagttaggacccagagggaaccatggaagccccagctcagcttctcttcctcctgctactctggctcccagatactaccggagaaattgtgttgacacagtctccagccaccctgtctttgtctccaggggaaagngccaccctctcctgcagggccagtcagngtgttagcagctacttagcctggtaccaacagaaacctggccaggctcccaggctcctcatctatgatacatcctacacggggcccacgtgggccactccccgagcccagggtttccaggttggcaggttgggtctgggacagtacttcaccgtctcgacctatcacgcacgacctaagaaccctagaagtagttttagcttaagtttaattacgtgttaccagctaggacgaggtacggtccgtttccgggacccgttagggaaccctaaagggtcggtattaacgtaccgtaaaacgtacgtacggtggtactacggaccgtaacctagttcgtcgttacgtttcctactttcccgttaccccgtcctacttccgtagtaaccg

SEQ ID NO: 203520 - DNA, 699 bp, Homo sapiens
  misc_feature: GYAE6OF02IB0JU.36.4.A04.1.454.CMB.1.raw
  modified_base (161)..(161): a, c, t, g, unknown or other
  misc_feature (161)..(161): n is a, c, g, or t
  modified_base (196)..(196): a, c, t, g, unknown or other
  misc_feature (196)..(196): n is a, c, g, or t
  modified_base (210)..(210): a, c, t, g, unknown or other
  misc_feature (210)..(210): n is a, c, g, or t
  modified_base (255)..(255): a, c, t, g, unknown or other
  misc_feature (255)..(255): n is a, c, g, or t
  modified_base (276)..(276): a, c, t, g, unknown or other
  misc_feature (276)..(276): n is a, c, g, or t
  modified_base (279)..(279): a, c, t, g, unknown or other
  misc_feature (279)..(279): n is a, c, g, or t
tcagtacgctgtctcacgaccggtgctcgatttagagtagtgatcagggggaggaactgctcagttaggacccaggagggaaccatggaacgccccagctcagcttctcttcctcctgctactctggctcccagatactaccggagaaattgtgtgacacngtctcagccacctgtctttgtctccgaggggaaangcctaccctctccngcgaggccagtcagagtgttagcagctactagcctaggtaccaanagaactggcaggctccgagcnctnatcgtatgaatacactacctacgagggccaactggcaactccccaagcctaagggttcaggtacgggccaaggttcggggtactacggggactaacggtaccttctaaccgttctaaccgaacctaacgttacgaacggaccgtaaacgtaccgttaaacgggaaacccttaggtaaaacggttaattttttcgggaaccgtttaaaggttttaaactttaccgagttaccgtaagaccttaaagggccgttaaagcggttaccgttttccgggaccccgttaaggggaaaccctaaagggttcggaaattaacgtaacccgaaaacgttaacgtcgtaagggtcccttagggacccctaaccaagtttccttcggttacttcgaactttccggtcccacctaattccgtacgaaaacgg

SEQ ID NO: 203521 - DNA, 766 bp, Homo sapiens
  misc_feature: GYAE6OF02IF8G4.36.4.A04.1.454.CMB.1.raw
  modified_base (225)..(225): a, c, t, g, unknown or other
  misc_feature (225)..(225): n is a, c, g, or t
  modified_base (408)..(408): a, c, t, g, unknown or other
  misc_feature (408)..(408): n is a, c, g, or t
  modified_base (722)..(722): a, c, t, g, unknown or other
  misc_feature (722)..(722): n is a, c, g, or t
tcagtacgctgtctcacgaccggtgctcgatttagagtagtgatcagggggaggaactgctcagttaggacccagagggaaccatggaagccccagctcagcttctcttcctcctgctactctggctccagatactaccggagtaaattgtgttgacacagtctccagcccacctgttctttgtctccgagggaagacgccaccctctcctgcgacgggccagtnagagttgttagcagtctacttacgccttaggtaaccaacgaagaacccgtcgggcccaacggtcccctaccccgagggtcccttcccctactacttacttacgtgtaactaaccgtacttcccctaacggacgggtcccacgtacggcctaacgtaccccgaacggtcccgtacggttaccgngggttcggacgtagggttcggggtcgtcggggtactacggttaccttaccaccgttacctccgaaccctagttcccaaggcccgtaacggtaccccgttaacgaaacccgtttagggtaaaacgttttcgttttaggttaaccgtttaaggttttaacctttacggtacgtttacgaacgttacgacgggtaccggtagggtaacgggtttcccggttacgggtaccccgttaggggaaacccgtaagggtacgtaacgttaaccgtaacggaaacgttacgtggtacggcgttacgcctacgtctaccggttnttccttactccgttacctccccggtactacgttcacggtaaccg

SEQ ID NO: 203522 - DNA, 728 bp, Homo sapiens
  misc_feature: GYAE6OF02GBB2B.36.4.A04.1.454.CMB.1.raw
tcagtacgctgtctcacgaccggtgctcgatttagagtagtgatcagggggaggaactgctcagttaggacccagagggaaccatggaagccccagctcagcttctcttcctcctgctactctggctcccagatactaccggagaaattgtgttgacacagtctccagccaccctgtctttgtctccgaggggaaagagcccaccctctcctgcgacgggccagtcagagtgttagcagctacttagcctaggtaccaacagaaacctggaccaggcctccgaggtcctcctcatctatgactacactccgtacgcgggacctacgtggccaccgtcccgacgaccgtaggttcgaaggtcggacgtaggttcgggtcgtagggacctaaggtaccttacgtacctacctacccgtaacctacgttaccgaacggtaccgtaaccggtacccgtaaacggtaaacccgttagggtaaacggttttacgttttacggtaaccttttaagttttaacttacgtacgttacgaacggtaccggtacggacggtaacgggttccggttcccgttttacccgggacccggttaacggggtaacccgtaaaggttacggtaacgtaaactaaaccggtaaacgtaacggttcgggacgtaccgtgaacccgtacgttacgtccgttacgtttcctcgttaccttcccgttacccacgtcttaccgtgtaaaccg

SEQ ID NO: 203523 - DNA, 704 bp, Homo sapiens
  misc_feature: GYAE6OF02G2HA6.36.4.A04.1.454.CMB.1.raw
  modified_base (202)..(202): a, c, t, g, unknown or other
  misc_feature (202)..(202): n is a, c, g, or t
tcagtacgctgtctcacgaccggtgctcgatttagagtagtgatcagggggaggaactgctcagttaggacccagagggaaccatggaagccccagctcagcttctcttcctcctgctactctggctcccagatactaccggagaaattgtgttgacacagtcctccagcccaccctgtctttgtcctccgaaggggaaagngcccaccctctcctgcgacgggccagtcagagtgttagcagctacttagcctaggtaccaacagaacctggccacggcctcccgacggcctcctcatctaatgactacactccgtacgacgggccacgtcggaccaccgtacccaggcctacgggttaccagggtcgggaccgaagggttcggggacgttcggggaacacggtacgttccgtaaccgtccttaccaacctacgtccacgccgacgtaccctaacggtaacccgtagtaacgttacgttttacgacgtttaacgttttacttaacgtgttacgacgtaccgaaggcggtaacggtacggtcccggttttccgggcccggttaagggtaacccggtaaagggttcggaacttaacgtaaaccgtaaaacggtacgttagggtacgtaccgttgaaccctaacgtacttccgttacgttcctttaaccacgtttccctacccgtctaacgttcgtaacgtaacgg

SEQ ID NO: 203524 - DNA, 771 bp, Homo sapiens
  misc_feature: GYAE6OF02JVBBM.36.4.A04.1.454.CMB.1.raw
  modified_base (195)..(195): a, c, t, g, unknown or other
  misc_feature (195)..(195): n is a, c, g, or t
tcagtacgctgtctcacgaccggtgctcgatttagagtagtgatcagggggaggaactgctcagttaggacccagagggaaccatggaagccccagctcagcttctcttcctcctgctactctggctcccagatactaccggagaaattgtgttgacacagtctccagccacctgtctttgtctccgagggaaanagccaccctctcctgcacgggccagtcagagttgttagcagctacttagctggtaaccaacgagaaaccgtggaccaggcctcccgaggcctcctcatctatgacttacatcctaccgaggcccacgtcggaccactaccccgagtacctagggttccaggtcggaccgtaggttcggggtcgtacgggactacggtaccgttccgtaaccgttaccgtacctaaccccgtagttccgaacgtaccgaccgtacccgttaaacgaacccgtaagtaaacgtttacgttttacggtaccgttaaaggtttttactaaccggttatacgtaagttacctaacgggtacgtaacggggttaccgttaaccgggtttcccgggtacccggttaaccggggtaaacgtaaacgggttaacggtaaccgttaaaccgttaaacccggaaaaccggttaacggttacggttaccggtaccgttaacgacccggttaaacctaacggtttccctttaacggtttcttaacccgtccttttacccggtaccccgttacctaccggtttaccgtacgtaaacccgg

SEQ ID NO: 203525 - DNA, 586 bp, Homo sapiens
  misc_feature: GYAE6OF02F8DXG.36.4.A04.1.454.CMB.1.raw
  modified_base (304)..(304): a, c, t, g, unknown or other
  misc_feature (304)..(304): n is a, c, g, or t
  modified_base (321)..(321): a, c, t, g, unknown or other
  misc_feature (321)..(321): n is a, c, g, or t
  modified_base (375)..(375): a, c, t, g, unknown or other
  misc_feature (375)..(375): n is a, c, g, or t
tcagtacgctgtctcacgaccggtgctcgatttagagtagtgatcagggggaggaactgctcagttaggacccagagggaaccatggaagccccagctcagcttctcttcctcctgctactctggctcccagatactaccggagaaattgtgttgacacagtctccagccaccctgtctttgtctccagggtaaagagccaccctctacctgccagggccagtcagagtgttagcagctacttagcctggtaccaacagaaacctggaccaggctccaggctcctcatctatgatacatcctanagggccatggcatccanccctaggttcagtggcaggtgggtctagggacaggacctttcacttcacaccanccagcagcctaagacctagaacgtattttagacttaagtttaacttacgtagtacaacgcaggtacgagtacggtcgttaccggcccgtagggaacctaaaggtcggagttaacaactaaacggtacgttggcggtcgtacgaccgtaactactttacctcggtttaccttacgtacgttccttaccccgactaccttccgtagtaaacgg

SEQ ID NO: 203526 - DNA, 687 bp, Homo sapiens
  misc_feature: GYAE6OF02GZO0D.36.4.A04.1.454.CMB.1.raw
  modified_base (203)..(203): a, c, t, g, unknown or other
  misc_feature (203)..(203): n is a, c, g, or t
tcagtacgctgtctcacgaccggtgctcgatttagagtagtgatcagggggaggaactgctcagttaggacccagagggaaccatggaagccccagctcagcttctcttcctcctgcctactctggctcccagatactaccggagaaattgtgttgacacagtctccacgcccacccttgttctttgtctccgaaggggaaancgcccaccctctcctgcgagggccagtcagtagtagttacgcagctacttagcctggtaaccaacaacgaaacccgtggccaggcctcccgaggccttcctctattcctatgtaactactctaccacgacgggccacgtcggctactcccagcctagggttcaggtcggaccgtaggttcgggtacgtagggactaacggtaccttcgaccttccgtacccaaccgtaactccgacgtaccgtaacgacccgttaacgaaacccgttaaggtaaacgtttacgttttcgtaacgtttaagtttacgtttactcggttacagtacaggtacgtagtacggtcgttaccggccgttaccgggaacggtaaaggtgtaagttaaccgtaacgtaaacgtacgtcggtcgtacgtacgaccgtaacgtattaccgttacttaccgttacctaccgtttccttacccgaccgtactccgtaaataccgg

SEQ ID NO: 203527 - DNA, 700 bp, Homo sapiens
  misc_feature: GYAE6OF02HPISC.36.4.A04.1.454.CMB.1.raw
tcagtacgctgtctcacgaccggtgctcgatttagagtagtgatcagggggaggaactgctcagttaggacccagagggaaccatggaagccccagctcagcttctcttcctcctgctactctggcctcccagatactaccggagtaaattgtgttgacacagtctccagccaccctgtctttgtctccgaggggaaagagccaccctctcctgcgacgggccagtcagagttggttagcaagtcctacttacgcctaggtaaccaactaacgaaaccgtggaccaggcctccccgaggtcctccgtctacgtctaatcgattacgacttccctagacggcctacgtcggacctactcccgacggtacccgtagggttccgacgggtcggctaacgggttcgggtcgtagggaccacgtaccgttaccgaccttactccaaccgtactccgagtaccgtacgtaccgtacgaaaccgttggtaaagttcgttttagacgtttaacgtttacgttaacgttgacgaggtacgtagcgggtaagggtcgttccgtttacccgggccggttaaccggaaaccgttaaggtacgtaagttacctaaaccggtaaacggtacgttggtaccggtctaccgccttaacgtacgttccttacgttcgttacctccttacccggttccactacgttacgactaacggg

SEQ ID NO: 203528 - DNA, 621 bp, Homo sapiens
  misc_feature: GYAE6OF02JJCGV.36.4.A04.1.454.CMB.1.raw
  modified_base (197)..(197): a, c, t, g, unknown or other
  misc_feature (197)..(197): n is a, c, g, or t
tcagtacgctgtctcacgaccggtgctcgatttagagtagtgatcagggggaggaactgctcagttaggacccagagggaaccatggaagccccagctcagcttctcttcctcctgctactctggctcccagatactaccggagaaattgtgttgacacagtctccagccaccctgtctttgtctccaggggaaagngccaccctctcctgcagggccagtcagagtgttagcagctacttagcctggtaccaacagaacctggccaggcctccgaggctcctcatctatgatacacttcctacgacgggccacgtggcactcccagcccaggttcagtcgcgtaggtgggtctgggacaggtacttcgactctacacctagtcacggcaacgccctaacgtaaccgtgaacgttactttgaccttagtttaacttacgtcgtcagtaccgagtacggagtaccgtccgtttccgggaccggttacggggtaacctaaacgggtagtaacttacgtacgtaaaacggtacgttggtacggacctaggaccctaaccgtatcccgttgttaccttccgttaatttccccctacccggttaccctacgtttacacggtaaccg

SEQ ID NO: 203529 - DNA, 964 bp, Homo sapiens
  misc_feature: GYAE6OF02HS1QP.36.4.A04.1.454.CMB.1.raw
tcagtacgctgtctcacgaccggtgctcgatttagagtagtgatcagggggaggaactgctcagttaggacccagagggaaccatggaagccccagctcagcttctcttcctcctgctactctcggctccagatactaccggagaaattgtgttgaacacagtctccacgccacccttgttctttgtcctccgaaggggaaacgacgcctaccctctcctgccgacgggccagtacgacggtagttagttacgcgtacgtaccttaacgttacggtacccgttagggtaaacccaaaacgtaaaccggtaaacccgttacgggaacccgtaacgggtcccctaccccggtaaccggtcccttaccccgttactaacgtttacctaacgttacggttaaccttaaccctaaccgttacccgttaaaccgggaaccgggtacccttaaccggtccgggtaaccctaacccgttaccccgaacggtacccgttaacgggtttaccggtagggtccggtaacggtttacggggtccggggttaccggtacgggggtaaccttaaccggttacccgttaccgtaaaccgttcctaaccgtaaccctacgttaccgacgtaccgaacgtacccgttaacgtaaaccgttagttaaaccgtttagttttacgaaacgtttaacgtttaacgtttacgtacgttacgaacggtaccgaagggtaccgtaacggggtaccggtttacccggttcccgggaacccgggtttaaacggaaccggtttaaacgggtacggtaaaccgtttaagtaaaccccggggtaaacgttaccgggttacggttacgaccggtttacccgaacccgttaaccggttaccgtttaccggttacccggttttacccttaacgttaccccggtttaaccccgtttccccggtacctttaccggtttacggaaaccggttaaaccgg

SEQ ID NO: 203530 - DNA, 739 bp, Homo sapiens
  misc_feature: GYAE6OF02GJQRR.36.4.A04.1.454.CMB.1.raw
  modified_base (196)..(196): a, c, t, g, unknown or other
  misc_feature (196)..(196): n is a, c, g, or t
tcagtacgctgtctcacgaccggtgctcgatttagagtagtgatcagggggaggaactgctcagttaggacccagagggaaccatggaagccccagctcagcttctcttcctcctgctactctggctcccagatactaccggagaaattgtgttgacacagtctccagccaccctgtctttgtctccaggggaaanagccacctctcctgcagggccagtcagagtgtagcagctacttagcctaggtaaccaacacgaaacctggaccagcctccaggcctcctcatctatgactacactcctacgacggaccacgtggacactcccacgtccgtaggttccaaggttcggactaggttcggggtacgtacgggggtaaccaacggtacctttaccgtacgttcctaacctaaccccaagttcccgaacgaccgtaacggtacccgtaaacggtaaaccccgttaaggaaacgtttaacgtttttacggaccgtttaaagttttaacttaccgttacggttacgtaacgtacgtaacgtacggaagggtacggttccggtttaccgggcccgttaacggggtaacctaaagggttcggtaacttaaccgtaacgtaaaaccggtaacgttacgggtacggttacgtacgtacccgtaaccgtacgttacgttcgtttacccgtttcgtaaccgtttccccgtttacccgacccttaacgttaccgtaacggtaaaccg

SEQ ID NO: 203531 - DNA, 765 bp, Homo sapiens
  misc_feature: GYAE6OF02HPPZ8.36.4.A04.1.454.CMB.1.raw
tcagtacgctgtctcacgaccggtgctcgatttagagtagtgatcagggggaggaactgctcagttaggacccagagggaaccatggaagccccagctcagcttctcttcctcctgctactctgctccagatactaccggagtaaattgtgttgacacagtctccagcccaccctgttctttgtcctccgaaggggaaagacgccaccctctcctgcgacgggccagtcagagtgttagcagctacttacgcctaggtaaccaacgaacgtaaaccgtcggaccacggtcctcccgaggtcctcctacacttacctagtacgaactacctacgttaccctaaccggacggggtaccctaacgttcggacctaccgtcccccgaagtacccgtacgggtttaccaagggtcggtacgtacgggttcggggttacgtacggggaacctaacggttacctttcaccgtttcctacccgaacccgtaactcgaacgtccgtaacggtaccgttaaacgtaaacccgttaggtaaagtttacgttttacgtacgtttaaagttttaactttacgttcgtaacgacggtacctaaggtccggtaaggtaccgggttccgtttaccgggacccgttaacgggtaaacgtaaacgggttggtaaacttacgtaaaccgaaacgtacgttgtacggtacgacggtaccctaaccgtacttccttacgtttaccttcgtaccttcccgttacccctcgtacttacgtacgtaacg

SEQ ID NO: 203532 - DNA, 812 bp, Homo sapiens
  misc_feature: GYAE6OF02H0QMG.36.4.A04.1.454.CMB.1.raw
  modified_base (452)..(452): a, c, t, g, unknown or other
  misc_feature (452)..(452): n is a, c, g, or t
tcagtacgctgtctcacgaccggtgctcgatttagagtagtgatcagggggaggaactgctcagttaggacccagagggaaccatggaagccccagctcagcttctcttcctcctgctactctggctcccagatactaccggagaaattgtgttgacacagtctccagcccacctgttctttgtctaccgaggggaaagcgccaccctctaccgtgaccgacgggaccaggtccaggtacgttggttagcagtcctacgttacgccttaggtaaccctaaacgaacgtaaaaccgtcggacccgacgggtaccctcccgaagggtcctaccgtcgtattcctatcgaactactactcccgttaacgacgggtcccacgtcggacctacgtacccgacgccgttaggttccgagggtcggacggtacggttcggggtaccgtaggggtaaccngttaaccttccgaaccttcctaacccgtaacctaagttccgaagcccgtaagtaccccgttaaacgtaccgttaagggttaaacgttacgttttacgtaccttttaaggtttactttacccggttgttaaccgtaggcctaagggccgtaagggttaccggtttaccggttttacccgggacccgttacggggtaaacccgttaagggttaggaaccttaaccgaaccggttaaaaccggaggtttacgggtaccggttactacgtaacccgtagttaccgtttcggttacgttaacccgtttaccgtacccgtttaccgtttacccccgtaacgtttcgtttacgtaacccgggtaacg

SEQ ID NO: 203533 - DNA, 752 bp, Homo sapiens
  misc_feature: GYAE6OF02HIGPO.36.4.A04.1.454.CMB.1.raw
  modified_base (330)..(330): a, c, t, g, unknown or other
  misc_feature (330)..(330): n is a, c, g, or t
tcagtacgctgtctcacgaccggtgctcgatttagagtagtgatcagggggaggaactgctcagttaggacccagagggaaccatggaagccccagctcagcttctcttcctcctgctactctggctcccagatactaccggagtaaattgtgttgacacagtcctccacgcctacccgttgttctttagtcctaccgaaggggaaagcgccctaccctctcctgcgacgggccagtcaggtacgttgttagcagtcttactacgccgtaggtaccaacgacgtaaaccgtcggaccgaggtcctaccgaggtccctcctcacttctagngtaactactacgtaccctaacggaccggtaccacgtcggacaccgtacccgaggacccgtaggttacaggtcggtcgtacggtcggtgtacgggactacggtacgttcacgtctaccaccgcgtacgacgcgaccgtcgtgacgtaggtacgtaggtattcgttacgtacgttttaagttttattacgttacgtgtaagtaccgttaagtaactaaacggtttacgtcccgggttacccgttaccgggttacgttacccgggtttaccggggaccgggttaaaccgggtacggtaaaagggtccgtaaacgaccgttaaacgtaaccgggtaacggttcggtaaccggttaccgtaccgggaaccttaacccggtattttcccggttccggttttaaccttcccggttaccgtttacccccg

SEQ ID NO: 203534 - DNA, 794 bp, Homo sapiens
  misc_feature: GYAE6OF02IAITD.36.4.A04.1.454.CMB.1.raw
tcagtacgctgtctcacgaccggtgctcgatttagagtagtgatcagggggtctcagagaggagccttagccctggactccaaggcctttccacttggtgatcagcactgagcacagaggactcacatggaagttgggctgagcgttgggttttccttgttgtcttattttagaggtgtccagtgtgaggtgcagtcgtgggtggagtcggtgggggaggtcgttgggtccgacggggtcccgggggggtccctggacgtacctccgttccgtggtgtccgagtccgtcgtcggtactttcctaaccgttttagctaacgcttaagtcgcctagtccgaccggttcgggtcccgtaccggacggtccgtaccggaaggggtaacgggtacgtggggtaggttcggggtccttcggttacttaaggttagggtgggtaacggttgggttaggttaactaacgtaaacgtacggacgtacggtcccgtaccggtagggaaccgggtcccgtacttaccgaacctacgttcccgtaccgaagtaacgtaaccttacgttacccgaaggacgtcctacgttcgttacgttactacgtacgtaactaaacgtacgaacgtacgtacgtacggtacgtaccggacccgggaacggtaaccccgtaacggttaccctttaaagttagtttacggttacgtaacggtaacggttaaagggttgggggtacggggggttaacggtcggggtaccttaccgggtcccggtttagggtttccgttttacgggagtttacccgggg

SEQ ID NO: 203535 - DNA, 774 bp, Homo sapiens
  misc_feature: GYAE6OF02F4NUH.36.4.A04.1.454.CMB.1.raw
tcagtacgctgtctcacgaccggtgctcgatttagagtagtgatcagggggtctcagagaggagccttagccctggactccaaggcctttccacttggtgatcagcactgagcacagaggactcaccatggaattggggctgagcttgggttttccttgttgcttattttagaaggtgtccagtgtgaggtgcagcgtgggtggagtcggtgggggagtcgttggtccgacgggtcccggggggtccctggacgacttctccgtgtcgcacgtcctcgtggtacttcattcttagtagttagttgttggattgtacgttcgggtcccgccgacggccgtaccggaggggaacgggtctggcgtagggtgggtcgacctaagtaagttaacggaagagtaggaaggtagagactattactagtaggtcgtacgttcgttggtaggaacgggtcctaagttaccccgtaacctacttcccgtaccgaaggtaaacgaaacccgaaaccgaaccgaaacttaaaccgtaccgtaacgttaggtaaccttcgaagaacctaaagtaccgaaaacgtcgtacgtaacggaacggtacggtaaccggaacgggtaacgtacccgggttagtttacgggttaacgttttaacgtttccggggttaacggttcccgggggaaccgggttaacccgggggtaaccctttaaaaggtttacgggtttaacgggtttttacggggtttaccgggtttaaccgggtttaaaacctttttaaacggg

SEQ ID NO: 203536 - DNA, 820 bp, Homo sapiens
  misc_feature: GYAE6OF02IMBPG.36.4.A04.1.454.CMB.1.raw
tcagtacgctgtctcacgaccggtgctcgatttagagtagtgatcagggggaggaactgctcagttaggaccagagggaaccatggaagccccagctcagcttctcttcctcctgctactctggctcccagatactaccggagaaattgtgttgacacagtctccacgccacccttgttctttgtctaccgaaggggaaagacgccacccttctcctgacgacgggccagtcagtagtgttagacagtcttacttacgccgtaggtaaccaacgaacgaaaccgtggaccacggcctacccgaggcctccgtcatactatgaactacagtacccgtaacgacgggaccaacgtacggacctaacgtcccgaacgaccgtaacggttcgaaggttcggacggtaggtcggggtacgtacggggaacaacgtaccgttactaccgttcctaccgtaaaccctagtaccgaagtccgaacgtacccgttaaacgtaaacccgtaaggtaaacgttacgtttttacggtaaccgtttaaacgtttaacgttaaccggttaggtaaccgtaacggtaacccgtagggtaaccggtaaggggtttaccgggttcccgggttttacccgggacccgggttaacggggtaaacccgtaaagggttaccggtaaagttaacccgtaaaccggtaaaacggttaaccgtttagggtaccggtacgttacggtaaccccgtaacgttacgtttaccggttacgttaccgtttaccgtacccgttttacccgttccccgtaacccttaacgttaccggtaacggtaaaccgg

SEQ ID NO: 203537 - DNA, 620 bp, Homo sapiens
  misc_feature: GYAE6OF02FN1R2.36.4.A04.1.454.CMB.1.raw
  modified_base (380)..(380): a, c, t, g, unknown or other
  misc_feature (380)..(380): n is a, c, g, or t
tcagtacgctgtctcacgaccggtgctcgatttagagtagtgatcagggggtctcagagaggagccttagccctggactccaaggcctttccacttggtgatcagcactgagcacagaggactcaccatggaattggggctgagctgggttttccttgttgctattttagaaggtgtccagtgtgaggtgcagctggtggagtctgggggaggcttggtccaggccgggggggtccctggagactctcctgtgcagcctctggattcatcttgagtagttattggatgacttgggtccgccaggctccgaggggaaggggctgcaggtgggtggccaacagttaaggaagagtagggaagtgagacatactatgtgactntgtgaagggcgattcaccatctcagagacaacgccaaagacctacactagtactctgacaaatcgaaacacggacctaggaacggaagggacggaacggaaccgaaccgggccgtttagggttacggtttaagttttccggtacggttcgggacccggggtaacggggggtaacccctaaacggtttaacgtttaaggtttcgggggtttttacgggaccggtttaacgtttttaaacgg

SEQ ID NO: 203538 - DNA, 779 bp, Homo sapiens
  misc_feature: GYAE6OF02GRW8W.36.4.A04.1.454.CMB.1.raw
tcagtacgctgtctcacgaccggtgctcgatttagagtagtgatcaggggggaggaactgctcagttaggacccagagggaaccatggaagccccagctcagcttctcttcctcctgctactctggctcccagatactaccggagaaattgtgttgacacagtctccagccaccctgtctttgtcctccgaggggaaagacgccaccctctcctgcgagggccaggtcagagtgttagcagctacttagcctggtaccaacgagaaacctggaccaggcctccgaggcctcctcatctatgactacactacctacgacgggaccacgtcggactactcccgaacgtcccgtaggttccgaaggtcggacggtaggttcggggtacggtcggggacgtacggtactttaccgaccgttacctacctaaacctacttacggacgtaccgacggtaccctaaacgggtaaccgttaggtaaacgtttattttacggtacgtttaaggttttaactttacgttccggttaatacgggtactaacgggccgggtaacggttaccggggttcccgttttacccgggggaccccggtttaacggggtaaacccggtaaagggttacgggtaaccgtttaaaccgtaaaccggtaaaaaccgttaacgggttcgggtacggttaccgacgggttaccctaaccgttacgtttaccggttccgtttaacccgtttaccttaaccgttcccgtttaccccggttccttaacgttccgtaacgaaaccgg

SEQ ID NO: 203539 - DNA, 947 bp, Homo sapiens
  misc_feature: GYAE6OF02FGQID.36.4.A04.1.454.CMB.1.raw
tcagtacgctgtctcacgaccggtgctcgatttagagtagtgatcagggggtctcagagaggagccttagcccctggacctcccaaggccctttccacttggtgactcagccactgacgcaccaggacggacctccacccagtgggtaacgtttcgggggcctgacggtcgttttcgggttttacccgtttggttcggtacctttaagttttaaggaacggttcgttacccgtaggttggtacggtaggttcggaccgtacggtccggttgggtacgggtacggttccgggttacgggggggtaccggtcgtttcccggggtcccggtccgggggtcccccgggggggttccccctcgggaacctccgtccgtcccgttggtccggacccgtaccgtccgttacgtacggtactttcctaacgtttccgtaggttacgtttaacgtttacggttacgtacgttcggtacccgttaccgggcccgaccggtacgtccgtacgggtaaggacggtcgtacgcggtacggtacggtaccaaccgtaaagtaaggttaaacgggaagacggtaagggtaacgtacgaacccgtagttaaccgtaacgttcggtacgggtacgttaccggtacggttacggggtaaccggaccggttaacctttaaccgttaccctaaccttcccggtaaacccgttaacggaaccggaaaaccaacccgggtaaacccaaacccgggtaaactaacccgttacgtaacgttccgttaaaccttacgaaacccgaaaccttaaaggccccggtaaacggaccggtagaaacgggaccgtaccggaaccggtaacgtcggtacgtcgttacggacgttaccggtgaaccgggtaccggacggtaaccggtacctttaggtacggtttaccggttacggttaccgtacttaaaccgttaacggg

SEQ ID NO: 203540 - DNA, 727 bp, Homo sapiens
  misc_feature: GYAE6OF02FJVIN.36.4.A04.1.454.CMB.1.raw
  modified_base (197)..(197): a, c, t, g, unknown or other
  misc_feature (197)..(197): n is a, c, g, or t
tcagtacgctgtctcacgaccggtgctcgatttagagtagtgatcagggggaggaactgctcagttaggacccagagggaaccatggaagccccagctcagcttctcttcctcctgctactctggctcccagatactaccggagaaattgtgttgacacagtctccagccaccctgtctttgtctccgaggggaaangcccaccctctcctgcagggccagtcagagtgttagcagctacttagcctggtaccaacacgaaacctggaccaggcctacccgaggccttccccgtcacttacctattgaacttaccacttcccgtaacgacgggccacgtcggccaactccccgagcccgtagggttccgtaggtcggaccgtagggtcgggtacgtacggggaactaacggtacccttctaacgtcctaacccaccctaacttccgaacgcgtaacggaccctaaggaaccctaggtaaacgttacgttttacggacgtttaagttttaacttacgttacgttacaggtaccgtaggaccggtacgtacgggttcccgtttccgggaccccggttaggggtaaacccctaaaggggttacggtaacgttaacgtaaaccggtaaacggtaacgttacggttcgtacccggtagtacccgtaactacgttccttggttacctttacgttacccttcccttccccggactcgttacgttaaggtaaccg

SEQ ID NO: 203541 - DNA, 736 bp, Homo sapiens
  misc_feature: GYAE6OF02GRI1Q.36.4.A04.1.454.CMB.1.raw
  modified_base (467)..(467): a, c, t, g, unknown or other
  misc_feature (467)..(467): n is a, c, g, or t
tcagtacgctgtctcacgaccggtgctcgatttagagtagtgatcagggggaggaactgctcagttaggacccagagggaaccatggaagccccagctcagcttctcttcctcctgctactctggctcccagatactaccggagaaattgtgttgacacagtctcagccacctgtctttgtctccgaggggaaagcgacctacctctcgtgcggacggctacgtcgagtagttgttacgacacgtctacgttacgccgtaggtaaccaacgtaacgaaccgtcggaccgacggtcctaccgacggtcctaccgtcacttacttatagtactacgtaccttaccgtacgtaccggggacctacggtacggacctacctacccgacggtccgttaggttcgagggtggacgtaggttcgggtcgtacgggacgtacgtacgttaccgtctacctaccgactacgtaccncgtaccgacgtaaccgtaaccgtaaccgtaagttaacgtttacggtttacgatttaacgtttacttacgtcgttaccgagtacgtaacggtacggtacgggtccggtttaccggttcccggtaccggtaacgggtaaccgtaaagggttcgtaaacttaacgaaccggtaaaccgttacggtacggtacgtcgtaccggtacctacgtacgttccgttagtttaccttaccgtaccttcccgttacccgtacacttacgacgtaaccgg

SEQ ID NO: 203542 - DNA, 677 bp, Homo sapiens
  misc_feature: GYAE6OF02I2CLY.36.4.A04.1.454.CMB.1.raw
  modified_base (181)..(181): a, c, t, g, unknown or other
  misc_feature (181)..(181): n is a, c, g, or t
  modified_base (603)..(603): a, c, t, g, unknown or other
  misc_feature (603)..(603): n is a, c, g, or t
  modified_base (611)..(611): a, c, t, g, unknown or other
  misc_feature (611)..(611): n is a, c, g, or t
tcagtacgctgtctcacgaccggtgctcgatttagagtagtgatcagggggaggaactgctcagttaggacccagagggaaccatggaagccccagctcagcttctcttcctcctgctactctggctcccagatactaccggagaaattgtgttgacacagtctccagccacctgtctttntctccgaaggggaaagagcccaccctctccgtgcgagggccagtcgagagttgttagcagcttaacgtacgccttagggtaacccaacgaagaaacctcggacccgaggcccttacccgacggtccctacctcgtaactctatgaactactatccctacgacggtacccagtcggaccaccgtcccgacgacccgtaggttaccaaggtcggccggtaggtacgggttcggtcgggaacctaggttacctacgaaccttcctaccaccgtactcgaacgcaaccgtcgtaacggtactacgggtatttacgtttcggaactttagtttaacttcgttacttacggactcgacggacgaggtccggtacgttcccgggaccggtaggtacccgtaagtcggattacaacggtaaacgtaacgngtaccggngtaccgacgtctacgcgttcgtccttaccgtacttcccgtaccgacctagttacccgtagtaacgg

SEQ ID NO: 203543 - DNA, 789 bp, Homo sapiens
  misc_feature: GYAE6OF02FX342.36.4.A04.1.454.CMB.1.raw
  modified_base (200)..(200): a, c, t, g, unknown or other
  misc_feature (200)..(200): n is a, c, g, or t
  modified_base (216)..(216): a, c, t, g, unknown or other
  misc_feature (216)..(216): n is a, c, g, or t
  modified_base (529)..(529): a, c, t, g, unknown or other
  misc_feature (529)..(529): n is a, c, g, or t
tcagtacgctgtctcacgaccggtgctcgatttagagtagtgatcagggggagggaacgtgctcagttaggacccagagggaaccatggaagccccagctcagcttctcttcctcctgctactctggctcccagatactaccggagaaattgtgttgacacagtctccagccaccctgtctttgtcctccgaggggaaangccaccctctctgccngggccagtcagtagtgttagcgacgtctacttagcctagggtaacccaactacggaaaccgtggacccaaggtccttacccgacgggtcctcctacactaccttacgtagaacttacctacctccgtaacgacggggtcccacggttcggacaaccgtacccgaagcccgtaagggttccgaaggttccgggaccgtagggtacgggtccgttaggggaccgtaacggttccgttaccactaccgttacccaacccttacgtaccgaggacccgtacgtaccccgtaaacgaacccgtttagtaaacggtttntttacgtacgtttacggttttattaacggtcgttacgttacggtacgtacggtacggtaacgtaaggtaccgggtttccgttacccgggtacccgggttaacggtaaaccggttaaaggtacggttaaacgtaacgttaaaccggtaaacgttaacgggttccgtaggtacccgtacgtaaccgtaaccgtcgttaccgtttaccggttaccttcgtttaaccgttccccgttacccgtaacttaccgtaccgtaaaccg

SEQ ID NO: 203544 - DNA, 802 bp, Homo sapiens
  misc_feature: GYAE6OF02I5T45.36.4.A04.1.454.CMB.1.raw
  modified_base (196)..(196): a, c, t, g, unknown or other
  misc_feature (196)..(196): n is a, c, g, or t
  modified_base (300)..(300): a, c, t, g, unknown or other
  misc_feature (300)..(300): n is a, c, g, or t
tcagtacgctgtctcacgaccggtgctcgatttagagtagtgatcagggggaggaactgctcagttaggacccagagggaaccatggaagccccagctcagcttctcttcctcctgctactctggctcccagatactaccggagaaattgtgttgacacagtctccagccaccctgttctttgctccgaggggaanagcccaccctctacctgcgacgggcccagtcagtgtgttagcagctactagcctggtaccaacacgaacctggccaggcctcccgaggctaccgtcattcctanagtaactacctacgtaccctaacgaccgggtaccctacgtaccgggactaccgtaccccgacggtacccgtacgggtttaccgaacggttcggcggtaacggttcggggtaccggttacggggacctacggttaacttcccgtaccgttacccctaccgaacccctaacgttccgaccgacgtaccccggtaacccgtaaacccgtaaacccgtacgggttaaaccgtttaacgtttttacggtaaccgtttaacgtttttaaaccgttaccgtttacgtttacgaaccgttaccgaacggaaccggtacgggttaccgggtaccgtttttacccgggcccggttacgggtaaaccggttaaggtacggtaagttaaccgtaacggtaaacccgtaacgttcgggtaccggtacgttaccgtacgtaaccttacgttaccgtttaagtcctttacccgttaaccttccccggttacccgtacctcgttaccgtagtaaccgg

SEQ ID NO: 203545 - DNA, 1037 bp, Homo sapiens
  misc_feature: GYAE6OF02HM09I.36.4.A04.1.454.CMB.1.raw
  modified_base (132)..(132): a, c, t, g, unknown or other
  misc_feature (132)..(132): n is a, c, g, or t
  modified_base (152)..(152): a, c, t, g, unknown or other
  misc_feature (152)..(152): n is a, c, g, or t
  modified_base (322)..(322): a, c, t, g, unknown or other
  misc_feature (322)..(322): n is a, c, g, or t
tcagtacgctgtctcacgaccggtgctcgatttagagtagtgatcagggggaggaactgctcagttaggacccagagggaaccatggaagccccagctcagctctcttcctcctgctactctggcctcccanatactaccggagaaattgtnttcgactacacgtctccgacgccaccctgttcctttgtcctaccgaaggggtaagacgccctaccctccttcctcgaccgacgggccagttcgagtagttcgttacgctagcctacgttactccgtacggaacctaacgaacgtaaaccgtcggaccgtaacgggtcccncccggacgtccttaccctatacttcctaattacgtaactacctaaccgttaccgtaaccggacgggacccgtaccgtcggaaccctacttacccccgaacgtcccgttaagggttccccgtaagggtccggttacgggtaccggttcggggtttacggtacggggtaaaccgtacggtttaccccggttaacctaacccgttaccctaaacccgtaccccgtaacgttacccgaacgggtaccttaaaaccggtccgtaaaaacccggttttaccgtaaacccgggttaaaggttttttacgttttaccccggggaaacttttttaaaccgggtttaacccttttaccggttttaaaccccggtacggttaaaccgggtttaccgggtaacccggtaacggggttaaccgggtaaacccggggttttcccccgggtttttaaacccgggtcccccggggtaaaaccgggttaaaccccggtaaaggggttttacccggggaaattttaaaacccggggaaaacccgtttaaacggttaaccgggttttaccgggggaacccgtaccgggttccccggttaaacccttacccggggtttaaccttccgggtttaacccttttcccccggttaaaacttttaccccccccgggtttaacttttccccccgtaaccgttttaacccccggtttaagggaacccgtttaaaaccccggg

SEQ ID NO: 203546 - DNA, 741 bp, Homo sapiens
  misc_feature: GYAE6OF02JYSCW.36.4.A04.1.454.CMB.1.raw
  modified_base (209)..(209): a, c, t, g, unknown or other
  misc_feature (209)..(209): n is a, c, g, or t
tcagtacgctgtctcacgaccggtgctcgatttagagtagtgatcagggggaggaactgctcagttaggacccagagggaaccatggaagccccagctcagcttctcttcctcctgctactctggctcccagatactaccggagaaattgtgttgacacagtctccagccaccctgttctttgctccgaggggaagcgccacctctccngctagggccaggtcagtagttgttagcacggcttacttacgcccgttaggtaacccaacgacgaaccgtcggaccgaaggcctacccgaaggtcctcctcactccgtagtacgattaacgacttacccgtaacgacgggtacctaccgtacgggccaaccgttccccggaaggacccgttaaggtccgtagggtcgggtaccgtacggggttgggtccgtaagggggtactaaccggtactttacccgaccgttacccgaacctaacccgtactaccgaacgcccgtacggtcctcggaacggtaacgtagggtaaccgaaagttccgtttaccggtagtttacgtttttattacgttcgtaacgagttaccgtaaagtttataaacgggtacttacgggcccgtttaaccggtaccgttacggttacgggaaccggtaacggtacggacgggttaggactacgtaacgtaacgtacggttaggcctaaggtaccacgttactagtccgttcgttacctcgtacccttcccg

SEQ ID NO: 203547 - DNA, 800 bp, Homo sapiens
  misc_feature: GYAE6OF02IUPKU.36.4.A04.1.454.CMB.1.raw
  modified_base (213)..(213): a, c, t, g, unknown or other
  misc_feature (213)..(213): n is a, c, g, or t
tcagtacgctgtctcacgaccggtgctcgatttagagtagtgatcagggggaggaactgctcagttaggacccagagggaaccatggaacgccccagctcacgcttctcttcctcctgctactctggctccagatactaccggagtaattgtgttgacactagtctaccagccctaccttgttacgtttgtacccgtaccggaaggggaaacncgaccctacccttacgtccgtacggacgacgggtaccacggttacgaacggtagtttacggtacgacgtacggtaccttaacgttaacggccgttacggtaaacccaacgtaacgtaaccgtcggacctaaccggtccctacccggtacggtacccttaccgtacttaacgttaccgtaacgttacgtaacctacgaccttaccgtacgaccggtactacggtcgaccgtaccgtaccgtacgtaaccggttacggttacgtaggaccggttacggtacgggttcggtaaccggtaggtaccgtacgttaacctaccggtacttaccgtacctaaccactacggacctacgtacgtacctaagttacgaagtaacgtttcgttacgtacttaaggtttactcgtacaacgtcgtacgtaggtacggtaccgtacggttccgtaccggttaaccgtacggaacgttaacgtcggttaacacgttaacgtaaacggtacgtacgtcgtactaccgtacgtacttacggttcgtaacgtttcctacgtaccgtttacccgtaccgtaccgttaacgtacgtactaaccgg

SEQ ID NO: 203548 - DNA, 599 bp, Homo sapiens
  misc_feature: GYAE6OF02FP7ZI.36.4.A04.1.454.CMB.1.raw
  modified_base (304)..(304): a, c, t, g, unknown or other
  misc_feature (304)..(304): n is a, c, g, or t
  modified_base (473)..(473): a, c, t, g, unknown or other
  misc_feature (473)..(473): n is a, c, g, or t
tcagtacgctgtctcacgaccggtgctcgatttagagtagtgatcagggggtctcagagaggagccttagccctggactccaaggcctttccacttggtgatcagcactgagcacagaggactcaccatggaattggggctgagctgggttttccttgttgctattttagaggtgtccagtgtgaggtgcagctggtggagtcgtgggggaggcttgggtccgaggccggggggggtccctggagactctcctgtgcagcctctggattcatcttgagttagttattggatggacttgggtccnccaggctccgagggagggctgcaggtgggtgccaacattaaggagagtgaagtgagacatactatgtggactgtgtggaagggccgtattaccacctaattccctaccgaaggacgaacaacgccgaaaacgtaacctcacttgtaactcgtagaccaaaatcgaaacncgtccgtaggagacgggacgaaggaccgacgggcttaggttcggtaatttaacgtcggtagggacccggaagggtaccctaaagttacgttaacggtttgggggtttacgaccgttaattttaacg

SEQ ID NO: 203549 - DNA, 725 bp, Homo sapiens
  misc_feature: GYAE6OF02F1VT1.36.4.A04.1.454.CMB.1.raw
  modified_base (197)..(197): a, c, t, g, unknown or other
  misc_feature (197)..(197): n is a, c, g, or t
  modified_base (300)..(300): a, c, t, g, unknown or other
  misc_feature (300)..(300): n is a, c, g, or t
  modified_base (328)..(328): a, c, t, g, unknown or other
  misc_feature (328)..(328): n is a, c, g, or t
tcagtacgctgtctcacgaccggtgctcgatttagagtagtgatcagggggaggaactgctcagttaggacccagagggaaccatggaagccccagctcagcttctcttcctcctgctactctggctcccagatactaccggagaaattgtgttgacacagtctccagccaccctgtctttgtctccaggggaaagngccaccctctcctgcagggccagtcagagtgttagcagctacttagcctggtaccaacgagaacctgccaggcctccgaggcctcctacatctatcgaatacnctacctacgacgggccacgtcgcgtacnccagacctaggttcaaggtcggactaggtcgggttacgtagggaacacggtaccttacaccttctacgaaccctactacgtaacgccgaacgtacccgaaacgtaaccctaggtaaacgttacgttttaggacctttaagttttaaccttacgtttacgtacgacgtacgtacggtacgtaagggtaccggttccgtttaccgggcccggttaaccggggtaaaccgtaaagggttacggttaaccgttaaagtaacccgtaaaaacggtaaccgttacgggtaccggtccgttacggaaccctaaccgttaacgttaccttcgggttttaccttaacccgttacgtttcccccgtttaacccggtacccttaacggttaccgttacggtaaaccgg

SEQ ID NO: 203550 - DNA, 746 bp, Homo sapiens
  misc_feature: GYAE6OF02IUKGL.36.4.A04.1.454.CMB.1.raw
  modified_base (202)..(202): a, c, t, g, unknown or other
  misc_feature (202)..(202): n is a, c, g, or t
  modified_base (361)..(361): a, c, t, g, unknown or other
  misc_feature (361)..(361): n is a, c, g, or t
tcagtacgctgtctcacgaccggtgctcgatttagagtagtgatcagggggaggaactgctcagttaggacccagagggaaccatggaagccccagctcagcttctcttcctcctgctactctggctcccagatactaccggagaaattgtgttgacacagtcctccagccaccctgttcctttgtctccgaagggggaaancgccctaccctcgtcctcgcgacgggtcagtcgagtaggttgttacgcgagtccttaacgttaccgccgttacggtaaccaaaccgaacggtaaccgtcggaccgagggccctacccggacggtccttcccgtactaacttctaacgtctaacgtaccncgttaccctaacggacgggaccctaacggtccggaacctaccgtaccccgaggtcccgttaagggttcgacggttacgggaccgttaacgggttggtacgtacgggactaaccgtctacgtactcctacacctacgtcaacggtctaacgtacctaacggtaaccttaggtaactttaacgttcgtaagtttacgttacgtttacgtatacgactacggtaggcgtaacgggtaccgttccgttacgggtaccggtaggtaaaccgtaggttacgaagttaccgtaacaacggttaacgtgtaaccggtctaacgtccgtaaccttcgttaccgttgtccctttaacgcgtttccccgtcccggaacttccgtacgtaactacgg

SEQ ID NO: 203551 - DNA, 796 bp, Homo sapiens
  misc_feature: GYAE6OF02IKJMN.36.4.A04.1.454.CMB.1.raw
tcagtacgctgtctcacgaccggtgctcgattttagagtagtgatcgagggggaggaactgctcagttaggacccagagggaaccatggaagccccagctcagcttctcttcctcctgctactctggctaccagatactaccggagaaattgtgttgacacagtctccagccaccctgttctttgtcctacgaggggaagacgccaccctctcctgccagggccagtcagtagttgttagacagtaccttaacgttagcccgttaggtacctaaacgaacgtaaacccgtcggaccaacggcctaccccgtaaggcccttacctacgaacttcgtaactcggtaaaccttaacctaacgttaccccgttaaccggaacggtacccctacggtacggtcctaaccgtcccgaagtcccgtaagggttccagggtcgacgtggttcgggtaccgtagggaactcgtaaccgtttcgaaccttccgtaaccaaccgttataccgaacgtccgaaaccgtaacctacggtaaaccgttaggtaaacgtttagttttacgacgtttaaacgttttaccgttacgtcgttacaacgtcgaaggtaccggtaggtaccgtccggtttaccggacccgttagggtaaaccgtaaagttacggtaacttaacgtaaaccggtaaaccgtacgtacgggttaccggacgttaaccgacgttaaccttacggttacctttaccgggttactttacccgtaccgtttacccgttaccccgtaccgttagttacccaacggtaacccgg

SEQ ID NO: 203552 - DNA, 782 bp, Homo sapiens
  misc_feature: GYAE6OF02HWBHU.36.4.A04.1.454.CMB.1.raw
tcagtacgctgtctcacgaccggtgctcgatttagagtagtgatcagggggtctcagagaggagccttagccctggactccaaggcctttccacttggtgatcagcactgagcacagaggactcacatggaattggggctgagcgttgggttttccttgttgcttattttagaggtgtcagtgtgaggtgcagctggtggagtcggtgggggaggtcgttgggtccgacggggtcccgggggggtccctggacgtaccttcctccgtagtcgcacgtccttcgtggtacttctattcgttagtagttagttagttggatggtacggttcgggtcccgcgacgggtctaccgggaagggggacgggtctcggcggtagggttcgggggtaccggacctaaacgtaaggttaaagggaacggtaaggtaggggaaaggtagtaacgactaacgtaacgttaggtggtaacggtacttacggtcggtaagggaacgggtacctacgttcccgaacgtagttccctacggacggaaacgtaaccaaccgggtaaccaaacgtaccgttacgtaaccgttacgtacttaccgtaacggaacgtaaactacggaaacctcgtaaccggttaggaaacggggcggtaacccggaacggtaccgtacggtacgggttagtttacggttaaaccgttcgggttcggaaccggggtacggtaaccggggtaacccttaaggttacggtttacgggtttaccgggggttacttaacggttaacttttaacggg

SEQ ID NO: 203553 - DNA, 847 bp, Homo sapiens
  misc_feature: GYAE6OF02FMUNG.36.4.A04.1.454.CMB.1.raw
  modified_base (151)..(151): a, c, t, g, unknown or other
  misc_feature (151)..(151): n is a, c, g, or t
  modified_base (196)..(196): a, c, t, g, unknown or other
  misc_feature (196)..(196): n is a, c, g, or t
  modified_base (255)..(255): a, c, t, g, unknown or other
  misc_feature (255)..(255): n is a, c, g, or t
tcagtacgctgtctcacgaccggtgctcgatttagagtagtgatcagggggaggaactgctcagttaggacccagagggaaccatggaagccccagctcagcttctcttcctcctgctactctggctcccagatactaccggagaaattgngttgacacagtctccagccaccctgtctttgtctccaggggaaancgccaccctctcctgcgaggccagtcagagtgtagcagctacttagcctaggtaccaanacgaaacctgggaccaggcctcccgaggtcctcctacatctatcgaactactacgtaccctaacgacgggaccctaacgtacggctaacctacccccgtaaggcccctaagggtttccgaaggttcggaccgttaagggtcgggggttaccgtacgggggaacacgggtaacgttttaccgaccttaccttaccgaaccctaagttacccgaaggtacccacgttacccgtacggtaccgtaacggttacgtaaggtaaacggttacgtttttacggtaacgtttaaggtttttaaactttaaccgtttaacggttaaacccgtaaaagttaaccggttaaaacctaaacgttaaccgggtaaccgttacgggttaacccttccggttacccgtttacccgggtttacgggggtaccggggtaaacgggtaaccggtaaaggggttacgggaaacgtttacggtaaaccggtaaaccggttaaaccggtaacccggggttttaagggtaacccgttacccggtaaccgttaacccgttacgttaccgttttaaccgggtttacccttttaaccgtacccggtttacccccgg

SEQ ID NO: 203554 - DNA, 506 bp, Homo sapiens
  misc_feature: GYAE6OF01AFO5G.24.85.H08.1.454.CMB.1.raw
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggattcgccttcaataacttctggatgcactgggtccgccaagctccagggaaggggctgatttgggtctcacgtattaacatttgatgggagtagctcacactatgcggactccgtgaagggccgattcaccatctccagagacaacgccagaacacactgtatctgcaaatgagcagcctgaagccgacgacacggctgtgtattactgtgcagaggggccagcattactcctactactccgctatggacgtctagggccaagggccgtacggg

SEQ ID NO: 203555 - DNA, 531 bp, Homo sapiens
  misc_feature: GYAE6OF01CPD4C.24.85.H08.1.454.CMB.1.raw
  modified_base (246)..(246): a, c, t, g, unknown or other
  misc_feature (246)..(246): n is a, c, g, or t
  modified_base (286)..(286): a, c, t, g, unknown or other
  misc_feature (286)..(286): n is a, c, g, or t
  modified_base (325)..(325): a, c, t, g, unknown or other
  misc_feature (325)..(325): n is a, c, g, or t
tcagactactatgtcacgaccggtgctcgatttagtatcactcagtcgcggggagcccagccctgggattcccagctgtttctgcttgctgatcaggactgcacacagagaactcaccatggagtttgggctgagctgggttttccttgttgctattttaaaaggtgtccagtgtgaggtgcagctggtggagtccggggagcttagttcagccgtgggggtcctgagactctcctgtgcagcctntggattcgccttcaataacttctggatgcacgtgggtccncaagctccgagggagggctgatttggctcacgtataacnttgatgggactagctcacactatgcgactcgtagaacgggccattcgactatctaccagacgacaacgccaagaaacacactgtatctagacaaatgagcagcctagaacgccgacgacacgctgtagttattacgtgtagacgaaagggaggggaccaggacctaatttaccgtacccttaactaccctccgtctagttacgggg

SEQ ID NO: 203556 - DNA, 528 bp, Homo sapiens
  misc_feature: GYAE6OF01BO77E.24.85.H08.1.454.CMB.1.raw
  modified_base (268)..(268): a, c, t, g, unknown or other
  misc_feature (268)..(268): n is a, c, g, or t
  modified_base (310)..(310): a, c, t, g, unknown or other
  misc_feature (310)..(310): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggattcgccttcaataacttctggatgcactgggtccnccaagctccagggaggggctgatttgggctcacgtattaacnttgatgggatagctcacactatgcggactccggtgaacggccgattcacatctccagagacaacgccaagaaaccacactgtatctagacaaagtgagcaacgcctagaaacgcccgaacgacacggctgtagtattactgtgacgaggacggggccagcaattacctcctactacctcgactagtacggtacgtcgaggggccaaagggtccacggg

SEQ ID NO: 203557 - DNA, 520 bp, Homo sapiens
  misc_feature: GYAE6OF01C584W.24.85.H08.1.454.CMB.1.raw
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggattcgccttcaataacttctggatgcactgggtccgcaagctccagggaaggggctgatttgggtctcacgtattaacattgatgggatagctcacactatgcggactccggtgaaggccgattcacatctcagagacaacgccagaaacacactgtatctgacaaatgagcagcctagaacgccgagacacgctgtgtatacgtgtgacaggacggggccagcctattaccgtcctactacctccgtctagtcggtacgtcgtaggggacccaagggccgtacgggg

SEQ ID NO: 203558 - DNA, 520 bp, Homo sapiens
  misc_feature: GYAE6OF01D3SGR.24.85.H08.1.454.CMB.1.raw
  modified_base (499)..(499): a, c, t, g, unknown or other
  misc_feature (499)..(499): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggattcgccttcaataacttctggatgcactgggtccgccaagctccgagggaagggctggatttgggtctcacgtattaacattgatgggatagctcacactatgcggactccgtgaaggccattcaccatctccagagacaacgccaagaaacacactgtatctgacaaatgagcagcctagaaacgccgacgacacggctgtgtattacgtgtgacgaggacggggaccagcattactcctactactccgctagtcggtacgtcgnggggaccaagggccgtacggg

SEQ ID NO: 203559 - DNA, 682 bp, Homo sapiens
  misc_feature: GYAE6OF01C44D8.24.85.H08.1.454.CMB.1.raw
  modified_base (242)..(242): a, c, t, g, unknown or other
  misc_feature (242)..(242): n is a, c, g, or t
  modified_base (530)..(530): a, c, t, g, unknown or other
  misc_feature (530)..(530): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggattcgccttnaatacttctggatgcacgtcgggtccgccaagcctccgaggggaaggggctggtagttttggggtctcgacgttattaaacatttggagtggggaattagcttcaacgacttatggccggtaactcccggtaggaacggggccgtaaatttccgaacctagttccctacccgaaggacgaaccaaccgacccaagaaacacgactagtaactctagactaaaagtgacgcgtacgacctagaaacgcccgaacgaccgaacggtcctaggttacgttaagtttaccgnggttacgaccgaaggggacgggggaccctaaggaccttaaagtttacccctacccttaaccgttaacccttccccggacttaacgttacggggtaacccggtttacccggtaggggggacccccgtaaaagggggccccgttaaaccggggg

SEQ ID NO: 203560 - DNA, 533 bp, Homo sapiens
  misc_feature: GYAE6OF01CW2U8.24.85.H08.1.454.CMB.1.raw
  modified_base (268)..(268): a, c, t, g, unknown or other
  misc_feature (268)..(268): n is a, c, g, or t
  modified_base (525)..(525): a, c, t, g, unknown or other
  misc_feature (525)..(525): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccccgagactctcctgtgcagcctctggattcgccttcaataacttctggatgcactgggtccnccaagctccgagggagggctgatttgggctcacgtattaacattgatgggatagctcacactatgcggactccggtaggaacgggccattcacatctcagacgacaaccgcaagaacacactgtatcagacaaatgagcacgacgtagaacgccgacgacgagtctgtagtactacgtgtagacgaaggacgggaccagtctattacctcctacctactccgctagtcggtacgtcggtacgggaccaacgggccgngggtaccc

SEQ ID NO: 203561 - DNA, 513 bp, Homo sapiens
  misc_feature: GYAE6OF01DM70P.24.85.H08.1.454.CMB.1.raw
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggattcgccttcaatacttctggatgcactgggtcccgccaagctccagggaaggggctgatttgggctcacgtattaacattgatgggatagctcacactatgcgactccgtgaagggccattcacatctccagacacaacgccaagaacacactgtatctagacaaatgagcagcctagaacgccgacgacgacggctgtgtattacgtgtgacgaggaggggccagcattactcctactactccgctagtcggtacgtcgtgggccaagggccgtacggg

SEQ ID NO: 203562 - DNA, 516 bp, Homo sapiens
  misc_feature: GYAE6OF01EO77K.24.85.H08.1.454.CMB.1.raw
  modified_base (268)..(268): a, c, t, g, unknown or other
  misc_feature (268)..(268): n is a, c, g, or t
  modified_base (367)..(367): a, c, t, g, unknown or other
  misc_feature (367)..(367): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggattcgccttcaataacttctggatgcactgggtccnccaagctccagggaaggggctgatttgggctcacgtattaacattgatgggagtagctcacactatgcggactccgtgaaggccatcacatctccaganacaacgcagaacacactgtatctgacaaattagcagcctagaaacgccgacgacacggctgtgtattactgtgcgaaggacggggcagctattactcctactactccgctatcggacgtcgtacggggaccgaacgggccgagggtccc

SEQ ID NO: 203563 - DNA, 552 bp, Homo sapiens
  misc_feature: GYAE6OF01DQZYL.24.85.H08.1.454.CMB.1.raw
  modified_base (242)..(242): a, c, t, g, unknown or other
  misc_feature (242)..(242): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggattcgccttnaatacttctggatgcactgggtccgccaagctccgagggaaggggctgatttgggctcacgtataacattgatgggagtagctcacactatgcggactccgtgaacgggccattcaccatctccagagacaacgcagaacacactgtatctgacaaatgagcagcctagaaacgccgacgacgacggctgtgttattacgtgtagacgaagggacgggggccaggccgtaatttacccgtccttaaccttacctcccgtactagtacgggtacggttacgtgggggacccaaacggggcccgtaacgggg

SEQ ID NO: 203564 - DNA, 561 bp, Homo sapiens
  misc_feature: GYAE6OF01CR0CA.24.85.H08.1.454.CMB.1.raw
  modified_base (353)..(353): a, c, t, g, unknown or other
  misc_feature (353)..(353): n is a, c, g, or t
  modified_base (359)..(359): a, c, t, g, unknown or other
  misc_feature (359)..(359): n is a, c, g, or t
  modified_base (383)..(383): a, c, t, g, unknown or other
  misc_feature (383)..(383): n is a, c, g, or t
  modified_base (390)..(390): a, c, t, g, unknown or other
  misc_feature (390)..(390): n is a, c, g, or t
tcagactactatgtcacgaccggtgctcgatttagtatcactcagtcgcgggggagccccagccctgggattcccagctgtttctgcttgctgatcaggactgcacacagagaactcaccatggagtttgggctgagcttgggttttccttgttgctattttaaaaggtgtccagtgtgaggtgcagctggtggagtccgggggaggcttagttcagccgtggggggtccctgagactctcctgtgcagcctctggattcgccttcaataacttctggatgcacgtgggtccgccaagctccgaagggaaggggctgagtttgggctcacgtattaacattgatggatagctnacatangcgactcgtgagggccattcacanctcaganacacgacaagaaacacatgtatctagacaaatgaagcacgaccgtaagaaacgcccgaacgaccgacggtactagttagttaattacgtacgtgacggaaacgggagggggaccacggacctaacgttaaccttacccgtaacttaacccgcccgtcgtacgttaccgggg

SEQ ID NO: 203565 - DNA, 527 bp, Homo sapiens
  misc_feature: GYAE6OF01B6YNZ.24.85.H08.1.454.CMB.1.raw
  modified_base (267)..(267): a, c, t, g, unknown or other
  misc_feature (267)..(267): n is a, c, g, or t
  modified_base (420)..(420): a, c, t, g, unknown or other
  misc_feature (420)..(420): n is a, c, g, or t
  modified_base (433)..(433): a, c, t, g, unknown or other
  misc_feature (433)..(433): n is a, c, g, or t
  modified_base (445)..(445): a, c, t, g, unknown or other
  misc_feature (445)..(445): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggattcgccttcaatacttctggatgcactgggtccncaagctcgagggagggctgatttggctcacgtattaacattgatgggatagctcacactatcgcggactccggtaggaacgggccattcaccatctaccagagacaacgccaagaaacacactgtatctagactaaatgagcagcctagaacnccgagacgacggntagtgtattacngtgacgaaggcggggccagctaagttacctcctaactactccgatagcggtacgtcgtaggggacccaaggggcctaacggg

SEQ ID NO: 203566 - DNA, 534 bp, Homo sapiens
  misc_feature: GYAE6OF01EK4N2.24.85.H08.1.454.CMB.1.raw
  modified_base (269)..(269): a, c, t, g, unknown or other
  misc_feature (269)..(269): n is a, c, g, or t
  modified_base (367)..(367): a, c, t, g, unknown or other
  misc_feature (367)..(367): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggattcgccttcaataacttctggatgcacgtgggtccnccaagctccgaggggaagggctgtatttgggtctcacgtattaacattgatgggatagctcacactatgcggactccgtggaaggccattcaccatcnccagagacaacgccaagaaacacactgtatctagacaaatgagcagcctagaacgccgacgacgacggctgtgtattacgtgtgacgagggacggggccagctacttacctcctacctacgtccgactagtcggtacgtcggtaggggacccgaagggccgtacggg

SEQ ID NO: 203567 - DNA, 552 bp, Homo sapiens
  misc_feature: GYAE6OF01BUB5Q.24.85.H08.1.454.CMB.1.raw
  modified_base (267)..(267): a, c, t, g, unknown or other
  misc_feature (267)..(267): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggattcgccttcaatacttctggatgcactgggtccncaagcctccgaggggaagggctgatttgggctcacgtattaacattgatgggatagctcacactatgcggactccggtagaacggccattccacatctccgagagacaacgccaagaacactactgtatctagacaaatgagcacgccgtagaacgccgaacgacgacggctggtagttaattacgtggtcgacgtaagggcggggaccaggctaacgttaccgtcctaactacctccggcttagtcggaccgttcggtacggggacccaaggggcccgtacggg

SEQ ID NO: 203568 - DNA, 693 bp, Homo sapiens
  misc_feature: GYAE6OF01BH40M.24.85.H08.1.454.CMB.1.raw
  modified_base (302)..(302): a, c, t, g, unknown or other
  misc_feature (302)..(302): n is a, c, g, or t
  modified_base (355)..(355): a, c, t, g, unknown or other
  misc_feature (355)..(355): n is a, c, g, or t
tcagactactatgtcacgaccggtgctcgatttagtatcactcagtcgcgggggagccccagccctgggattcccagctgtttcctgtcttgctgatcaggactgcacacagagaactcaccagtggtaggttggctgaggctgggtttccttaggttgctaatttaaaggtgtcagtgtgaggtgcagctggtggaggtccgggggaggtcttagttcagccgtgggggtccctgagactctcctgtgcacgcctctggacttcgccttacaattaacttctggatggctacgtgggtccnccaagctccgaggggaagggtctaggtagtttgggtctcgtacgttattaacntttgagtgggagtgctcaactacgtatggccgtactccggacggaacgggtccgtaattccgaacctacgtacctaccgaagacgaaccgaaccggaacccaaacgaaaccaaccgaacttacggtaacttacctacggaacctaaagtcgaacgtcgaacgtaccgtaacggaaaccgacccggaaccgtaccggtacggtacgttacggttacggttaacgttacggttacggtacggtaacggtaaagggaccgggggtacccaacggtaccgttaacgttacccgttaccccgttaacccttaccgtaccccgttggttaccgttaacccgggg

SEQ ID NO: 203569 - DNA, 555 bp, Homo sapiens
  misc_feature: GYAE6OF01BGVOQ.24.85.H08.1.454.CMB.1.raw
  modified_base (242)..(242): a, c, t, g, unknown or other
  misc_feature (242)..(242): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggattcgccttnaataacttctggatgcactgggtccgccaagcctccgaggggaagggctgatttgggtctcacgtattaacatttgatgggatagctcacactatgcggactccggtaggaacgggccattccaccatcctccagacacaacgccaagaaacacactagtatcagacaaatgagcagcctagaacgccgacgacacggctgtagtacttactgtagacgaaggacggggaccaggacctaagttacctacctacctaccgtccacgtacgtcgggtaccgtcggtaggggacccgaacggggcccgtacgggg

SEQ ID NO: 203570 - DNA, 574 bp, Homo sapiens
  misc_feature: GYAE6OF01AI5LL.24.85.H08.1.454.CMB.1.raw
tcagactactatgtcacgaccggtgctcgatttagtatcactcagtcgcgggaggacgctgaccacacggtacgtgctgttgtactgctcctcccgcggcttgtcttggcattatgcacctccacgccgtccacgtaccagttgaacttgacctcagggtcttcgtggctcacgtccaccaccacgcatgtgacctcaggggtccctgagactctcctgtgcagcctctggattcgccttcaataacttctggatgcactgggtccgcaagctccgagggaaggggctgatttgggtctcacgtattaacattgatgggagtagctcacactatgcggactccgtgaaggccgattcaccatctccagagacaacgccagaacacactgtatctgacaaatgacgacagcctagaaacgccgacgacacggctgtagtattacgtgtacgacgaaggagggggaccaggcctaagtttacccgtacccttaccttaaccgtccccggtacgttacgttacgggaaccggtttccgtaggggggacccctaaaggggggtaccccgtaacggggg

SEQ ID NO: 203571 - DNA, 573 bp, Homo sapiens
  misc_feature: GYAE6OF01DJQFD.24.85.H08.1.454.CMB.1.raw
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggattcgccttcaataacttctggatgcacgtgggtcccgccaagcctccgaggggaaggggctggtagtttgggtctcgacgttattaacattgagtgggagtagctcaacactatgcggactccgtaggaacgggccgattccacctatcctacagacgaccaaccgccaaagaaaccacgtactgtactctagacaaagtgagcacgcctagaacgccgaacgacacggctagtagttattacgtgacgacgagggacggggaccagcctattaccgtccttacttacctccgacttagcgggtacgtcggacggggaacccgaaggggccgtaccgggg

SEQ ID NO: 203572 - DNA, 887 bp, Homo sapiens
  misc_feature: GYAE6OF01DR0O0.24.85.H08.1.454.CMB.1.raw
tcagactactatgtcacgaccggtgctcgatttagtatcactcagtcgcgggggagccccagccctgggattcccagctgtttctgcttgctgatcaggactgcacacagagaactcaccatggagtttgggctgagtcttgggttttccttgttgtcttaattttaaaaggtgtccagtgtgaggtgcagcgtgggtggaggtccgggggaggtcgttagttcgaggtccgtggggggtccctggagacttctcctgtgcagcctcgtggtacttccgcctttacaaacttaacctttcgtagggtattcggcctaccggttcgggggtaccccgaccgtaaacggtccgtacccgggaagggggtaacgggggtcctttagggttaacggtttttcggggttaccttaccggtaaacgttttaacgtttaaaccgtaagtttagggaaggtttagggggtaaacgttacggtaccttaccgtaaaccgtaacgtttaaggtcgggtaccgggttaaccgttacccggggttacgggaaaccggggtacccgttaacgtttacccgaacccgtacgttacccgtacccgaaaggaaccgaaacccgaaacccggaaccccgaaaaggaaaaccctaccgtaaacgttgttaaccttacgtaacggaacctaaaagtcggaacgtaccgaacggtacccgtaaaggaaacccggacccggaaccggaaccgtaccgggtctttagggttacgttaaaccgtttacggtacgggtaaccgaaacgggtaaacgggggacccgggggtacctaaacgggtccctttaaacgttttaccccgtaccctttaaaccgttacccgttacccggtagttacggttacccgggg

SEQ ID NO: 203573 - DNA, 523 bp, Homo sapiens
  misc_feature: GYAE6OF01CFLGR.24.85.H08.1.454.CMB.1.raw
  modified_base (397)..(397): a, c, t, g, unknown or other
  misc_feature (397)..(397): n is a, c, g, or t
  modified_base (470)..(470): a, c, t, g, unknown or other
  misc_feature (470)..(470): n is a, c, g, or t
tcagactactatgtcacgaccggtgctcgatttagtatcactcagtcgcgggggagccccagccctgggattcccagctgtttctgcttgctgatcaggactgcacacagagaactcaccatggagtttgggctgagctgggttttccttgttgctattttaaaaggtgtccagtgtgaggtgcagctggtggagtccgggggaggcttagttcagcctggggggtccctgagactctcctgtgcagcctctggattcgccttcaataacttctggatgcacgtgggtccgccaagctccgaggggaaggggctggatttgggtctcacgttattaacattgagtgggagtagctacacactatgcgactcgtgaagggccattcaccatctcaganacaacgccaagaaacacactgtatcagacaatgagcagcctaggaacgccgacgacacggctgtgtattacgngtagacgaaggaggggccagctaattacctcctaactacctcgcttagtcggg

SEQ ID NO: 203574 - DNA, 695 bp, Homo sapiens
  misc_feature: GYAE6OF01B4UAQ.24.85.H08.1.454.CMB.1.raw
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcgacggggtccctgacgactctcctgtgcacgcctcgtggacttccgccttacaaacttaacttcgtggtatgcctacgtcgggtccaccaagcctaccggaagggggaacggggtctaggtacgtttcggggtctacgtaacgttaacttaactagtttggagttaggggacgttacgcctacgaactacttagtcggacggtaccgtccggtaggaaacgggtcctaattcccaacctacgtcctaccgaaggacgaaaccgaaccgaccaaacgaaaccactacgtagtactacgtacgactaaagtgaacgacgtaacgtaccgtaaggaaccgcccggaacgaccgtacggtctacggttacgttaacgttacgcggttacgacggaacggggacgggaccacgtaccttacgttaccgtccgtaacgtacccgtccgacgttacggtacggtacggtacggtacggggacccgaaacggggtcccgtacggg

SEQ ID NO: 203575 - DNA, 553 bp, Homo sapiens
  misc_feature: GYAE6OF01ERBAX.24.85.H08.1.454.CMB.1.raw
tcagactactatgtcacgaccggtgctcgatttagtatcactcagtcgcgggggagccccagccctgggattcccagctgtttctgcttgctgatcaggactgcacacagagaactcaccatggagtttgggctgagctgggttttccttgttgctattttaaaaggtgtccagtgtgaggtgcagctggtggagtccgggggagcttagttcagccgtggggggtccctgagactctcctgtgcagcctctggattcgccttcaataacttctggatgcacgtcgggtccgccaagcctaccgaggggaaggggctggtagtttcggggtctcgtacgtattaacattagagtgggagtagctcacactagtcgacggactccggtaggaacgggccgtattccgacctatcctaccaaggacgacaacgaccaacgaaacacactgtactcagacaatgagcagcctagaacgccgacgacgacgctgtagtattacgtgtcgacgaagggaggggctagctattacctacctactacctcgctgtacggg

SEQ ID NO: 203576 - DNA, 608 bp, Homo sapiens
  misc_feature: GYAE6OF01BRMJL.24.85.H08.1.454.CMB.1.raw
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggattccgccttcaataacttctggatgcacgtgggtcccgcaagcctccgaggggaaggggctggtagtttgggctcgacgttaattaacattgagtgggatagctacactactatggcgactccggtaggaacgggcctattccacctatcctaccgaagacgaccaacgaccaagaaaccacactgtactcagacaaagtgagcagcctaggaacgcccgaacgacacggtcttggttagttactttacgtggtacgacgtaagggacgggcccaaggtacctaacgtttacccgtcccgttaactacccgtcccgacgttaggtcgggtaccggttccggtagggggaaccctaaagggggcccgtaaccgggg

SEQ ID NO: 203577 - DNA, 569 bp, Homo sapiens
  misc_feature: GYAE6OF01DTW2Z.24.85.H08.1.454.CMB.1.raw
  modified_base (266)..(266): a, c, t, g, unknown or other
  misc_feature (266)..(266): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggattcgccttcaatacttctggatgcactggtccncaagctcgagggagggctgtattgggctcagtattaacattgatgggagtagctcactactatgcggactccgtagaacggccgatccacatctccgagacgacaacgccaagaacacactgtatctagacaaatgacgcacgcctagaacgccgacgacgacggactgtacgtattacgtagtgacgagggacggggaccagtacctacgttacctaccccgttaacttacccgtcccgacgttagtacgggtaccgttaccggtagggggaacccggtaaccggggacccggtaaccgggg

SEQ ID NO: 203578 - DNA, 571 bp, Homo sapiens
  misc_feature: GYAE6OF01CJEPR.24.85.H08.1.454.CMB.1.raw
  modified_base (268)..(268): a, c, t, g, unknown or other
  misc_feature (268)..(268): n is a, c, g, or t
  modified_base (459)..(459): a, c, t, g, unknown or other
  misc_feature (459)..(459): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggattcgccttcaataacttctggatgcactgggtccncaagctccgaggggagggctgatttgggctcacgtattaacatttgatgggatagctcacactatgcggtactccggtggaaacggggcctaattccaacctatcctaccaaggacaaccaacgccaagaaaacacacgtagtactctgaacaaatgagacagcctagaaacgccgaacgacacggctgtntattactgtgacgaaggacggggaccagctaatttaccgtcccttaactacctccgacttaagtcgggtaaccggttcgtacgggggacctaaacgggggcccgtacggggg

SEQ ID NO: 203579 - DNA, 557 bp, Homo sapiens
  misc_feature: GYAE6OF01EJKMD.24.85.H08.1.454.CMB.1.raw
  modified_base (268)..(268): a, c, t, g, unknown or other
  misc_feature (268)..(268): n is a, c, g, or t
  modified_base (379)..(379): a, c, t, g, unknown or other
  misc_feature (379)..(379): n is a, c, g, or t
  modified_base (389)..(389): a, c, t, g, unknown or other
  misc_feature (389)..(389): n is a, c, g, or t
  modified_base (468)..(468): a, c, t, g, unknown or other
  misc_feature (468)..(468): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggattcgccttcaataacttctggatgcactgggtccnccaagctccgagggaggggctgatttgggctcacgtattaacattgagtgggatagctcacactatgcggactccgaggaacggcattcactatcctcaagacgaacaacnccaagaaacncactgtactctagacaaatgagacacgcctagaacgccgaacgacgacggctagtgttacttacgtgtagacgaagggnggggccaggacctaagttaccctccgttacctacgtcccgacttagcggtaccggtcgtacgggggaccctaaacggggccgtaccggg

SEQ ID NO: 203580 - DNA, 506 bp, Homo sapiens
  misc_feature: GYAE6OF01EV3Z3.24.85.H08.1.454.CMB.1.raw
  modified_base (475)..(475): a, c, t, g, unknown or other
  misc_feature (475)..(475): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggattcgccttcaataacttctggatgcactgggtccgccaagctccagggaaggggctgatttgggctcacgattaacattgatgggatagctcacactatgcggactccgtgaaggccgattcaccatctccagagacaacgccagaaacacactgtatctgcaaatgagcagcctagaagccgacgacacggctgtgtattactgtgacaagaggggcagcattactctactactccgctancggtacgtcgtaggggccaagggcctacggg

SEQ ID NO: 203581 - DNA, 731 bp, Homo sapiens
  misc_feature: GYAE6OF01BJLQ5.24.85.H08.1.454.CMB.1.raw
tcagactactatgtcacgaccggtgctcgatttagtatcactcagtcgcgggggagccccagccctgggattcccagctgtttctgcttgctgatcaggactgcacacagagaactcaccatggagtttgggctgagcttgggttttccttgttgcttaattttaaaaggtgtccagtgtgaggtgcagctgggtggaggtccgggggaggcttagttcagccgtgggggtccctgagactctcctgtgcagcctctggattcgccttacaaattaacttctaggatgctacgtcgggtcccgaccaagccgtaccggaggggaacggggtcttaggtaacgttttcggggtccttaccgtaacggtttaatttaaaccgtagtttaggtaaggttggggtaagttacgaccgttacaacctacgttagtcggaccggtaccgttacccgggtagggaaaccgggtcccgtaactttaccgaaccgtacttccgtaccgaaggaacgaaccaaaccgacccaaaacgaaaccacctaacgttataactaccgtagaacctaaagtgaacgccaacggaccgtaacgggaaaaccggtccccgaaacggaaccgaccggtcgttaggtacgttaacgttacgtgtacggaccggtaaacgggaccgggggaccctaaggacccttaattacccgtacccttaacgttaacccgtccgtacgtaggtaccggg

SEQ ID NO: 203582 - DNA, 531 bp, Homo sapiens
  misc_feature: GYAE6OF01EKZ9D.24.85.H08.1.454.CMB.1.raw
  modified_base (445)..(445): a, c, t, g, unknown or other
  misc_feature (445)..(445): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggattcgcttcaatacttctggatgcacgtggtccgccaagctccgagggaggctgatttgggctcacgtattaacattgagtgggatagctcacactatggcggactccggtaggaacgggccgattccaccatcctccaagacgacaacgccaagaaacacactgtactctagacaaatgagcagcctagaacgccgacgacgacggctagtntaacttcgtgtgacgaaggcggggccaggctacttacgtcctactctccgactagcggtacgtcgaggggccaagggccgtacggg

SEQ ID NO: 203583 - DNA, 566 bp, Homo sapiens
  misc_feature: GYAE6OF01EXJ8A.24.85.H08.1.454.CMB.1.raw
  modified_base (357)..(357): a, c, t, g, unknown or other
  misc_feature (357)..(357): n is a, c, g, or t
  modified_base (401)..(401): a, c, t, g, unknown or other
  misc_feature (401)..(401): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggattcgccttcaataacttctggatgcacgtgggtccgcaagctccgagggagggctgatttgggctcacgtattaacattgatgggatagctcacactatgcgactcgtgaaggcattcacatcncagacgacaacgccaagaacacactgtactctagacaaatgacncgagcctagaaacgccgaacgacacggctagtagtattacgtgtacgacgaagggacggggccaaggtcctaacgtttacccgtcccttaaccttacgtcccgtacttaacggtcgggtaaccggttcggtacggggggaccccaaagggggacccgtaccgggg

SEQ ID NO: 203584 - DNA, 538 bp, Homo sapiens
  misc_feature: GYAE6OF01C227X.24.85.H08.1.454.CMB.1.raw
  modified_base (268)..(268): a, c, t, g, unknown or other
  misc_feature (268)..(268): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggattcgccttcaatacttctggatgcacgtgggtccncaagctccgaggggaaggggctgagtttgggtctcgacgtattaacattgatgggatagctcacactatgcggactccggtagaacggccgtattccgacatcctaccagacgacaacgccaagaaaccacactgtatctagacaaatgagcagcctagaacgccgaacgacgacggctagtgtattcgtgtgacgagggcggggccagctattaccgtcctactacctcgactagtcggtacgtcggagggaccgaagggccgtacggg

SEQ ID NO: 203585 - DNA, 519 bp, Homo sapiens
  misc_feature: GYAE6OF01DST6G.24.85.H08.1.454.CMB.1.raw
  modified_base (249)..(249): a, c, t, g, unknown or other
  misc_feature (249)..(249): n is a, c, g, or t
  modified_base (387)..(387): a, c, t, g, unknown or other
  misc_feature (387)..(387): n is a, c, g, or t
  modified_base (429)..(429): a, c, t, g, unknown or other
  misc_feature (429)..(429): n is a, c, g, or t
tcagactactatgtcacgaccggtgctcgatttagtatcactcagtcgcgggggagccccagccctgggattcccagctgtttctgcttgctgatcaggactgcacacagagaactcaccatggagtttgggctgagctgggttttccttgttgctattttaaaaggtgtccagtgtgaggtgcagctggtggagtccggggagcttagttcagcctggggggtccctgagactctcctgtgcagcctntggatttcgccttcaataacttctggatgcactgggtccgccaagctccgagggaaggggctggatttggggtctcgacgtattaacattgatgggagtagctcacactatgcggactccgtgaagggccattcaccntctcagagacaacgcagaaacacactgtatctgacaaatgancagcctagaacgccgacgacacggctgtgtattacgtgtagcgaagggaggggccaggcaatttacctccctactacctccgctgtcggg

SEQ ID NO: 203586 - DNA, 701 bp, Homo sapiens
  misc_feature: GYAE6OF01ESK8M.24.85.H08.1.454.CMB.1.raw
tcagactactatgtcacgaccggtgctcgatttagtatcactcagtcgcgggggagccccagccctgggattcccagctgtttctgcttgctgatcaggactgcacacagagaactcaccatggagtttgggctgagcttgggttttccttgttgtctattttaaaaggtgtccagtgtgaggtgcagctggtggagtccgggggaggcttagttcagccgtgggggtccctgacgactctcctgtgcagcctctggattcgccttacaattaacttctggatgctacgtcgggtcccgaccgaagcctaccggaagggggtaacgggggtccgttaggttaacggtttttggggtccttaccgtaacgtttaaatttaaacctagttttaggagttaggggtagttacgtccttacgaactacgttagtcggaccggtaaccgtaccggtagggaaacggggtccgtattacccgaacctacttcctacccgaagacgaaccaacgaccaaagaacacactatatctagactaaagtgacgcaacgaccgtaggaaaccgcccggaacgaccgtacggtaccttaggttagttacgttaacgttcgggacgtaacggaaacgggggtaccgggggaccacgggtaccttaaacgttacccttaccccgttaactacccgtccggtactaggtacccgggg

SEQ ID NO: 203587 - DNA, 573 bp, Homo sapiens
  misc_feature: GYAE6OF01CIYT4.24.85.H08.1.454.CMB.1.raw
tcagactactatgtcacgaccggtgctcgatttagtatcactcagtcgcgggggagccccagccctgggattcccagctgtttctgcttgctgatcaggactgcacacagagaactcaccatggagtttgggctgagctgggttttccttgttgctattttaaaaggtgtccagtgtgaggtgcagctggtggagtccggggaggcttagttcagccgtgggggtccctgagactctcctgtgcagcctctggattcgccttcaattaactctggatgcactcgggtccgcctaagctaccgagggaagggctgtagtttgggtctcgacgttattaacattgagtgggagtagctacacactagtcgcggtaactccggtagaacgggtccgtattccgacctactcctaccaagacgaacaacgaccaaagaaacacactagtactctagacaatgagacagcctaagaacgaccgaacgaacacggactgtacgtattacgtgtagacgaaggacggggacacggtcctaatttacctacccttacttaccgtccgtcgttagtaccggg

SEQ ID NO: 203588 - DNA, 645 bp, Homo sapiens
  misc_feature: GYAE6OF01CVXSP.24.85.H08.1.454.CMB.1.raw
  modified_base (251)..(251): a, c, t, g, unknown or other
  misc_feature (251)..(251): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggattcgccttcaatacttcnggatgcacgtgggtccgcaagctaccgagggaaggggctgagtttgggtcctacacgtattaacagttgagtgggatagctcacactatcggacggtacctccggtaggaacgggcctaagtttccacctactcctacgaaggtacgaaccaaaccggccaaacggtaaaaccacctaacgtgtaactcgtagaactaaagtgacgacaacgacctaggaaacgcccggaacgaaccgacggtctaggttacgttaacgttacgtcgtaggacgaagggaccggggccacggtacctaacgtttacccgtacccttaacgttaccctcccggtacttaacgtcgggtaccgtaccgggtacggggaacccgtaaaggggaccccgtaaccgggg

SEQ ID NO: 203589 - DNA, 696 bp, Homo sapiens
  misc_feature: GYAE6OF01CL23Q.24.85.H08.1.454.CMB.1.raw
tcagactactatgtcacgaccggtgctcgatttagtatcactcagtcgcgggggagccccagccctgggattcccagctgtttctgcttgctgatcaggactgcacacagagaactcaccatggagtttgggctgagcttgggttttccttgttgtcttattttaaaaggtgtccagtgtgaggtgcagctggtggaggtccggggaggcttagttcagccgtggggggtccctgagacgtctcctgtgcagcctctggattccgccttacaattaacttctggatgcacgtcggtccgccaagccgtccgagggaacgggctgtagtttgggtctcgtacgtattaacagttgagtgggaagttagcctacacgtactagtcggacggacctccggtaggaacgggtcccgtacttccgaaccctacttacctaccgaacgtaacggaaacctaacccggaccccaaacggaaaacccaacctaaccgttacgttaactaccgttacgaacgtaaagtcgaacgaccacggtacccgtaacgaaaccggacccggtaaccgaccgacggtacgttagtacgttaacgttaacgtggtacggacggtaacggggacgggggacccaacggtaaccttacgtttacccgttacccttaaccgttacccgttacccggtagttccgggttaaccgggg

SEQ ID NO: 203590 - DNA, 572 bp, Homo sapiens
  misc_feature: GYAE6OF01DW4WO.24.85.H08.1.454.CMB.1.raw
  modified_base (298)..(298): a, c, t, g, unknown or other
  misc_feature (298)..(298): n is a, c, g, or t
  modified_base (308)..(308): a, c, t, g, unknown or other
  misc_feature (308)..(308): n is a, c, g, or t
  modified_base (375)..(375): a, c, t, g, unknown or other
  misc_feature (375)..(375): n is a, c, g, or t
  modified_base (400)..(400): a, c, t, g, unknown or other
  misc_feature (400)..(400): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggattcgccttcaatacttctggatgcactgggtccgccaagctcgagggagggctgatttgggtctnacgtataacnttgatgggatagctcacactatgcggtactccggtagaacggggcctaattcgacctatcctcaganacaacgccaagaacacactgtatcngacaaatgagacagcctagaacgccgacgacacggctagtagtattacgtgtgacgaaggacggggaccagtacctatttaccgtacccttaacgttacccgtcccgaacgttagacgggttaccgttacgggtaccgggggacccgaaacggggtacccggtaacccgggg

SEQ ID NO: 203591 - DNA, 568 bp, Homo sapiens
  misc_feature: GYAE6OF01BRGEU.24.85.H08.1.454.CMB.1.raw
  modified_base (268)..(268): a, c, t, g, unknown or other
  misc_feature (268)..(268): n is a, c, g, or t
  modified_base (333)..(333): a, c, t, g, unknown or other
  misc_feature (333)..(333): n is a, c, g, or t
  modified_base (353)..(353): a, c, t, g, unknown or other
  misc_feature (353)..(353): n is a, c, g, or t
  modified_base (361)..(361): a, c, t, g, unknown or other
  misc_feature (361)..(361): n is a, c, g, or t
  modified_base (374)..(374): a, c, t, g, unknown or other
  misc_feature (374)..(374): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggattcgccttcaatacttctggatgcacgtgggtccnccaagctccgagggaagggctgtatttgggctcacgtattaacattgatgggatgctcacactangcgactcgagaggcatcacntctcaganacacgcaagaacncactgtatctagactaaagtgagacacgcctaggaaacgccgaacgacgacggctaggtagttagttaccgtggtcgacgaagggcggggacacgacgttaacgttaccgtacccttaactaccgtccggtacttaacggtcgggtacccggttcggtaccgggggaacccgaaacgggggcccgtaaccgggg

SEQ ID NO: 203592 - DNA, 558 bp, Homo sapiens
  misc_feature: GYAE6OF01A0FNJ.24.85.H08.1.454.CMB.1.raw
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggattcgccttcaataacttctggatgcactgggtccgccaagctccagggagggctgatttgggctcacgtattaacattgatgggagtagctcacactatgcggactccgtagaagggccattcaccatcctccagacgacaacgccaagaaaccacactgtatctgacaaatgagcacgcctagaacgccgacgacgacggctggtacgtaattactggtcgacgaagggacggggaccagcctaagtttacccgtccttacctaccgtcccgacttaggtcgggtaccgttcggagggggacccaaagggggcccgtaacgggg

SEQ ID NO: 203593 - DNA, 595 bp, Homo sapiens
  misc_feature: GYAE6OF01EP3EI.24.85.H08.1.454.CMB.1.raw
  modified_base (269)..(269): a, c, t, g, unknown or other
  misc_feature (269)..(269): n is a, c, g, or t
  modified_base (365)..(365): a, c, t, g, unknown or other
  misc_feature (365)..(365): n is a, c, g, or t
  modified_base (371)..(371): a, c, t, g, unknown or other
  misc_feature (371)..(371): n is a, c, g, or t
  modified_base (437)..(437): a, c, t, g, unknown or other
  misc_feature (437)..(437): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggattcgccttcaattaacttctggatgcactgggtccncaagctccgagggagggctggatttgggctcacgtattaacattgagtgggatagctcacactatggcggactccgtagaacggccattcacatcnccaganacacgccaagaacacactgtactctagacaaatgagcacgcctagaaacgccgaacgacgaccggnttaggtacgttattacgtgtaggacgaaggggacgggggccaaggtacctaacgtttaacccgttacccgttaacttacccgttccccggacttaacggtacgggtaaccgttccgggttacggggggacccctaaacgggggacccgtaaccggggg

SEQ ID NO: 203594 - DNA, 710 bp, Homo sapiens
  misc_feature: GYAE6OF01CD8A2.24.85.H08.1.454.CMB.1.raw
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcgacggggtccctgagactctcctgtcgcacgcctcgtggacttccgcctttacaaattaactttcgtaggattcggacctacgtcggggtcccaccgaacggtccgtacccggaaggggggaacgggggtccttagggttaacggtttttcgggggtacctaccgtaacggtttaatttaaaccgagtttaggaggttggggaagttacgccttacaacgtacttagtcggaccggtactccgggtaggaaacggggtccctattccaactactcctaccgaggaacgaaccaacgaccaacgaactacactgtactcagaacaaagtcgaacgtcacgtaccgtaagaaccgacccgaacgaaccgtacggtacgtaggttacgttaacgttaccgtggtacggaacgaacggggacggggacctacggtaccttaacgttaccctaccgttactaccgtccgtacgtaggtacggtacgtacggtacggggaccgaagggccgtaccggg

SEQ ID NO: 203595 - DNA, 655 bp, Homo sapiens
  misc_feature: GYAE6OF01DJ4PT.24.85.H08.1.454.CMB.1.raw
  modified_base (343)..(343): a, c, t, g, unknown or other
  misc_feature (343)..(343): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcgaggggtccctgagactctcctgtgcagcctctggattccgccttacaatacttctggatgcacgtgggtccgcaagcctaccgaggggagggctgtagtttcgggtctacgacgttaattaacagttgagtgggatagctacanactagtgcggtactccggtaggaacgggtcctattccactatcctacagacaccaacgaccaaagaaccactacgtagtactcgtagaactaaagtgacgcacgacctaagaaaccgccgaacgacgacggtcttaggttagttacgttacgtggtacgaacgtaacgggggaccgggacctaaggtacccttaaactttaccccgtaacccgttaaccgttacccggtcccgttaacgttaacgggttacgggtaacccggtttcgggaaccggggggaaccccgtaaagggggaccccgttaaccggggg

SEQ ID NO: 203596 - DNA, 625 bp, Homo sapiens
  misc_feature: GYAE6OF01EMK3G.24.85.H08.1.454.CMB.1.raw
  modified_base (267)..(267): a, c, t, g, unknown or other
  misc_feature (267)..(267): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggattcgccttcaatacttctggatgcactgggtccnccaagctccgagggaggctggatttgggctcacgtattaacattgatgggatagctcacactatcgcggtactccggtaggaacggtcctattccgaacctattccctaccgaagacgaccaacggcccaaggaaaccacacttgtactccgtagacctaaagttcgaacgtctaatacccgtaggaaccgcccgaacgaccgaacggtctagtacgttacttaccgtgtcgaacgtaagggtacggggacctaggtccctaagtttacccgtcccgttaaccgtaccgtcccggacttacggtacgggtaccgtttaccggacgggggtacccctaaagggggtcccgtaaccgggg

SEQ ID NO: 203597 - DNA, 554 bp, Homo sapiens
  misc_feature: GYAE6OF01DU4CM.24.85.H08.1.454.CMB.1.raw
  modified_base (307)..(307): a, c, t, g, unknown or other
  misc_feature (307)..(307): n is a, c, g, or t
  modified_base (420)..(420): a, c, t, g, unknown or other
  misc_feature (420)..(420): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggattccgcctttcaataacttctggatgcacgtgggtcccgccaagctaccgaggggaagggctgatttgggtctnacgtattaacattgagtgggagtagctcaacactatcggcggactcggtgaacgggcctattccacatcaccagacgacaacgcaagaacacactgtactcagacaaagtganacacgcctagaacgccgaacgacacggtctgttagtattacgtgtagacggaaggacgggggccagcctaattaccgttacctactacctccgactagtcggtacggtcgacggggaccgaagggccgtacggg

SEQ ID NO: 203598 - DNA, 723 bp, Homo sapiens
  misc_feature: GYAE6OF01DGLSI.24.85.H08.1.454.CMB.1.raw
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggacttccgcctttacaaattaacttcgtggatgcacgtcgggtccgacctaagcctaccgaggggaacggggcttaggtagttttggggtcctacgtacgttaattaactagttgagtgggtagtagcctacactacgtagtcggaccggtaccgtaccggtagggaacgggtcccgtaactttacccgaacctaacgttccctacccgaaaggtaacggaaacccgaaaccggccccaaaacggaaaaccctaaccgtaacctttaggttaacttaccgtaacgaaccgtaaaagttacggaacgtaccgaacggtacccgtaaggaaaacccggtccccggaaacggaccgtaaccgggtcttacggttacggttaacttaaccgtgggttacgacggtaaacggggacggggacctaacgacttacttacccgtacctagtaccctcgtactagtacggacgtcggagggaccgaacgggtcgaccggg

SEQ ID NO: 203599 - DNA, 841 bp, Homo sapiens
  misc_feature: GYAE6OF01AN0HU.24.85.H08.1.454.CMB.1.raw
  modified_base (279)..(279): a, c, t, g, unknown or other
  misc_feature (279)..(279): n is a, c, g, or t
  modified_base (331)..(331): a, c, t, g, unknown or other
  misc_feature (331)..(331): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggacttccgccttacaattaactttcgtggatgccacgtcggggtcccnccaagcctaccgaggggaacgggctggtagtttgggtctcgacgtattaacnttgagtgggatagctcactactatcggacggtactccggtaggaacgggccgtacttaccaccgtactcccgtaccgaaggtaaccgaaccgtaaccggacccgaaacggaaaaccctaaccgtaaccgttaggtttaacttacccgttaacgaacccgtaaaaagttcgggaaaccgtacccgtaaacggtaccccgttaaaggggaaaaacccggtcccccgggaaaacccggtaacccgggtaaccggggttacccgttttaacggggtttaccggtttaaaccgttttaacccgggttacgggttacgggaaccgggttaaaccgggggaaccgggggggtacccctaaacgggtaccccgttaaacgtttttacccccgttaaccccgtttaacccgttaaccccggttccccggtaacccgttaacgggttaccggggtacccggtttacgggtaaccggggggtaaccccgtaaaccggggggtacccggtaaacccgggggg

SEQ ID NO: 203600 - DNA, 644 bp, Homo sapiens
  misc_feature: GYAE6OF01A6GOH.24.85.H08.1.454.CMB.1.raw
tcagactactatgtcacgaccggtgctcgatttagtatcactcagtcgcgggggagccccagccctgggattcccagctgtttctgcttgctgatcaggactgcacacagagaactcaccatggagtttgggctgagctgggttttccttgttgctattttaaaaggtgtccagtgtgaggtgcagctggtgggaggtccgggggaggcttagttcagccgtggggggtccctgagactctcctgtgcagcctctggattcgccttcaataacttctggatgcacgtgggtccgccaagctccgaggggacggggctgtagtttgggtctcacgttattaacattgagtgggagtagctcacactagtgcggactccgtagaacgggccgattccaccatcctaccaggacgaaccaaccggaccaagaaaccacactagtactctagactaaagtcgaacgcgacgaccctaaggaaaaccgcccgggtaaacgaacccgtaccgggtacttacggttagttaactttaccgtggttacggaccggtaaacgggggacggggtacccgacggtaccgtaacgttttaaacccgttacccgttaacccttacccgttccccggtacgtttaagggtacccgggg

SEQ ID NO: 203601 - DNA, 804 bp, Homo sapiens
  misc_feature: GYAE6OF01A9MRD.24.85.H08.1.454.CMB.1.raw
  modified_base (269)..(269): a, c, t, g, unknown or other
  misc_feature (269)..(269): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggattcgccttcaataacttctggatgcacgtgggtccnccgaagcctccgaggggaaggggctggtagtttcgggctcgacgttattaacagttgagtgggagtagctcactactagtggccggactccggtaggaacgggtccgtacttaccaccctattccctaccgaaaggtacgaaacccgaaccggacccaaaggaaaacccaccgtaacctttaggttaacttacccgtacggaacctaaaagtcggaacgaccgaaccggtacccgttaaagggaaaaccggtcccccgggaaaccgtaacccggaacggggttcctttaagggtttaccggttttaacgtttaccggttacgggttacggaacccgggtaaagggggtacccgggggggtaccctaaagggtaccccgttaaaacgttttacccccgtaaccccggtttaaccctttaaacccggttccccggtaaccgttttaacgggttacccggggtaaccccgggtttaccggggtaccgggggggaaacccccgtaaaacgggggggtacccccggttaaacccgggggg

SEQ ID NO: 203602 - DNA, 625 bp, Homo sapiens
  misc_feature: GYAE6OF01B8DZO.24.85.H08.1.454.CMB.1.raw
  modified_base (273)..(273): a, c, t, g, unknown or other
  misc_feature (273)..(273): n is a, c, g, or t
  modified_base (317)..(317): a, c, t, g, unknown or other
  misc_feature (317)..(317): n is a, c, g, or t
  modified_base (481)..(481): a, c, t, g, unknown or other
  misc_feature (481)..(481): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgaccctcgaggggtccctgagactctcctgtgcagcctctggacttcgccttcaataacttctggatgcacgtcgggtccnccaagctccgaggggagggctgagtttgggctcacgtattaacnttgagtgggatagctcactactagtgcgactccggtaggaacgggcctaattccaactactcctaccgaagaacgaccaacgccaagaaaccacactgtactctagacaaatgacgcacgcctagaaacgccgaacgacgacggcttaggtacgtagtttacgngtacggaacggagggacgggggaccctaggacccttaacgtttacccgtacccttaaacccgtacccgttacccgacgttaacggttacgggtaaccgggttaccggtaccgggggaacccgtaaacggggcccggtaccgggg

SEQ ID NO: 203603 - DNA, 631 bp, Homo sapiens
  misc_feature: GYAE6OF01BF4IJ.24.85.H08.1.454.CMB.1.raw
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtcccctgagactctcctgtgcagcctctggattcgccttcaataacttctggatgcacgtgggtccgccaagctccgaggggaaggggctgtagtttgggtctcacgtattaacattgagtgggagtagctcacactatggcggactccggtggaacgggcctattcacctatcctaccagacacaacgccaagaaaccacactagtatctagactaaatggaacgcagaccgtagaacgcccggaacgaccgacggtcttagtacgttaacgttacgtggtacgacgaacgggacgggggaccagtaccgttaacgtttacccgtacccgttaaccgttacccgtccggtaacgtttacggtaccgggtacccggtttccggggacgggggaccccggtaaacggggggtaccccggtaaccggggg

SEQ ID NO: 203604 - DNA, 703 bp, Homo sapiens
  misc_feature: GYAE6OF01E2QUV.24.85.H08.1.454.CMB.1.raw
  modified_base (282)..(282): a, c, t, g, unknown or other
  misc_feature (282)..(282): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcaaagggtcttcgtggctcacgtccaccaccacgcatgtgacctcgaggggtccctgagactctcctgtgcagcctctggacttccgccttacaaattaaccttctggatcgcacgtcggggtcccnccaagcctaccggaaggggaaggggctggtagtttggggtcctcgaacgttaattaactagtttggagtggggagtagctacaactacttagtcggaccggtaccgttccggtaggaacgggcccgtattacccaacctacttcccgaccgaaggacgaaccaaccggaccaaacgaaaccaccgtaacttgtaactccgtagaactaaagtcgaacgcgaacgtacccgtaaggaaacccggcccggaaccgaaccggtacgggtaccgtttaggttacgttaactttacggtggtacggaacggaacggggacggggaccaagtccttaaacgtttaccctacccgttactaccggtcccgtacgttacggtacgggtaccgttccgggacgggggacccaaaggggtccccgtacggg

SEQ ID NO: 203605 - DNA, 840 bp, Homo sapiens
  misc_feature: GYAE6OF01A38IE.24.85.H08.1.454.CMB.1.raw
tcagactactatgtcacgaccggtgctcgatttagtatcactcagtcgcgggggagccccagccctgggattcccagctgtttctgcttgctgatcaggactgcacacagagaactcaccatggagtttgggctgagcttgggttttccttgttgctattttaaaaggtgtccagtgtgaggtgcagctggtggaggtccgggggaggtcgttagttcagtccggtcggggggtccctgagctctccgtgtgcacgcctctggtacttccgtacctttacaaacttaaccttcgtggatcgactacgtcggggtcccgaccgaacgtccgtaccggaagggggaacggggtccttggtaagttttcggggtcctacgtaacggttaacttaaacgtagtttaggaaggtaggggtaagtacgtccttaccgaacgtaacttacggtacggaccggtaccgttaccgggtacgggtaacgggtcccgtaacgttacctaaccctacgttcctacccgaaaggaccgtaaacccaaaccgggacccaaaggaaaaccctccgaacgttagtacttacgtacgaaaccgtaaagtcgaacgccgaaccggtacccgtaaaggaaacccggaccgtaacccggtaacgtaacgggtacccgtttaggttaaacccggtttaaacgttaccgggttaaccgggtagaaacccggggtaaaacggggggtaacccgggggtcccctaaagggtaaccccctttaaaacggttttaacccccgttaccccgttaaaccccgttttaaccccggtaccccggttacgtttaaacgggggtacccgggg

SEQ ID NO: 203606 - DNA, 541 bp, Homo sapiens
  misc_feature: GYAE6OF01BCYBH.24.85.H08.1.454.CMB.1.raw
  modified_base (293)..(293): a, c, t, g, unknown or other
  misc_feature (293)..(293): n is a, c, g, or t
  modified_base (421)..(421): a, c, t, g, unknown or other
  misc_feature (421)..(421): n is a, c, g, or t
  modified_base (439)..(439): a, c, t, g, unknown or other
  misc_feature (439)..(439): n is a, c, g, or t
tcagactactatgtcacgaccggtgctcgatttagtatcactcagtcgcgggggagccccagccctgggattcccagctgtttctgcttgctgatcaggactgcacacagagaactcaccatggagtttgggctgagctgggttttccttgttgctattttaaaaggtgtccagtgtgaggtgcagctggtggagtccgggggaggcttagttcagccgtggggggtccctgagactctcctgtgcagcctctggattcgccttcaattaacttctggatgcacgtgggtccnccaagcctccgaggggaaggggctgagttttgggtctcacgtattaacattgatggggatagctcacactatgcgactcggtgaagggccattcaccatctcagagacaacgaccaagaaacacactntaatctagacaatgaacncagcctaaggaaacgcccggaacacgacgggactgtacgttattacgtgtgacgaagggaggggcacgactacttactccctactacctccgcgtgtacggg

SEQ ID NO: 203607 - DNA, 552 bp, Homo sapiens
  misc_feature: GYAE6OF01C4PPW.24.85.H08.1.454.CMB.1.raw
  modified_base (252)..(252): a, c, t, g, unknown or other
  misc_feature (252)..(252): n is a, c, g, or t
  modified_base (270)..(270): a, c, t, g, unknown or other
  misc_feature (270)..(270): n is a, c, g, or t
  modified_base (527)..(527): a, c, t, g, unknown or other
  misc_feature (527)..(527): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagacctctcctgtgcagcctctggattcgccttcaatacttcnggatgcacgtgggtcccnccaagcctccgagggaagggctgatttgggtctcgacgtattaacattgatgggatagctcacactagtcgcggtactccgtaggaagggccgattccaccatcctacagacgacaacgccaagaaccacactgtatctgactaaatgagcacgcctagaacgccgacgaccgacggctgtagtacttacgtgtcgacgagggacgggccagctaattacctacctactacctccgacgttatcgggaccgttcggnggggaacccaggggacccgtacggg

SEQ ID NO: 203608 - DNA, 833 bp, Homo sapiens
  misc_feature: GYAE6OF01EIFM8.24.85.H08.1.454.CMB.1.raw
tcagactactatgtcacgaccggtgctcgatttagtatcactcagtcgcgggggagccccagccctgggattcccagctgtttctgcttgctgatcaggactgcacacagagaactcaccatggagtttgggctgagtctgggttttccttgttgcttattttaaaaggtgtccagtgtgaggtgcagctgggtggaggtccgggggaggtcgttagttcgaggccgtggggggtccctgagactctcctgtgcacgtcctcgtggtacttccgcctttacaaacttaacttcgtaggtatcgaccgtacgtcgggtacccgaccgaacgtccgtaccggaagggggtaacggggtccgttaggttacgttttcggggtccttacgtaaccggttaatttaaaccgtagtttaggaaggttggggtaacgttacgtaccgttacgaacgtaacgttaacgtcggaccgggtaccgttacccggtaagggaacgggtccgtaacttaccgaacccgtaacttccgtacccgaaggaaccgaaccgaaaccggacccgaaaacgaaaacccaccgtaaccgttacgtaacgttaccgtacgaaacctaaaagtcggaacgacccgtaacggtacccgtaaaggaaaacccggccccgggtaaacgtacccggtaacgggtaccttacgggttaacgtttaacgtttaccgttacgggtaacggtaaccgggaaacgggggtaccgggggtaccctaaaggttacctaaacccgtttacccgttaaccccgttaaccgtaacccgttcccggttaacgttaacggttacccggggg

SEQ ID NO: 203609 - DNA, 547 bp, Homo sapiens
  misc_feature: GYAE6OF01BLOFM.24.85.H08.1.454.CMB.1.raw
  modified_base (357)..(357): a, c, t, g, unknown or other
  misc_feature (357)..(357): n is a, c, g, or t
  modified_base (414)..(414): a, c, t, g, unknown or other
  misc_feature (414)..(414): n is a, c, g, or t
  modified_base (462)..(462): a, c, t, g, unknown or other
  misc_feature (462)..(462): n is a, c, g, or t
tcagactactatgtcacgaccggtgctcgatttagtatcactcagtcgcgggggagccccagccctgggattcccagctgtttctgcttgctgatcaggactgcacacagagaactcaccatggagtttgggctgagctgggttttccttgttgctatttaaaaggtgtccagtgtgaggtgcagctggtggagtccgggggaggcttagttcagccgtggggggtccctgagactctcctgtgcagcctctggattcgccttcaataacttctggatgcactggtccgccaagctccgagggaggggctggatttgggtctcacgtattaacattgatgggagtagctcacactangcgactcgtagaacgggccgattccaccatctccagagaccaacgccaagaaaccanactgtactctagacaaatgagcagcctaggaaacgccgacgacgacgntgtagtattacgtgtagacgtaagggacgggggaccaggacctaactttaccctaccttacctaccgtcccgtctaggtaccggg

SEQ ID NO: 203610 - DNA, 524 bp, Homo sapiens
  misc_feature: GYAE6OF01AT7BU.24.85.H08.1.454.CMB.1.raw
  modified_base (426)..(426): a, c, t, g, unknown or other
  misc_feature (426)..(426): n is a, c, g, or t
  modified_base (436)..(436): a, c, t, g, unknown or other
  misc_feature (436)..(436): n is a, c, g, or t
  modified_base (483)..(483): a, c, t, g, unknown or other
  misc_feature (483)..(483): n is a, c, g, or t
  modified_base (516)..(516): a, c, t, g, unknown or other
  misc_feature (516)..(516): n is a, c, g, or t
tcagactactatgtcacgaccggtgctcgatttagtatcactcagtcgcgggggagccccagccctgggattcccagctgtttctgcttgctgatcaggactgcacacagagaactcaccatggagtttgggctgagctgggttttccttgttgctattttaaaaggtgtccagtgtgaggtgcagctggtggagtccgggggaggcttagttcagcctggggggtccctgagactctcctgtgcagcctctggattcgccttcaataacttctggatgcactgggtccgccaagctccgagggaagggctgatttgggtctcacgtattaacattgatgggagtagctcacactatgcggactccgtagaacgggccgattccaccatcctccagacgacaacgccaagaaccacactgtactcngacaatgacncagcctagaacgccgacgacacggctagtgtatactgtgacgaaggnggggccaggcattaccgtacctactacctccgntgtacggg

SEQ ID NO: 203611 - DNA, 744 bp, Homo sapiens
  misc_feature: GYAE6OF01CZL7S.24.85.H08.1.454.CMB.1.raw
  modified_base (302)..(302): a, c, t, g, unknown or other
  misc_feature (302)..(302): n is a, c, g, or t
tcagactactatgtcacgaccggtgctcgatttagtatcactcagtcgcgggggagccccagccctgggattcccagctgtttctgcttgctgatcaggactgcacacagagaactcaccatggagtttgggctgagctgggttttccttgttgcttattttaaaaggtgtccagtgtgaggtgcagctgggtggaggtccgggggaggtcttagttcaggccgtggggggtccctgagacctctcctgtgcagcctcgtggattcgtccttacaataaccttctggatgcacgtgggtccnccaagccgtaccgaaggggaacggggtcttggtacgttttggggtctaccgtaacgtttaattaaacgtagttaggaagttggggaagttacggtcctaccgtaaccgtaaccgttagtccggaccgggtaaccgttcccggggtagggtaaaccggggtcccgttaacgtttaccaacccgtacgttacccgttaacccgaagtaaccgaacccaaacccggacccaaacgaaaaccacgtacctagtactaccgtagaacctaaagtcggacgtaccgacgtacccgtaaggaaaccgtccccgacgaaccgacggtaccttggttagttaacttcgtaggtacgaaccggaaagggtaccgggggacctaaggccttaaaccgtttaccctaacccccgttaacttacccgtaccccggtcgtttaagggtacccgggg

SEQ ID NO: 203612 - DNA, 765 bp, Homo sapiens
  misc_feature: GYAE6OF01D17AU.24.85.H08.1.454.CMB.1.raw
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtcgacctcgacggggtccctggacgactctcctgtgcagtcctgtggacttccgccttacaaattacttcgtggatcgctacgtcgggtcccgaccgaacgtccgtaccggaagggggaacggggtccttaggtacggttttcggggtaccttacgtaacgtttaacttaaacgtagtttaggtaaggtggggtaacgttacggccttaaccgaacgttacgttacgtccgggaccggtaccgttcccggggtaggaaccggggtcctaacttacccgacctattcccgtacgaaggaaccgaaccgaaccgaccgtaaaacggaaaaccctccgtaacgttacggtaacttaccgtacggaaactaaagtcggacgaccgtaacgacccgtaaggaaacccgccgaacggaccgacggtcttaggttacgttacttacggtggtacgaacggaagggggtaccgggactacggtaccttaaccgttacccgtaccgttaaccttaccggtcccgtagttacggtcgggtaccggttcgggaaccggggacccgtaaggggtacccgtaccggg

SEQ ID NO: 203613 - DNA, 614 bp, Homo sapiens
  misc_feature: GYAE6OF01CVM98.24.85.H08.1.454.CMB.1.raw
  modified_base (380)..(380): a, c, t, g, unknown or other
  misc_feature (380)..(380): n is a, c, g, or t
  modified_base (450)..(450): a, c, t, g, unknown or other
  misc_feature (450)..(450): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtcgacctcaggggtccctgagactctcctgtgcagcctctggacttcgccttcaaatacttctggatgcacgtgggtccgcaagcgtaccgaaggggaagggctggtagtttgggtctacgacgtattaacagttgagtgggagtacgctcacactagtcgcgacgtcgtaggacgggctattcgaccntcacagacgaacacgaccaagtaaaccactactagtactctacgaacaaatcgagacagccgtaggaacncccgaacgaacgcggtataggttacgttattacgtaggttacgaccgagggacggggacctaacggtacctaacgttaccgtacccttacgttacccgtcccgacgttacgtcgggtaaccgttccgggaggggtaacccgaaacggggtacccgtaaccgggg

SEQ ID NO: 203614 - DNA, 785 bp, Homo sapiens
  misc_feature: GYAE6OF01EIWET.24.85.H08.1.454.CMB.1.raw
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgacttgacctcaggtcttcgtggctcacgtccaccaccacgcatgtcgacctcgacggggtccctgacgacctctcctgtcgcacgccttcgtggactttccgccttacaattaacttcgtggatgctacgtcgggtccaccaagctacggagggaggctgtagtttgggtctcgacgttattaacagttgagtgggtagtacgtctacaactacgtagtggaccggtacgttaccggagggaaccgggtccgtacttaccaacctactcctacgaacggaacgaaacccgaaccgaaccctaaagaaacctacctaacgttagttaactcggtaacaacgtaaagtccggaacgtacctaaccggtaccctaacgggaaaaccggtccccggaaacccggtcgtaaacccgggggtctttaacggtttaacggtttaaactttaccggttagggaaccgttaacccggggaaaggggggcccggggttaacccaaagggtttaccccttaaaaccgtttttaccccgtaaccccctttaaccggttaacccggttcccgttaacgttaccggtaacggggtacccgggtttaccgggaacggggggaaacccctaaacggggggtacccgtacccggggg

SEQ ID NO: 203615 - DNA, 668 bp, Homo sapiens
  misc_feature: GYAE6OF01DI8SN.24.85.H08.1.454.CMB.1.raw
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcgaggggtccctgagactctcctgtgcacgcctctggattccgccttacaaataacttcgtggattcgctacgtgggtccgaccaagcctaccgaaggggtaacggggcttaggtacgttttcggggtacctacgtaacggttaactttaaaccgagttttggaagttggggagttacggccttaccgaactactagttcggaccggtaacttcccgggtaggaaacgggccgtaattccaaccgtattcctaccgaagaacgacaaccgaccaacgaaaccacgtactagtactcgtagaacaaagtcgagcacgcctagaaacgccgaagaccgacggtctaggtcttaagttcgaggtacggacgtaagggcggggaccagtaccgtaacttacccgttccgtaactacccgtccgattaaggtccgggtaacgtcgggtacgggacccgaaggggtcccgtaccggg

SEQ ID NO: 203616 - DNA, 792 bp, Homo sapiens
  misc_feature: GYAE6OF01BLCMN.24.85.H08.1.454.CMB.1.raw
tcagactactatgtcacgaccggtgctcgatttagtatcactcagtcgcgggggagccccagccctgggattcccagctgtttctgcttgctgatcaggactgcacacagagaactcaccatggagtttgggctgagtcttgggttttccttgttgtcttaagttttaaaaggtgtccagtgtgaggtgcagcgtgggtgggaggtccgggggaggtcttagttcgacggccggtggggggtccctggacgtacctcctccgtgtcgccacggtccctcgtggtactttccgtacctttacaaacttaacgttcgtaggtatcgcgtaccggttcgggtacccgaccgtaacgccgtaccgggacggggtaacgggtcgttaggtacgttttcgggtcctacgtaacgttaacttaacgtagttagtaggtagggtacgtagccttacaactaacgttcgtacggtaccggtccgttacgggtaacgggaacgggtaccgttaactaaccgtaacgtactcccgtaacgtaaggaaccgaacccgaaaccgaacccgaaaaccgaaccctaacgtaaccgttacgtaacttaccggaacgtaaaccgaagtaccgacgtacgaaccgtacgtaaacggaaccggacccgaacgtacccggagtaccggttagttacgttaagttacccgtagggtaacgaaccgggtaacgggaccggggtaccctaagttaaccgttaccctttaaccccgtaaccctacgttacccggtacgtacggttacgtaccgggg

SEQ ID NO: 203617 - DNA, 522 bp, Homo sapiens
  misc_feature: GYAE6OF01C5R0C.24.85.H08.1.454.CMB.1.raw
  modified_base (269)..(269): a, c, t, g, unknown or other
  misc_feature (269)..(269): n is a, c, g, or t
  modified_base (368)..(368): a, c, t, g, unknown or other
  misc_feature (368)..(368): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggattcgccttcaatacttctggatgcacgtgggtcccnccaagctccgagggaagggctgagtttgggctcacgtataacattgatgggatagctcacactatgcggactcgtgaacgggccattcacatctcaganacaacgcaagaacacactgtatctgacaaatgagcagcctagaacgccgaacgacacggctagtagtacttactgtagacgaaggacggggccaggctattacctcctactactccgctaagtcggacgtcgtggggaccaagggccgtacggg

SEQ ID NO: 203618 - DNA, 625 bp, Homo sapiens
  misc_feature: GYAE6OF01B5XIW.24.85.H08.1.454.CMB.1.raw
  modified_base (266)..(266): a, c, t, g, unknown or other
  misc_feature (266)..(266): n is a, c, g, or t
  modified_base (459)..(459): a, c, t, g, unknown or other
  misc_feature (459)..(459): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggattcgccttcaatacttctggatgcactggtccnccaagctccagggagggctgatttgggtctcacgtattaacattgatgggagtagctcacactatcgcggactcgtgaacggccgaattcacctatctccaagacaacacgccaagaaaccacactgtaatctagacaaagtgagtcagccctagaaacgcccgaacgtacacggtctagttagtactttagngttagaccgaaagggaccgggggccctaagggtaccctaaacgttttaccgttaccccgttaacccgttaacccgtttacccgaccgttaaacggttcggggttaacccggttcccggttaacggggggaacccccgtaaacggggggtcccccgttaaacggggg

SEQ ID NO: 203619 - DNA, 715 bp, Homo sapiens
  misc_feature: GYAE6OF01CR0QV.24.85.H08.1.454.CMB.1.raw
tcagactactatgtcacgaccggtgctcgatttagtatcactcagtcgcgggaggacgctgaccacacggtacgtgctgttgtactgcctcctcccgcggtctttgtcttggcattatgccacctccacgccgtccacgtaccagttgaacttgacctcagggtcttcgtgctcacgtccaccacacgcatgtcgacctcgacggggtccctgagacctctcctgtgcacgcctgtggtacttcgccttacaattaacttcgtggatcggacctacggtcgggtacccaccgaagtccgtaccggaaggggaacggggtctaggttaggttttcgggacctacgtacgttaatttaacgagtttggagtagggaacgtgtcctacaacgacttagtcggaccggtacctacgggtaggaacggggtaccctaattacccaacctacgtaccctacccggaaaggacccaaaccgaacccgaaccgaaacgaaactaacgacttacgtaacttacgtacgaacgtaatacggacgacgtaaccgaccgtaagaaccgacgaacgaaccgaggtccgtaggttacgttaactacggttcgtaacggacggaacgggtaccggggactacggtacctaaccgttaccttaccctacgtccgtacctacgtacggttacggtaccgtacgggacggaccggtacgggccggtaaccggg

SEQ ID NO: 203620 - DNA, 980 bp, Homo sapiens
  misc_feature: GYAE6OF01EFORG.24.85.H08.1.454.CMB.1.raw
tcagactactatgtcacgaccggtgctcgatttagtatcactcagtcgcgggaggacgctgaccacacggtacgtgctgttgtactgctccctccgcgtcttgtcgtggctattatcgcctaccctccaccgtcccgtaccaccgtacctaggttacgtaacttcgaccctcggtagggttcctttcgggtcggtcctaccgtaccgtaccccaaccccaccgaccgctagttggtacgtaccctcgggtaccggggttccctaggacgtaccttccttccgttggtcgaccgtacgtcccttcggtagggtactttcccgtaccctttaactaaaacttttaaccgtttcggtagggtaacgttccggacccgtaaccggggtttccgggggtaccccctaaccggaaacggtcccgtaaccggggaaagggggggtaacggggtcttaggttttacgggttttcgggtaccttaccggttaaacggtttaaactttaacgtagtttaggtagggttaggggtaagttacgtcctacctaaacgtacgttaaggccgggtaccggtaccgttacgggtaaggggaaccgggtccttacttacccgaacctacgttcccgtaaccggaggaaccgaaaccgaacccgaaccgaaaacgtaaaacccacgttaaccgttagttaaccttcgaacgtaaacgtaaagtcggaacgtaccgtaaccgtaccgtaaacgggaaacccggccccggtaaaccgaccgggtaccgggttatttacgggtaaacttttaccgtttaacggtcgggtaacggaacgggtaacgggggaccgggacctaacggttacctttaaaccgttttaccccgtaacctttaacccgttacccgtccgtaaccggtttaagggacccggggtttaaccggttacccgggggtaaccgggggaaacccgtaaaccgggggtccccggtaaaccggg

SEQ ID NO: 203621 - DNA, 523 bp, Homo sapiens
  misc_feature: GYAE6OF01A1FFF.24.85.H08.1.454.CMB.1.raw
  modified_base (252)..(252): a, c, t, g, unknown or other
  misc_feature (252)..(252): n is a, c, g, or t
  modified_base (268)..(268): a, c, t, g, unknown or other
  misc_feature (268)..(268): n is a, c, g, or t
  modified_base (309)..(309): a, c, t, g, unknown or other
  misc_feature (309)..(309): n is a, c, g, or t
  modified_base (385)..(385): a, c, t, g, unknown or other
  misc_feature (385)..(385): n is a, c, g, or t
  modified_base (406)..(406): a, c, t, g, unknown or other
  misc_feature (406)..(406): n is a, c, g, or t
  modified_base (441)..(441): a, c, t, g, unknown or other
  misc_feature (441)..(441): n is a, c, g, or t
  modified_base (452)..(452): a, c, t, g, unknown or other
  misc_feature (452)..(452): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggattcgccttcaataacttcnggatgcactgggtccncaagctccagggaagggctgatttgggctcacgtattaacnttgatgggagtagctcacactatgcggactccgtgaagggccattcaccatctccagacgacaacgccaagaaacncactgtatctgacaaagtgancagcctagaacgccgagacacggctgtgtattacngtgacgaaggnggggccagcattacctcctatacctccgactagtcggacgtcgtagggggacccaaaggggtccctacggg

SEQ ID NO: 203622 - DNA, 698 bp, Homo sapiens
  misc_feature: GYAE6OF01BERT5.24.85.H08.1.454.CMB.1.raw
tcagactactatgtcacgaccggtgctcgatttagtatcactcagtcgcgggggagccccagccctgggattcccagctgtttctgcttgctgatcaggactgcacacagagaactcaccatggagtttgggctgagcttgggttttccttgttgcttattttaaaaggtgtccagtgtgaggtgcagctgggtggaggtccggggaggcttagttcagccgtgggggtccctgagactctcctgtgcagcctcgtggattccgccttacaattaaccttctaggatgctacgtcgggtccgaccaagccgtaccggaaggggaacggggcttggtagttttcgggtactacgtaacgttaatttaaacgtagttaggaagttggggaagttaacgtcctaccaacgtacttaagtcggacggtaccgtccgggtaggaaacggggtcccgtaacttcccgaacctacgtcctacccgaagaaccgaaccgaaaccgacccaaacgaaaccactaacgttcgttaactccgtagaactaaagtggaacgaccgaacgacccgtaaggaaacccggcccgtaaccgacgtacgggtcttaggttacgtacgttaccgtggtacgacgaacggggtacggggacccaggaccttaacttacccgtaccctaccttaaccgtccgtagttacggtaccggg

SEQ ID NO: 203623 - DNA, 745 bp, Homo sapiens
  misc_feature: GYAE6OF01BVI9I.24.85.H08.1.454.CMB.1.raw
tcagactactatgtcacgaccggtgctcgatttagtatcactcagtcgcgggaggacgctgaccacacggtacgtgctgttgtactgctcctcccgcggtctttgtcttggcatttatgccacctccaccgccgtccacgtaccagttgaacttgacctcgagggtcttcgtggctcacgtccaccaccacgcatgtcgacctcgacggggtccctgacgacctcctccgtgtcgcacgtcctcgtaggtacttccgtccttacaaacttaactttcgtagggtacttcggaccgtaccggtcggggtacccaccgtaacggccgtaccgggaagggggtaacgggtcttaggttacggttttcgggaccttacgtaaccgttaattaaccgtagttggaagtagggtattacgcctactaacgtacgttagtcggaccggtactccgggtaggaaccggctactaccgactatccacgaagacgacaacgaccaagaacacacgtagtacttacaacgaactaaagtcggacaccgtaacgtacccgaagggaaacccgcccgaagtaacccggtacggttcttagggttacttaacgttccgagggtacgaacgggtaaggggaccggactacggtaccttaaccgttacccgttacccgtaacgttacccgcccgttagttacggtacccgggtaccgtccggggaacccggggaaacccgtaaggggtcccgtaacccggg

SEQ ID NO: 203624 - DNA, 975 bp, Homo sapiens
  misc_feature: GYAE6OF01A7VH9.24.85.H08.1.454.CMB.1.raw
tcagactactatgtcacgaccggtgctcgatttagtatcactcagtcgcgggggagccccagccctgggattccccagcttgtttctgtcttgctgatcgaggactgcacacagagactcacagtggtaggtttggctgagtcgtttcgggtttttccttgttgtactttaaagtttttaaaagggtcgtaccgtaggttggtagggaggtgaccgaggtcgttggggtacgggacggggtcccggggggaggtcgtttaggttcgacggtccgggttcggggggtccctggacgtccttcctcgtgtcgcgacgtccttgtggtacttccgtccttactaaactttaccgttgtaggtatcggacctaccgggtcgggtaccccaccgtaacggtcccgtaccggggaaggggggtaaccggggtcgttaggttagggtttttccgggtacccgttacgtaaacggttttaaactttaaaccgttagtttagggtaagggttacggggtaagttaccggtccttaaccgaacgttaccgttagtccgggaacccggtacccggttcggggtaaacgggaacggggtcccgtaacttaccccgaacttaccggtaccctacccgaacggaacccgtaacccgaaacccggacccgaaaaccggtaaacctaaccgttaacgttacgttaaccgtttccggaacgtaaacctaaacggttcgaaccggaccgtaaacccggtacccgtaaacggggaaaaccccggaccccggtaaaccggaacccgggttaccggttacggtttaacggttacgtttaaacggttttccggtacgggtaccgtaaaccgggggtaaccgggggtaccggggggaaccctacgggttaaccctttaacccggtttaacccccgtttaaccccgttaaccccgtttaaccgtcccccgggtttaagttaccggggttaaccccgggg

SEQ ID NO: 203625 - DNA, 926 bp, Homo sapiens
  misc_feature: GYAE6OF01COVAK.24.85.H08.1.454.CMB.1.raw
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtcgacctcgaggggtccctgacgactctcctgtcgcacgtcctcgtggactttccgcctttacaaattaactttcgtggtaattcggacctaccggttcggggtaccccgaccgaaacggtccgttacccggaaggggggtaacggggtccgttaggtaacggttttttcgggggtacctttaccgtaacggtttaaacttttaaaccgtagtttaggaaggttaggggtaaacgttacggtacctacctaaaccgtaaccgttagtaccgggtaccggtaaccccgttacccgggttaacgggaaaccgggggtaccgttaactttaccccgaacccgtaacgtttacccgtacccgaaaaggaaccgaaacccgaaacccggtacccgaaaacggaaaacctacccgttaacgttacggttaacgttacccgtaacgtaaccgtaaaaagttcggaacgaccgtaaacggtacccgtaacgggtaaaccggaccccggaaacggtaacccgggaacgggttacctagggtttacggttaacgtttaccggtaggttacggaacggaacggggaaccgggggtaccctaaggtacccttaacgtttaaccccggttaaccccgttaacccgtttaaacccggtcccgtaacggtttaaccggtacggggttaacccgggttaccggttaacccggggggaaccggaaacccgggggtacccggtaaccccgggg

SEQ ID NO: 203626 - DNA, 554 bp, Homo sapiens
  misc_feature: GYAE6OF01BB4XB.24.85.H08.1.454.CMB.1.raw
  modified_base (241)..(241): a, c, t, g, unknown or other
  misc_feature (241)..(241): n is a, c, g, or t
  modified_base (443)..(443): a, c, t, g, unknown or other
  misc_feature (443)..(443): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagctctcctgtgcagcctctggattcgccttnaataacttctggatgcacgtgggtccgccaagctccgagggaagggctgatttggctcacgtattaacattgatgggagttagctacactactagtgcggtactccggtgaacggccgaattcaacctatcctaccaagtacgacgaacgccctaagaaaccacgactagtaactctagacaaatgagacagcctagaaacncgaacacgacggctagtgtattactgcacgaaggtcgggactagcgtacttacctcctacttactcgacttaggaacgttcgtacgtagggacgtaaagggccgtaacggg

SEQ ID NO: 203627 - DNA, 646 bp, Homo sapiens
  misc_feature: GYAE6OF01A7XRC.24.85.H08.1.454.CMB.1.raw
  modified_base (242)..(242): a, c, t, g, unknown or other
  misc_feature (242)..(242): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggattcgccttnaattaacttctaggatgcacgtgggtccgccaagctccgaggggaaggggtctgtagttttgggtcctacaacgttattaaacgatttggagtgggagtacgcttacacacttagtggaccggtactccggtagggaaacgggccgtaatttaccaaccctagtccctacccgaagaaccgaacaaacccggaccaacgaaaccaactaccgtagtactactagaactaaagtagaacgacgaacgtacctaaggaaccgaccggaaccgaccgacggtaccttaggttacgttaacgttacgtcggtacgacggtaaggacggggaccagtctaacgttacctaccgtactacccgtcgacgtagtacggtacgtacggacgggaccgaaggtcccgtacggg

SEQ ID NO: 203628 - DNA, 656 bp, Homo sapiens
  misc_feature: GYAE6OF01EOCJY.24.85.H08.1.454.CMB.1.raw
  modified_base (547)..(547): a, c, t, g, unknown or other
  misc_feature (547)..(547): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcgaggggtccctgagactctcctgtgcagcctctggacttccgccttcaaattaaccttctggatgcacgtcgggtcccaccaagcctaccggaaggggaacggggtctggtagttttggggtccttacgtaacgttaattaacgtagtttggagtggggagtacgctacgactaacgtagtcggacggtaccttccggtaggaacgggtccgtaatttacccgaaccgtacttccctaccgaagaacgaaccgaaccgaccaaacgaaaccactactgtaactctagaactaaagtcgacgcgaacgcctaaggaacgccgaacgacgacggtctagttagtattacgnggtacgacgtaagggcgggaccaggtactaacgttaccgtccttaacgtacctccgtacgttagtccgggtacggtcggtacggggaacccgtaacgggcccgtacggg

SEQ ID NO: 203629 - DNA, 906 bp, Homo sapiens
  misc_feature: GYAE6OF01ECD72.24.85.H08.1.454.CMB.1.raw
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtcgacctcgacggggtccctgacgacctctcctgtgcacgcctcgtggacttccgccttacaaattaaccttcgtggatcgcacgtcgggtcccgaccgaagccgtaccggaagggggaacggggtcttaggtagttttcggggtaccttacgtaacggtttaacttaacgtagtttaggaggttaggggtagtacgtaccgttaccaaccgtacgttagtcgggtaccggtacccgttaccgggtaagggaaaccgggggtccctaactttacccaaccgtacttacccgtacccgaaaggtaaccggaaacccaaacccggaacccgaaaccggaaaaccctaacctaaccgttacgttaacttaccgttacgaaacgtaaagtacggaacgtacccgaacgtacccgtaaggaaacccggtacccggaacccgtaacccggtaaccgggtacgtttacgggtttaacggtttaaacgtttaccggttacgggttaacgggtaaccgggtaaacgggggtaacccggggggtacctaaacgggttacccgttaaacccgttttaaccccgttaaccccgttttaaacccgtaaccccggttccccgggttaaccgtttaacccgggtaccggggttaaccccgggttaccggggtaccccggggggtaaaccccgggtaaacccgggggtaaccccgggttaaccccgggggg

SEQ ID NO: 203630 - DNA, 654 bp, Homo sapiens
  misc_feature: GYAE6OF01EH5P6.24.85.H08.1.454.CMB.1.raw
  modified_base (260)..(260): a, c, t, g, unknown or other
  misc_feature (260)..(260): n is a, c, g, or t
  modified_base (331)..(331): a, c, t, g, unknown or other
  misc_feature (331)..(331): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcaggtcttcgtggctcacgtccaccaccacgcatgtgaccgtcaggggtccctgagactctcctgtgcagcctctggacttcgccttcaataacttctggatgcncctcgtcggccacgacgcacggaggtaggcttagttgacgtcactttataatatcgagtggagtaggctanaccccagtactcggtacgtaccgtcgtacggtaacggaccgaacgttccaacctagtcctaccgaacgtaaccgaacgaaaccgaccaaccgaaaccgtaaccgtaacgtaacgtaacttacgtacgtaactagaacttcgaaggccctaaggaaccccgtcgaaacgacccgtaccgggaactacgggtacgtagttacggtagttaacgtcgtaggtaccggaactagggggtccctaagtaccgtacgttacctaccgtacgtaccgttaccgcggtacgttacgggtacggtacgtcggggacccgaacgggtacccgg

SEQ ID NO: 203631 - DNA, 600 bp, Homo sapiens
  misc_feature: GYAE6OF01CKBPH.24.85.H08.1.454.CMB.1.raw
  modified_base (242)..(242): a, c, t, g, unknown or other
  misc_feature (242)..(242): n is a, c, g, or t
  modified_base (251)..(251): a, c, t, g, unknown or other
  misc_feature (251)..(251): n is a, c, g, or t
  modified_base (268)..(268): a, c, t, g, unknown or other
  misc_feature (268)..(268): n is a, c, g, or t
  modified_base (426)..(426): a, c, t, g, unknown or other
  misc_feature (426)..(426): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggattcgccttnaatacttcnggatgcacgtgggtccncaagctccgaggggagggctgatttgggctcacgtattaacattgatgggatagctcaacactatgcggtactccggtaggaacgggtccattccaacctatccctacaaggacaacaaccgccaagaaaccactactgtaatctagactaaaatgancaacgcctaagaaaccgccgaacgaccgacggtcttaggttcgttaattacgtgtacgacgaagggacgggggcccaagtcctaagttaccctacccttaactacccgtccgtacgttaacgtcgggtaaccgttcggtacgggggaacccctaaagggggacccgtaacgggg

SEQ ID NO: 203632 - DNA, 771 bp, Homo sapiens
  misc_feature: GYAE6OF01B62BF.24.85.H08.1.454.CMB.1.raw
tcagactactatgtcacgaccggtgctcgatttagtatcactcagtcgcgggggagccccagccctgggattcccagctgtttctgcttgctgatcaggactgcacacagagaactcaccatggagtttgggctgagctgggttttccttgttgcttatttaaaggtgtcagtgtgaggtgcagctggtgggaggtccgggggaggtcgttagttcgaggccgtggggggtccctgagactctcctgtgcagcctgtggattcgccttacaattaacttcgtggatcgcacgtcggtaccaccgaagccgtaccgaggggaacgggctaggtagttttcggggtcctcgtaacgttaatttaaactagtttaggagttgggtaacgttacgaccgtacaacgtaacttagtcggaccggtaaccgttacccgggtagggaaaccgggtcccgtaacgtttacccaacccgtacttccccgtaaccgaacggaaccgtaaacccgaaacccgaccctaaaacggaaaacctaccgaaaccgtttagtaaccttaccgttaagaaaccctaaagttcgaacggaccgaacggtacccgtaaagggaaacccgacccggtaacggaacctaccggggtaccttggtaacggtttaactttaccggaggttacggaaccgtaaaggggggaccggggaccctaaggttacctaaaccgttttacccaacccccgttaacgttaacccctcccggtaacgtttaccggtaccgggg

SEQ ID NO: 203633 - DNA, 624 bp, Homo sapiens
  misc_feature: GYAE6OF01B5Z6H.24.85.H08.1.454.CMB.1.raw
  modified_base (349)..(349): a, c, t, g, unknown or other
  misc_feature (349)..(349): n is a, c, g, or t
  modified_base (376)..(376): a, c, t, g, unknown or other
  misc_feature (376)..(376): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcgacggggtccctgacgactctcctgtgcacgcctctggacttccgcctttacaaattactttcgtaggattcgacacgtcggggtccccacaacgcctaccggaaggggaacggggtctaggtagtttcgggtctacgtacgtaattaacngtttgagtgggagtagctacactactntcggcgactcggaggaacggcctattccacctatccacgagaacgaccaaccgaccaaacgaaaccactacgtagtatcgtagaactaaagtcgaagcaacggccgtaaggaaccgccgaacgaccgaggtctagttacgtattacgtggagacggaagggcgggtacagtctaactttaccgaccttaccgtacgttccgcgttaggtccggtccgtacggacggggaccgaaacgggccgtacggg

SEQ ID NO: 203634 - DNA, 785 bp, Homo sapiens
  misc_feature: GYAE6OF01BPB4I.24.85.H08.1.454.CMB.1.raw
  modified_base (233)..(233): a, c, t, g, unknown or other
  misc_feature (233)..(233): n is a, c, g, or t
  modified_base (603)..(603): a, c, t, g, unknown or other
  misc_feature (603)..(603): n is a, c, g, or t
tcagactactatgtcacgaccggtgctcgatttagtatcactcaggtcgcgggaggacgctgaccacacggtacgtgctgttgtacctgctcctcccgcggtctttgtcttggcattatgcaccctccacgccgtccacgtaccagttgacttgacctcaggtcttcgtggctcacgtccaccaccacgcatgtgacctcgacggggtccctgagactctcctgtgcagcctntggtattcgtccttcaacttacttcgtggatcggactacgtcgggtcccgacgaacgtcctaccggtaaggggacggggtccttaggttacgttttcgggtccttaccgtacggtttaacttaaaccgtagttacggtacggttggggtaagttaacgccgttaaccactaacgttacgtcgggacccggtaccgttaccgggtagggaacgggccttaacgttcccaaccgtattcccgtaaccgaaggtaaccgaacccgaaaccgtaccgaaagtaaacccacgtaacttagtaacttctaacgaactaaacgttcgacgtacgacggtaccttaaggaaccgtacccgtaccggaccgtacgggtnttacggtacgtttaacttaccggtggaccggtaacgaacgggggaccgggttaccaccgttaaacgttaacccgtttaacccgtaccgttaacccgttacccgtcccgggacttacgggtcccgggttaaccgttcggggaaccccggggttaccgtaaaacggggtcccccggttaaccgg

SEQ ID NO: 203635 - DNA, 719 bp, Homo sapiens
  misc_feature: GYAE6OF01EWVMF.24.85.H08.1.454.CMB.1.raw
tcagactactatgtcacgaccggtgctcgatttagtatcactcagtcgcgggggagccccagccctgggattcccagctgtttctgcttgctgatcaggactgcacacagagaactcaccatggagtttgggctgagcgtggtttcgtgtagcgtatttaaagtgtcagtgtgaggtgcagctggtgggagtccgggggaggcttaggtcagccgtggggggtccctgagctctcctgtgcagcctgtggtatttcgcctttacaaattaaccttgtggatgctacgtcggggtccgaccaacgtcctaccggaagggggtaaacggggtcctagggtagttttcggggtccttaccgtaacggttaattaaacgtagtttagggaagttaggggagttaaggccttacgaactaacgtgtacggaccgggtacctacggtaacgggaacggggtacccgtaactttccgaaccccgtactaccgtacccgaaggaaccgaaccaaaccgggacccaaagtaaaccaccgtaaccgttagtactaccgtgaaaccgtaaaatcggaacggcctaacggtcctaaacggaaaccggacccgtaaaccgaaccgaacggtacgttagttaggttaacttaccggtaggtacgacggtaaaggggaccggggcctagccgttaactacccgttacctaacgtacctccgtacttgtaccggg

SEQ ID NO: 203636 - DNA, 795 bp, Homo sapiens
  misc_feature: GYAE6OF01EI792.24.85.H08.1.454.CMB.1.raw
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtcgacctcgacggggtccctggagaccttctccgtgtgccacggtcctctggacttccgtcctttacaattaaccttcgtaggatcgcgacgttcggggtcccaccgaagccgtaccggagggggaacggggtcttaggtacgttttcggggtccttacgtaacggttttacttaaactagtttaggtaggtagggtaagtacggcttaccaacgtacgttagtcggtaccggtaccgttcgggtagggaaccgggtcctaacgttaccaccgtacttccgtaccgaagaacgaaccgaaccgaccaaacggaaacctacaacgttagttaactacgtacggaactaaagtcggaacgcgtaacggtacccgtaaaggaacccggaccggaaaccggtaaccgtacgggtaccgtttacggttacgggtttaactttaaccggttacggtacgggaaccggtaaacgggggccgggggtaacctacggttaacccttaaccgtttaccttaaccccgttagtaaccccgtaccggttacgttaaccgtcggggtaaccgttacggggacccgggaaaccgggtaaccggacccgggtaaccggg

SEQ ID NO: 203637 - DNA, 661 bp, Homo sapiens
  misc_feature: GYAE6OF01BMLUV.24.85.H08.1.454.CMB.1.raw
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctcgtggattcgccttcaattaacttctggatgcctacgtgggtcccgccaagcctccgaaggggagggctgtagtttgggtctcacgttattaacattggagtgggagtagtctacactactagtcggacggaccttccggtaggaacggggtcccgtactttacccaacctactcctacccgaaggaaccgaacctaaccggacccaaacgaaaccaccacgttagtactctagactaaagtcgaagcacgtaccgtaaggaaccgcccggaaccgacggaccggtcttagttagttacgttacgtggtgacggaagggaccggggaccagtaccgtaactttacccgtacccttaactaccctcccgtacgtacggttcggtaaccggttcggggtacggggaccccgtaaaggggtacccggtaaccgggg

SEQ ID NO: 203638 - DNA, 959 bp, Homo sapiens
  misc_feature: GYAE6OF01EG1VV.24.85.H08.1.454.CMB.1.raw
tcagactactatgtcacgaccggtgctcgatttagtatcactcagtcgcgggggagccccagccctgggattcccagctgtttctgcttgctgatcaggactgcacacagagaactcaccatggagtttgggctgagtcttgggttttccttgttgtcttaagttttaaaaggtgtccagtgtgaggtgcagcgtggtgggaggtccgggggaggtcttaggttcgacggccgttcggggggtccctggacgtaccttcctccgtggtcgcgacgtccttcgtggtactttccgtccctttactaaactttaaacctttcgttagggtattcggaccgtaccgttccggggtaccccgtacccgaaacggtccgtaccggaaggggggtaaacggggtccgttagggttaaggttttcggggttccttacgtaacgttaatttaaacgtagtttaggaggttacgggagtacgtaccgtacgaacgtaacgttagtccgggtaccggtaccgttaccgggtacgggaaccggggtaccgtactttacccgaaccctacgttacccttacccggaaaggtaaccgaacccgtaaacccgaacccaaaacggaaaaccctaccgtaacgttacgttaaccttcgtaaaccgtaactaaaacggtcggaaaccgtaccgaacggttacccgaaaacgggaaaacccggtaccccgggtaaaaccggtaacccggtaaccgggttccgtttacggggtttaaacggttttaaaaccgtttacccggttacggggttaacggtaaacccggggtaaaacggggggtaaccccggggggtaacccctaaagggttaaaccccttttaaaccccgttttaaacccccggtttaaccccttttaaaccccgggttaaacccccggtttaccccgggtttacgtaaaccgggtttaacccccgggggg

SEQ ID NO: 203639 - DNA, 723 bp, Homo sapiens
  misc_feature: GYAE6OF01AR50A.24.85.H08.1.454.CMB.1.raw
  modified_base (334)..(334): a, c, t, g, unknown or other
  misc_feature (334)..(334): n is a, c, g, or t
tcagactactatgtcacgaccggtgctcgatttagtatcactcagtcggcgggaggacgctcgaccacacggtacgtgctgttgtactgctcctcccgccggctttgtcttggcattatgcacctccacgccgtccacgtaccagttgaacttgacctcaggtcttcgtggctcacgtccaccaccacgcatgtgacctcaggggtccctgagactctcctgtgcagcctcgtggacttcgcctttcaactaacttctggatgctacgtcgggtccgccaagcctccgaggggaaggggcctggacgtttcggggtctctacggttattaaccngtttagagtggggaattaggccttacaacacttaagtcggcggtaacctcccggtaggaacggggtccgtattaccgacctagttccctaccgtaaggaacgaaccgaaaccgcccgaaacgaaacccacctaacgtagttaacgttctaggaactaaacgtcggaacgaccgtaaggtacccctaaggaaaacccggtccccgtaaacggtaacccgtaaccgggtacctttagggtttacgttaacgttttaaccgttggtacgtaacggaacggggtaccgggggtacctacgggtactaaccggtttactacccgttaccgtaaccgtccgtacgtagtacgggtaccgttcggtacggggaccctaaaggggcccgtaaccggg

SEQ ID NO: 203640 - DNA, 654 bp, Homo sapiens
  misc_feature: GYAE6OF01B9H38.24.85.H08.1.454.CMB.1.raw
  modified_base (222)..(222): a, c, t, g, unknown or other
  misc_feature (222)..(222): n is a, c, g, or t
  modified_base (229)..(229): a, c, t, g, unknown or other
  misc_feature (229)..(229): n is a, c, g, or t
  modified_base (459)..(459): a, c, t, g, unknown or other
  misc_feature (459)..(459): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtncagcctntggattcgccttacaattacttctggatgcacgtgggtccacaagcctccgagggagggctggtagtttcgggtctctacgttaattaactagttgagtgggatacgctacgactactgtcggacggtacctccggtaggaacgggtccgtaacttccgaacctattccgtaccgaaggacgaaccgaaccgaccaacgaaaccactacgtatactctagacaaatgacnccgagaccgtaaggaaccgcccgaacgaccgacggtcgtagttacgttaagttacgttagtgaacggaacgggacggggaccaacggtacttaacctttaccgttaacccctacgttaacccgttccggtaccttagggtaccggtaccggtttacgggacccggggaccgggtaaaccgggccgtaacccgggg

SEQ ID NO: 203641 - DNA, 738 bp, Homo sapiens
  misc_feature: GYAE6OF01CBYGT.24.85.H08.1.454.CMB.1.raw
tcagactactatgtcacgaccggtgctcgatttagtatcactcagtcgcgggggagccccagccctgggattcccagctgtttctgcttgctgatcaggactgcacacagagaactcaccatggagttgggctgagtctgggttttccttgttgcttaatttaaaaggtgtcagtgtgaggtgcagctggtggaggtccgggggagtcttagttcaggccgtgggggtccctgacgactctcctgtgcacgcctgtggtacttcgtcctttacaaacttaacttcgtggtaactcgcgtacgttcgggtcccgaccgtaacgtccgtaccggaagggggtaacgggccttaggtagttttcgggtacctacgtaaacgtttattaaaccgtatttagggagttacggggaagttacggtctaccgtaacgtaacgttacgtcggaccggtaaccgtaccgggttaggaaaccggggtcccttaacgttacccaacctacgtacctaaccgaagaaccgaaaccgaaccgaacccaaacggaaacctacgtaacgttacgtactacgtacgaacaaagtcgacgtaccacgtaccgaagaaccgccgaacacgacgtcgtagtaacgttacgtaccgtaggtacgaacggtaacgggacggggtaccctaagtaccgttaaactttaccccgttacccttaacccgttacgttaccccggtagttcggttaacccgggg

SEQ ID NO: 203642 - DNA, 622 bp, Homo sapiens
  misc_feature: GYAE6OF01BGFIU.24.85.H08.1.454.CMB.1.raw
  modified_base (423)..(423): a, c, t, g, unknown or other
  misc_feature (423)..(423): n is a, c, g, or t
  modified_base (455)..(455): a, c, t, g, unknown or other
  misc_feature (455)..(455): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcgaggggtccctgagactctcctgtgcagcctcgtggacttccgccttcaattaacttctggatgcacgtcgggtccacaagcctacgaggggaacgggctgtagtttcgggctacgtacgtaattaacagttgagtgggagtagcctacactactatcggacggactccggtaggacgggtcctattccgaacctatcctcaagacgaacaaccgcaagaaaccnctaacgtgtactacgtagacaaaagtggaacncgtaacgctaaggaaccgcccgacgaccgacggtctaggttactaagtttcgacgtacgaacggaaacgggtcggggaccctaggcccttaacgttaccctccgtaccttaccggtcccgataccggtggtacccgtggaccggggaccgaaacgggtccgtaccgg

SEQ ID NO: 203643 - DNA, 691 bp, Homo sapiens
  misc_feature: GYAE6OF01BGTKF.24.85.H08.1.454.CMB.1.raw
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcgaggggtccctgacgactctcctgtgcagcctctggattcgccttcaatacttctggatgcacgtcgggtccgccaagctccgaggggaggggctgtagtttgggtctcgacgttattaacattggagtggggagtacgctacacactatggcgacgtccgtaggaacgggccgtattaccgaccatcctaccgagacgaaccaacgaccaagaaaccactactagtactctagactaaagtgagaccaacggtcctaaggaacgtcccggaacggaaccgacgggtcttacggtagttaacgttacggtggtacggacggtaaagggggacgggggcccaaggtacccttaaacgttttaacccgttaccccgttaaaccgtttacccggtccccgttaacgttaacgggtttcccggggtaacccggttacccggggttaaccgggggggaaccccgtaaaccgggggggtaacccctaacccgggggggg

SEQ ID NO: 203644 - DNA, 972 bp, Homo sapiens
  misc_feature: GYAE6OF01B8FU1.24.85.H08.1.454.CMB.1.raw
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcgacggggtccctgacgactctcctgtgcacgccttcgtggtacttccgtccctttacaaactttaaccgttttccgtagggtaacttcggacccgtaaccggtttcgggggtaccccgaacccgaaacggtcccgttacccggggaaagggggggtaacgggggtccttagggttaacggtttttcggggtccttaccggtaaacgttaactttaaacgagtttaggagttaggggaagttacgccttaccaacgtacgtaggttcggacccggtaccgttacccgggtagggaaaccgggtacccttacttaccaacccgtagttaccccgtaaccggaaaggaaacccgaaaccgaaaccccggaaccgaaaaccggaaaacctaaccgtaacgtttaacggttaaccttaccgttaaacggaaccttaaaaagtcgggaaacgtaccgtaaaccggtacccgtaaaacgggaaaccccgggaccccggtaaaccgggaacccggtaaccgggggttacctttaagggtttaaccggttttaaccgtttaaccgggtacgggttaaccgggaaaccgggtaaaccgggggggaaccgggggtaccctaaacgggtacccttttaaacccggttaaccccgtttaccccgttaaaaccccggtttcccggttaccccgtaggtttaaccgggtaccgggggttaaccccgggttaccgggtaccggggggaaacccccgggttaaacggggtccccgggttaaaccccggggg

SEQ ID NO: 203645 - DNA, 524 bp, Homo sapiens
  misc_feature: GYAE6OF01ERB2G.24.85.H08.1.454.CMB.1.raw
  modified_base (363)..(363): a, c, t, g, unknown or other
  misc_feature (363)..(363): n is a, c, g, or t
  modified_base (367)..(367): a, c, t, g, unknown or other
  misc_feature (367)..(367): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggattcgccttcaataacttctggatgcacgtgggtcccgcaagcctccgagggagggctgatttgggctcacgtattaacattgagtgggatagctacacactatgacggactcgtaggaaggccattcacntccncagacgacacgccaagaacacactgtactctagacaaatgagcacgcctagaacgccgacgacacggctgtgtatactgtgacgaaggcggggccagctaattacctcctactacctccgactagtcggacgtcgagggacccaagggccgtacggg

SEQ ID NO: 203646 - DNA, 651 bp, Homo sapiens
  misc_feature: GYAE6OF01DXF59.24.85.H08.1.454.CMB.1.raw
  modified_base (210)..(210): a, c, t, g, unknown or other
  misc_feature (210)..(210): n is a, c, g, or t
  modified_base (271)..(271): a, c, t, g, unknown or other
  misc_feature (271)..(271): n is a, c, g, or t
  modified_base (446)..(446): a, c, t, g, unknown or other
  misc_feature (446)..(446): n is a, c, g, or t
  modified_base (516)..(516): a, c, t, g, unknown or other
  misc_feature (516)..(516): n is a, c, g, or t
  modified_base (559)..(559): a, c, t, g, unknown or other
  misc_feature (559)..(559): n is a, c, g, or t
tcagactactatgtcacgaccggtgctcgatttagtatcactcagtcgcgggaggacgctgaccacacggtacgtgctgttgtactgcctcctcccgcggctttgtcttggcattatgcacctccacgccgtcacgtaccagttgaacttgacctcgagggtctcgtgctcacgtccaccaccacgcatgtcgacctcgacggggtcccnggacgacctcgtcctggtgcacgtcctgtggacttccgcctttacaaattacttcttggangtcacgtcgggccaccaagcgtccggaggggaacgggctggtagtttgggctactaacgtactaagtattgagtacgggtagtacgactacactaacgtatcggaccggtactccggtaagggacggtaccgtacttaccaacctagtccaccaaggacgaaccgaacaccgaanaaaccttacactagtattacgagtaacaaagtcgacgacgacaccgaagaacggcctacggacaccggtnttacgattagtactggtcggacgaagggaccggggcaaacgtntaacctttacccgtaccttaacaccgttcccagtttacgggacggtacccgttagggaccccgggaacgggaaacggtccggtaacccgggg

SEQ ID NO: 203647 - DNA, 845 bp, Homo sapiens
  misc_feature: GYAE6OF01DJFFU.24.85.H08.1.454.CMB.1.raw
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcgacggggtccctgagctctcctgtcgcacgcctcgtggacttccgccctttacaaattaactttcgtggatgctacgtcgggtcccgaccaagccgtaccggaagggggaacgggggtcttagggtacgttttcgggggtaccttaccgtaacgtttaatttaaaaccgagttttaggtaagttagggggtaagttacggccttaccaacgtaaccttaaggtcgggtacccgggtaaccttacccggggttagggaaaccggggtcccgtaactttacccgaacctaacgttccctacccgaaaggaaaccgaaacccgaacccggaacccgaaacggaaaacccaaccgtaacgttaggttaacttacgttaacggaaacctaaaagtggaaccgacggtaaccgtacccgtaaacgggaaaaccggccccggaaacggaacccgaacgggtccgtttaggttaacggtttaactttaccgggtaggttacggaaccggaaagggggaccgggggtacctaacggtacccttaacgttttaaccccgttaacccttaacgtttaccccgtcccggtacgtttaggtaccggggtaccggttaccgggtacgggggaacccgtaaacgggggacccggtaccgggg

SEQ ID NO: 203648 - DNA, 544 bp, Homo sapiens
  misc_feature: GYAE6OF01BZI2S.24.85.H08.1.454.CMB.1.raw
  modified_base (270)..(270): a, c, t, g, unknown or other
  misc_feature (270)..(270): n is a, c, g, or t
  modified_base (397)..(397): a, c, t, g, unknown or other
  misc_feature (397)..(397): n is a, c, g, or t
  modified_base (446)..(446): a, c, t, g, unknown or other
  misc_feature (446)..(446): n is a, c, g, or t
  modified_base (456)..(456): a, c, t, g, unknown or other
  misc_feature (456)..(456): n is a, c, g, or t
tcagactactatgtcacgaccggtgctcgatttagtatcactcagtcggcgggaggacgctgaccaccacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggattcgccttcaataacttctggatgcactgggtccncaagctccgagggaggggctgatttgggctcgacgtattaacatttgagtgggagtagctcactactatgcggactccgtggaacgggccattccaccatcctacagacgacaacgccaagaaaccncactgatcagacaaatgagcacgcctagaacgcgacgacgcggctagtntattactgtnacgaaggcggggccaggctacgttacctcctacctaccgtccgacttagtcggtaccgtcggtacggggacccgaagggccgtacggg

SEQ ID NO: 203649 - DNA, 839 bp, Homo sapiens
  misc_feature: GYAE6OF01BC3WP.24.85.H08.1.454.CMB.1.raw
  modified_base (760)..(760): a, c, t, g, unknown or other
  misc_feature (760)..(760): n is a, c, g, or t
tcagactactatgtcacgaccggtgctcgatttagtatcactcagtcgcgggggagccccagccctgggattcccagctgtttctgcttgctgatcaggactgcacacagagaacctcaccatgggtagtttgggctggagtcgttgggttttccttgttgtcttaagttttaaaaggtgtccaggtgtggaggtgcgagcgtgggtgggacggtccgggggaggtcgttagttcgacggtccggtcggggggttccctggacgaccttctccgtggtcgcacggtcctcgtcggtacttccgtaccctttacgtaaattaaccttcgtaggtactcgtaccgtaccggttcggggtaccccgaccgaaccggtccgtacccgggaaggggggtaacggggtccgttagggttaacggttttccggggtaccgttaaccggttaacggtttaaactttaaaccgttagtttagggaggttaggggtaacgttacggtacctaccgtaaccgtaaccgttacgtcgggtaccggtaccgttaccggggtaggaaaccggggtccctaacgttacccaaccgtactttcccgaaccgaacggaccgaaacccgtaaaccgacccgaaaacgaaaccaccgttacgtaacgttacgtacgtaggtaaacctaaaggtcgaacgacccgtaagcccgtaaagggaaaccggccccggaaacggtaccgtaacccgggtgttacggttaacgttacgtttacggnggaacggtacgggaaagggggccgggaccaaggtacctaacgttacctacctaccggtactcccgtagtcggtaacggg

SEQ ID NO: 203650 - DNA, 521 bp, Homo sapiens
  misc_feature: GYAE6OF01CAUM5.24.85.H08.1.454.CMB.1.raw
  modified_base (358)..(358): a, c, t, g, unknown or other
  misc_feature (358)..(358): n is a, c, g, or t
  modified_base (478)..(478): a, c, t, g, unknown or other
  misc_feature (478)..(478): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggattcgccttcaataacttctggatgcactgggtccgcaagctccagggagggctgatttgggtctcacgtattaacattgatgggagtagctcacactatgcgactcgtgaaggccattcacatcncagagacaacgccaagaaaccacactgtatctagacaaatgagcagcctagaaacgccgaacgacacggctgtgtattactgtagacaaggacggggccagctattaccgtcctactacnccgcttagcggtacgtcgaggggaccaaaggggaccgaacggg

SEQ ID NO: 203651 - DNA, 566 bp, Homo sapiens
  misc_feature: GYAE6OF01EZU84.24.85.H08.1.454.CMB.1.raw
  modified_base (290)..(290): a, c, t, g, unknown or other
  misc_feature (290)..(290): n is a, c, g, or t
  modified_base (473)..(473): a, c, t, g, unknown or other
  misc_feature (473)..(473): n is a, c, g, or t
tcagactactatgtcacgaccggtgctcgatttagtatcactcagtcgcgggggagccccagccctgggattcccagctgtttctgcttgctgatcaggactgcacacagagaactcaccatggagtttgggctgagctgggttttccttgttgctattttaaaaggtgtccagtgtgaggtgcagctggtggagtccggggaggcttagttcagccgtggggggtccctgagactctcctgtgcagcctctggattcgccttcaataacttctggatgcactgggtccnccaagctccgagggaaggggctgtatttgggtctcgacgtattaacattgagtgggagtagctcacactagtcggacggtacctccggtaggaaacggggcccgtaatttccgaaccctacttctacccgaagacgaaccaaccgacccaacgaaaccacactagtactctacgacaatgacncagcctagaacgccgaacgacgacggctgtatattacgtgtagacgaaggaggggccagactattacctacctactacctccgtctagtacgg

SEQ ID NO: 203652 - DNA, 799 bp, Homo sapiens
  misc_feature: GYAE6OF01BK5UJ.24.85.H08.1.454.CMB.1.raw
tcagactactatgtcacgaccggtgctcgatttagtatcactcagtcgcgggggagccccagccctgggattcccagctgtttctgcttgctgatcaggactgcacacagagaactcaccatggagtttgggctgagctgggttttccttgttgctattttaaaaggtgtccagtgtgaggtgcagctggtggaggtccgggggaggcttagttcaggccgtgggggtccctgagactctcctgtgcagcctctggacttccgccttacaattaacttctggatgactacgtcgggtccgaccaacgcctaccgaggggaacggggtctaggtagttttcgggtctacgtacgttaacttaaacgtagtttaggagttagggagttaggacctacgaacctacgttaagtcgggtaccggtaccgttacccgggtagggaaaccggggtcccgtaactttacccgaaccctacgttcctacccaacggaacgaacccgtaaacccggacccctaaaacggaaaccctaaccgtaaccgtttacgtaaccttccgtaacgaaccgtaaaagtacggaacggtaccaaacggtacccgtaaagggaaacccggaaccccgggtaaccgaacccggtaccgggtacgttacgggttacgtttaaacgtttaccggttaggttaacgggaaccggtaaacgggggaccggggggtacccaagggtaccctttaaccgtttaaccccgtacccctttaaaccgttacccccgtttaccggtaccgttaaacgggttacccgggg

SEQ ID NO: 203653 - DNA, 793 bp, Homo sapiens
  misc_feature: GYAE6OF01DDL5T.24.85.H08.1.454.CMB.1.raw
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcgaggggtccctgacgactctcctgtgcagcctctggacttccgtccttacaaattaacttcgtggactgacctacgtcgggtcccaccgaacggccgtaccggaagggggaacggggtcttaggttagttttcggggtcctacgtaacgtttaattaactagtttggaagtgggtaagtacgtcctacaactacgttaagtcggacggtaccgtacggtaggaacgggtccgtaacttaccaacctagttacccgtaccgaaggaaccgaaacccgaaccggaacccgaaacgaaaaccctactaaccgttaggtaacttacgtacgaacgtaaaacgtggaaccgacgtaaccgtaccgtaaacggaaaccggaccccggaaacgacccgtaacgggttcgttacggttacgtttaaccgtttacggtcgggtaacgaaccgggtaacgggggaaccggggtccctaacgggtaccttaaccgtttacccgttaaccccgttaacgttaccctcccggtaacgttacgggtaccggggttaacccgttcggggtaaccggggaacccggtaaacggggcccggttaacccgggg

SEQ ID NO: 203654 - DNA, 725 bp, Homo sapiens
  misc_feature: GYAE6OF01C73JV.24.85.H08.1.454.CMB.1.raw
tcagactactatgtcacgaccggtgctcgatttagtatcactcagtcgcgggaggacgctgaccacacggtacgtgctgttgtactgcctcccccgcggctttgtcttggcattatgcacctccacgccgtcacgtacagttgaacttgacctcagggtcttcgtggctcacgtccaaccaccagcatgtcgacctcgacggggtccctgagacctctcctgtcgcagccttgtggactttcgcctttacaaattaaccttgtggaatcgcacgtgggtccgacaacgcgtaccgaaggggaaggggctagtagtttcgggtctacgaacgttagttaactagttgagtgggagtagctacacactagtggacggacgttccgtagggaacgggaccgacttacaacctacgtacctacccgagaacgaacgaaaaccgccaaacgaaacctaacgaaccttacgtaacgttactacgtaactaaacgtaacgaacggtaccgacggttacccgaaagaaaccggaaccggaaccgaacggtaccggtacgttaggttaacgttaacgtttaacgtggttacggacggaacgggtacgggggaacacgtacgttaacttaacccgttacctaaccttacccgtacgtacccgttaaggtaccgggtaacggttacccgggtaacggggaccgggtaaacccggaaccgggtacgggttaccccgg

SEQ ID NO: 203655 - DNA, 720 bp, Homo sapiens
  misc_feature: GYAE6OF01DGUHH.24.85.H08.1.454.CMB.1.raw
  modified_base (317)..(317): a, c, t, g, unknown or other
  misc_feature (317)..(317): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgaccctcaggggtccctgacgactctcctgtgcagcctctggacttccgccttacaaataacttctggatgcacgtgggtcagccaagctccgagggagggctgagtttggtctcagttataacnttgagtgggatagctcgactactagtggaccggacttcccggtaggaaacggggtccccgtaatttccgaaccctacttcccgtaccgaaagacgaaccaaccggaccaaaacgaaaccactaacgttacgtaactccgtaagaacgtaaaatgggaacgtaccaagtccctaaacggaaaccgtcccggaacgaccgtacggggtccttaaggtttcgttaaacgtttacgtgggtacgtacgggaaacggggtaccgggggacccctaaaggtcccttaaaccgtttaacccgttaccccgttaaacttaccccggttacccggtaccgttaaaggttccccgggtaaacgggttccgggtacggggggaaacccccggttaaaccgggggtaaccccggg

SEQ ID NO: 203656 - DNA, 720 bp, Homo sapiens
  misc_feature: GYAE6OF01CZERP.24.85.H08.1.454.CMB.1.raw
  modified_base (269)..(269): a, c, t, g, unknown or other
  misc_feature (269)..(269): n is a, c, g, or t
tcagactactatgtcacgaccggtgctcgatttagtatcactcagtcggcgggaggacgctgaccacacggtacgtgctgttgtactgctcctcccgcggtctttgtcttggcattatgcacctccacgccgtccacgtaccagttgaacttgacctcagggtcttcgtggctcacgtccaccaccacgcatgtcgacctcgacggggtccctgacgaccttctccgtgtcgcacgtcctctaggattccgtccttacaattacttcgnggtatcgccacggtcgggtcccacctaagtcctaccgaggaggaagggtctaggtagtttggactacgtaacgttaacttaactagttaggaggttagggtaagttacgtccttacgaacctagtaacgtcggaccggtacccgttcggtaacgggaaccgggtacctacgtttaccgaacctacgtcccgtaccgaaggaaccgtaaccgaaaccggaccaaacgaaaacctacgtaacgtacgtactacgactaacaaagcgacgactacgacgtaacggaacgaccgaaggtacgccggtacttcggttacttaacgttacgtggtaaccggacggtaaacggggccgggtacacggaccttaaccgttacccttaccgtacctaccgtccgtacgttacgggtaccggtaccgggttcggacccggggtaccgaacggggtacccgg

SEQ ID NO: 203657 - DNA, 160 bp, Homo sapiens
  misc_feature: GYAE6OF01C2LQG.24.85.H08.1.454.CMB.1.raw
  modified_base (158)..(160): a, c, t, g, unknown or other
  misc_feature (158)..(160): n is a, c, g, or t
tcagactactatgtcacgaccggtgctcgatttagtatcactcagtcgcgggggagccccagccctgggattcccagctgtttctgcttgctgatcaggactgcacacagagaactcaccatggagtttgggctgagcgggctggcaaggcgcatagnnn

SEQ ID NO: 203658 - DNA, 793 bp, Homo sapiens
  misc_feature: GYAE6OF01DELO9.24.85.H08.1.454.CMB.1.raw
  modified_base (125)..(125): a, c, t, g, unknown or other
  misc_feature (125)..(125): n is a, c, g, or t
tcagactactatgtcacgaccggtgctcgatttagtatcactcagtcgcgggggagccccagccctgggattcccagctgtttctgcttgctgatcaggactgcacacagagaactcaccatggngttggctgagtcttgggttttccttgttgtacttaagttttaaaaggtgtcctagtgtggaggtgcagcgtgggtgggacgggtccgggggagtcgttacgttcgacggtcccggtcggggggtccctggaacgtccttccttccgtgtggcgtacgtcccgtgtcggtacttccgtacctttaactaacgttaacctttcgtaggtacgtcgccgtaccggtcgggtcccgaccgtaacgccgtacgggaagggggtaacgggtcttggttacgtttcggtctacgtaacgttaattaacgtagttaggtaggtagggtagtacgtactacgaacgtaacgtagttacggaccggtacgttaccgggaacgggtaccgggtaccgtaaccttacccgaaccttacgtaacccgtacgaacggaaacgaacccgaaacccggtaacccaaacgaaaccctaaccgtaaacttaccgttaacgtacctaagtaaacgtaagtacgaacgaaccggtacggtaacctaacgggaaaccaacccgggtacggaaccgtaccggtgttacgtaacgttaacttacgtacgggtacggaacggaacggggtacccgggactaacggttacttaccttacctacccgttacaccggtcctagttcggtaccggg

SEQ ID NO: 203659 - DNA, 742 bp, Homo sapiens
  misc_feature: GYAE6OF01BM7IG.24.85.H08.1.454.CMB.1.raw
  modified_base (598)..(598): a, c, t, g, unknown or other
  misc_feature (598)..(598): n is a, c, g, or t
  modified_base (620)..(620): a, c, t, g, unknown or other
  misc_feature (620)..(620): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttcgacctcgagggtcttcgtggctcacgtccacccaccacgcatgtcgacctcgacggggtccctgacgacctctcctgtgcacgcctcgtggtacttccgtcctttacaaacttaacctttcgtggatcgctacggtcgggtacccgaccaagccgtaccggaagggggaacgggtctaggtagtttcgggtacctacgtaacgttaacttaactagtttaggaggtgggtaacgtacgtacctactaacctacgttacgcggtaccggaccgttaccgggacgggaaaccggggtccctaacgtttacccgaacctacgttacccgaccgtaaacggaaccgaaaccgaacccgaacccgtaaagaaaccaccgttaagttcggtaaatccgaagaactaaagtggacgactacggacctaaggaacccgccgaaacgacgtcggtnttacggtacgttaactttcggnggtacgaacgggaacggggcgtaccagttcctaaccgtttaccctaccgtaaccgttcctccggttatacgggttacggtaccgttacggggacccggggtacaaacggggtccgtaccggg

SEQ ID NO: 203660 - DNA, 727 bp, Homo sapiens
  misc_feature: GYAE6OF01BJBRQ.24.85.H08.1.454.CMB.1.raw
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcaggtcttcgtggctcacgtccaccaccacgcatgtgacctcgaggggtccctgagactctctgtgcagcctcgtggattcgccttcaaataacttctggatggcctacgtcgggtcccgaccaaacggccgtaccggaagggggaaacggggccttaggttacggtttttcggggtcttaccgtaacgtttaatttaaaccagtttaggaaggtaggggtaagttacggtcttaccaactaaccgttagtcgggaccggtaccgttcccggtagggaacggtccgtaactttcccgaacctactccgtaaccgaaggtaacgaaccaaccggaccaaagaaacccgtactaaccgttagtaactccgtagaaactaaagtcggacgacaacggtacccgtaaggaaaccgcccgaacgaccggtacggtctttaggtacgttattaccgtggtacgaacggtaacgggcgggccaagtaccttaatttacccgtaccctaccgttaccgccgtaccttaggtcccggtaccgttcgggaaccgggaccggtaaaccggggtccggtaccgg

SEQ ID NO: 203661 - DNA, 877 bp, Homo sapiens
  misc_feature: GYAE6OF01D8QWH.24.85.H08.1.454.CMB.1.raw
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggacttccgccttcaattaacttctggatgccacgtcgggtcccgaccaagccgtaccgaaggggaacggggtctggtagttttcggggtcctacgtaacggttaattaacgtagtttaggagttggggtaagttacgccttacaactactacgtcgggaccggtaccgttacccgggtagggaaaccggggtcccgtaactttacccaacccgtacgttccctacccgaaggaaccgaaacccgaaacccggacccaaaacggaaaaccaaccgtaaccgttaggttaaccttaccgtaaggaaacctaaaaagttcggaaacgaccgtaaaccggtacccgtaaacgggaaacccgggccccggtaaaccggaacccgtaaccggggttaccgtttagggtttacggttttaaacgttttaccggttacgggttacggaaccgggtaaacggggggaccggggggtacccctaaagggttacccgttaaaccgttttaccccgttaaccccgttttaaacccgttaaccccggttccccggttaacggtttaaccgggttacccgggggttaacccgggtttacccggggtaccggggggtaaaccccggtaaaaccggggggtaccccgggttaaacccggggg

SEQ ID NO: 203662 - DNA, 937 bp, Homo sapiens
  misc_feature: GYAE6OF01ASUVC.24.85.H08.1.454.CMB.1.raw
tcagactactatgtcacgaccggtgctcgatttagtatcactcagtcgcgggggagccccagccctgggattcccagctgtttctgcttgctgatcaggactgcacacagagaactcaccatggagtttgggctgagctgggttttccttgttgcttattttaaaaggtgtccagtgtgaggtgcagctggtggaggtccgggggaggcttagttcagccgtggggggtcctgagactctcctgtgcagcctcgtggacttccgccttacaattaacttctggtatcgctacgtcgggtcccgaccaacgccgtaccggaagggggaacgggggtccttggtaacgttttcggggtaccttacgtaaacggtttaactttaaaccgtagttttaggaaggttaggggtaacgttaacggtaccttaccgtaaaccgtaacgttaacgtacgggtacccgggtaaccgttacccggggtaacgggaaaaccgggggtcccgttaaacgtttacccgaacccgtaacgtttccccgttaacccggaaacgggaaaccggaaaccccgtaaaaccccgggaaccccgaaaaaggtaaaaaccccaaccgttaaacccgtttaaggttaacctttaccggtaacgtaaacgtaaaacgttcgggaacgaacccgtaaaccgggtacccgttaaacgggaaaacccgggtccccgggaaaacccggtaacccggtacccggggttaacgtttacgggttaaacggtttaaacgttttaccgtacggggttaaccgggaaacccgggtaaaaggggggtaccccggggggtaaccctaacgggttaacccgtttaacccttttaaacccccccgttaacccgtttaaacccggttaaccccgttaccccggttaacggtttaaaccggttaaccccggggggg

SEQ ID NO: 203663 - DNA, 698 bp, Homo sapiens
  misc_feature: GYAE6OF01DVC8E.24.85.H08.1.454.CMB.1.raw
  modified_base (273)..(273): a, c, t, g, unknown or other
  misc_feature (273)..(273): n is a, c, g, or t
  modified_base (530)..(530): a, c, t, g, unknown or other
  misc_feature (530)..(530): n is a, c, g, or t
  modified_base (535)..(535): a, c, t, g, unknown or other
  misc_feature (535)..(535): n is a, c, g, or t
  modified_base (543)..(543): a, c, t, g, unknown or other
  misc_feature (543)..(543): n is a, c, g, or t
tcagactactatgtcacgaccggtgctcgatttagtatcactcagtcgcgggggagccccagccctgggattcccagctgtttctgcttgctgatcaggactgcacacagagaactcaccatggagtttgggctgagtcttgggtttttccttgttgtacttaagttttaaaaggtgtccagtgtgaggtgcagcgtggtgggaggtccgggggaggtcgttagttcgaggtccggtggggggtccctggagactctcctgtcgcacgtcctntggtacttccgtccttacaaattaactttcgtagggtacttcggacctacggttcggggtaccccgaccgtaacggtccgtaccgggaaggggggtaacggggtccttagggttacggttttcggggtacctacgtaacgttaattaactagttaggacgtagggtaagtacgactactaactacgtagtcggaccggtacgtccggtaggaacggtctaattccactactctacgagacgacaccgacaacgaacnctatntatacganaactaagcgaacgcacgtaccgtaaggaacccgtccggaacgaccgtacggttacttacggttagtttaaccttacggagttacggaacggtaaggggtcccgggactacggtacttaaccgttacctaccgtacctagccgtagtggtaccggg

SEQ ID NO: 203664 - DNA, 595 bp, Homo sapiens
  misc_feature: GYAE6OF01EZCSB.24.85.H08.1.454.CMB.1.raw
  modified_base (245)..(245): a, c, t, g, unknown or other
  misc_feature (245)..(245): n is a, c, g, or t
  modified_base (467)..(467): a, c, t, g, unknown or other
  misc_feature (467)..(467): n is a, c, g, or t
  modified_base (529)..(529): a, c, t, g, unknown or other
  misc_feature (529)..(529): n is a, c, g, or t
tcagactactatgtcacgaccggtgctcgatttagtatcactcagtcgcgggaggacgctgaccacacggtacgtgctgttgtactgctcccccgcggctttgttcttggcattatgcacctccacgccgtccaccgtaccagttgtacttagtacctcgaggggtcgtttcgttgggctcctaccgtcccaccaccacgctatggttgaccctcgacgggggtccccttgagaccttctcctgngcacgtcctctggattccgccttacaattaactttctgggatgcacgtgggtccgaccaagctccgaggggaaggggtcgtgtagtttcgggttcgtctacgttaatttaactattggagtggggagtgctcacactatggcggacgtcgtaggaggaccgatttcaccatctaccagacgaaccaaacaccaacgaaacactactagtatactagacaaangagcacgctagaacggaccgacggacacggctgtagttagttacgtgtcgacaacgattacngtacacgaccgttggacggtagctaattcgtaagaactttaccctcaagtcgtaggtcggggcccg

SEQ ID NO: 203665 - DNA, 566 bp, Homo sapiens
  misc_feature: GYAE6OF01BZTO3.24.85.H08.1.454.CMB.1.raw
  modified_base (251)..(251): a, c, t, g, unknown or other
  misc_feature (251)..(251): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggattcgccttcaatacttcnggatgcacgtggtccgccaagctccgagggaaggggctgatttgggctcacgtattaacattgatgggatagctcacactatgccgactccgagaacggccgattcacatctccagagacaacgccaagaaaccacactgtatctgacaaatgagcagcctagaacgcccgaacgaccgacggctgtacgtattacgtgtagacgaaggtacgggggcctaggtcctaagtttaacccgtcccgtaaccttaacccgtcccgtacgtagtcgggtaccgttcggtacggggaccctaagggggcccgtaacgggg

SEQ ID NO: 203666 - DNA, 550 bp, Homo sapiens
  misc_feature: GYAE6OF01EVULO.24.85.H08.1.454.CMB.1.raw
  modified_base (314)..(314): a, c, t, g, unknown or other
  misc_feature (314)..(314): n is a, c, g, or t
  modified_base (438)..(438): a, c, t, g, unknown or other
  misc_feature (438)..(438): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggattcgccttcaataacttctggatgcacgtcgggtccgccaagcctccgaggggaaggggctgtagtttgggtctcgtaacngtaatttaacgatttgggaattggggagttagcctcacgactagtcgccgggactcccggtgaagggtcccgaattccaccatctccgagacgacaacgaccagaaacacactcgtatactagnaaatgagccagacctcgaaagccgacgacacggctgtgtagttactgtaggcgaagaggggccagtcattactcctacactcgctactggacgactggggccaagggacccg

SEQ ID NO: 203667 - DNA, 800 bp, Homo sapiens
  misc_feature: GYAE6OF01BGNAH.24.85.H08.1.454.CMB.1.raw
  modified_base (330)..(330): a, c, t, g, unknown or other
  misc_feature (330)..(330): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggattcgccttacaattacttcgtggatgcacgtcgggtcccgccaagctaccgaggggaagggcttggtagtttggggtactcgtacgttaatttaacngtttagagttggggagtagtcgtactaactactagtcggacggaccgttccggtaggaaccggggtccctaagtttacccaacccgtacgttccctacccgtaacggaacgaaaccgaaacccgacccgaaaacgtaaacccgtacctaacgttacggttaacttaccgtacggtaaactaaaagttacggaacgtaccgaaccgtacccggtaacggaaaaccgggtacccggaaaccgaacccggtttacgggaccgtttaggttaccggtttaaacgttaccgttacggggtacgaacgggaaaccgggggtacgggggaccctaaggtaccttaaccgtttaaccccgttacccgttaaacccgttacccgttcccggttacgttaacgggttacccggggtaaccggttacccgggtaacgggggggaacccgtaaaacccggggggtcccggttaaacccgggg

SEQ ID NO: 203668 - DNA, 755 bp, Homo sapiens
  misc_feature: GYAE6OF01BRUTZ.24.85.H08.1.454.CMB.1.raw
  modified_base (254)..(254): a, c, t, g, unknown or other
  misc_feature (254)..(254): n is a, c, g, or t
  modified_base (328)..(328): a, c, t, g, unknown or other
  misc_feature (328)..(328): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcgaggggtccctgagactctcctgtgcagcctctggattccgccttcaataacttcnggatgctacgtcgggtccaccaagcctccggaggggagggtcttggtagttttgggctacgacgttaattaacnttagagtgggtatacgcctacacactagtcgccggtactccggtaggaacgggcctacttccaacctctcctaccgaagacgaaccgaaccgaccgaagaaaccactaacgttagtaactcgtagacaaagtcggacgtacgtaacgacctaacggaaccggacccggtaacgaacccgaccgggttacgttagggtttaccgttaacgtttaccgtacggttacggaacccgggtaaacggggaccggggggaaccctaagggtacccgttaaaccgttttaacccccgttacccgtttaaaccccgttaacccggttccccggtaccgtttaaacgggttacccggggttacccgggtttaaccgggggttacccgggggtaaccccggtaaaaccggggggttaccccggttaaaccccggggg

SEQ ID NO: 203669 - DNA, 975 bp, Homo sapiens
  misc_feature: GYAE6OF01AMG5V.24.85.H08.1.454.CMB.1.raw
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcgaggggtccctgagactctcctgtgcagcctctggacttcgccttacaacttaacttcgtaggatcgcctacgtcggggtcccgaccaagtccgtaccgaaggggggtaacggggtcctaggtacgtttttcgggggttcctaccgtaaacggtttaacttttaaacgtacgtttttagggaaggtttaggggggtaaacgtttacggtcccttaaccctaaccgtaaccgttaagttccggggacccgggttaacccttcccggggttaaggggaaaaccggggggtcccctaacgttttaccccgaacccttaacgttccccgtacccgaaaggaaccggaaaaccccgaaacccggaccccgaaacggaaaacccaaccgtaacgtttacggtaacttaccggtacggtaacctaaaaggttcggaaccgaccgtaaccggtacccgttaaacgggaaaacccggtaccccgggaaaccggaaccccggtaccggggttaccgtttacgggtttaacggttttaaaccgtttttaacccgttgggttaacgggtaacccgggtaaaacgggggggtacccggggggtaccctaacgggttaaaccctttaaacccgttttaaccccgtttaccccctttaaaccggttacccccggttacccggtaacgttttaacccgggttccgggggttaaaccccgggttccgggggttaaccccggggggaaccccggggttaaaacccgggggggtcccccggttaaaccccgggggg

SEQ ID NO: 203670 - DNA, 712 bp, Homo sapiens
  misc_feature: GYAE6OF01CQ2W8.24.85.H08.1.454.CMB.1.raw
  modified_base (489)..(489): a, c, t, g, unknown or other
  misc_feature (489)..(489): n is a, c, g, or t
  modified_base (581)..(581): a, c, t, g, unknown or other
  misc_feature (581)..(581): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccagtaccagttgaacttgacctcagggtcttcgtggctcacgtccaccacacgcatgtcgacctcaggggtccctggacgactctcctgtgcagcctcgtggacttccgacctttacaaacttaactttcgtagggattcgaccgtacggttcggggtacccaccgaaaggtccgtacccggaaggggggtaacgggtctaggtagttttcgggggtccttacgtaccggtttaattaaccgtattaggagtggggacgttaacgcttaccgaactaacgtagtcggtaccggtactccggtagggaacgggtcctattccgacctactcctacgagtacgaaccgaacgaccaaanaacccgactacgtgtactcgagtaacaaatcgagtaccaagtccctaaacgaacccgacgaacgtacggtcttagttacgtaacgtttacgnggttacgaacggtaaggggcgggtaccctaaggtacctacgtttccctaaccgttaccgtccgttaccgagttacggtccgggacgttccggggtacggggacccgaaacggggtaccggtcggggtaccc

SEQ ID NO: 203671 - DNA, 671 bp, Homo sapiens
  misc_feature: GYAE6OF01DUO1V.24.85.H08.1.454.CMB.1.raw
  modified_base (256)..(256): a, c, t, g, unknown or other
  misc_feature (256)..(256): n is a, c, g, or t
  modified_base (366)..(366): a, c, t, g, unknown or other
  misc_feature (366)..(366): n is a, c, g, or t
  modified_base (437)..(437): a, c, t, g, unknown or other
  misc_feature (437)..(437): n is a, c, g, or t
  modified_base (494)..(494): a, c, t, g, unknown or other
  misc_feature (494)..(494): n is a, c, g, or t
tcagactactatgtcacgaccggtgctcgatttagtatcactcagtcgcgggggagccccagccctgggattcccagctgtttctgcttgctgatcaggactgcacacagagaactcaccatggagtttgggctgagctgggttttccttgttgcttattttaaaaggtgtcagtgtgaggtgcagcgtggtggaggtccgggggaggcgttagttcgagccgtgggggtccctgagactctcctgtgcacgcctntggattccgccttacaattaacttcgtaggatgccacgtcggtcccgacaagcctaccggaaggggaacggggcttggtagttttggggtctactaacgttaattaacgngtttagagtgggagtacgctacactacctatcggacggtactccggaggaacgggcctattaccaaccgtntcctacgaggaacgaaccgaaccgacccgaaagaaaaccactactacgttaactcgngaaccgaagtggacgccaacgccctaaggaaaccgccggaaccgacggtaccgacgtttagtaacgttacgttacgtaggtcgggaaccggaacggggaacgggggtcccaaggtacccttaacgtttccccgttaacccttaacgttaccctacccggtcgttaggtacccggggg

SEQ ID NO: 203672 - DNA, 840 bp, Homo sapiens
  misc_feature: GYAE6OF01CPWR7.24.85.H08.1.454.CMB.1.raw
  modified_base (417)..(417): a, c, t, g, unknown or other
  misc_feature (417)..(417): n is a, c, g, or t
tcagactactatgtcacgaccggtgctcgatttagtatcactcagtcgcgggaggacgctgaccacacggtacgtgctgttgtactgctcctcccgcgctttgtcttggcattatgccacctccacgccgtccacgtaccagttgaacttgacctcgagggtcctcgtgctcacgtccaccaccacgcatcgtgacctcgacggggtccctgacgaccttcctccgtggtcgacctacggtcccttcgtacggtactttccggtaccctttaacaaaactttaaccgtttcggtagggaacttcggacctaccggttccggggtaccccgaaccgaaacggtcccgtacccgggaagggggaacgggttcctaggttaacggtttcgggtaccttacgtaacgtttaatttaaacgngttagtaagtgggaagttacgaccttacgaacctacgtagtcggaccggtaccgttccggtacggaacgggtacctaacttaccccgaactacgttaccgaccgaaggaaccgaaacccgaaccgaacccgaaacgaaacctaaccgtaccgttaggtaacttccgtaagaacctaaagtcgaaccgaacctaaccggtacgtaaacgaacccgggcccgaagtaacccgtacgggtacctttagggtacgttttaaacgccggttaggtaccgggaacgaacgggggacccgggtactaaacgtaccccgttaagttaccccctcccggttaacttacccgggtcctacgggttaacgttacggggacccggtttacggggaacccgggtaaccccgtaaacgggggcccgttaacccgggg

SEQ ID NO: 203673 - DNA, 591 bp, Homo sapiens
  misc_feature: GYAE6OF01D349H.24.85.H08.1.454.CMB.1.raw
  modified_base (272)..(272): a, c, t, g, unknown or other
  misc_feature (272)..(272): n is a, c, g, or t
  modified_base (341)..(341): a, c, t, g, unknown or other
  misc_feature (341)..(341): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcgaggggtccctgagactctcctgtgcagcctctggacttcgccttcaataacttctggatgcacgtcgggtccnccaagctaccgagggagggctgtatttgggctcacgttattaacattgataggagtagctacacactangcggactccggtaggaacggccgtatccacatcctaccgagacgaacaacgaccaagaaaccacactagtactctagacaaatgagcagcctagaaaccgccgaacgaccgacggcgttagtagttacttacgtggtacgaacgaaggggacggggaccaagcctaacgtttaccctacccttaacgtaaccctcccgacgttaagtcgggaccggttcggacggggacccgaaggggcccgtaccgggg

SEQ ID NO: 203674 - DNA, 624 bp, Homo sapiens
  misc_feature: GYAE6OF01CNXY4.24.85.H08.1.454.CMB.1.raw
  modified_base (255)..(255): a, c, t, g, unknown or other
  misc_feature (255)..(255): n is a, c, g, or t
  modified_base (384)..(384): a, c, t, g, unknown or other
  misc_feature (384)..(384): n is a, c, g, or t
  modified_base (436)..(436): a, c, t, g, unknown or other
  misc_feature (436)..(436): n is a, c, g, or t
  modified_base (439)..(439): a, c, t, g, unknown or other
  misc_feature (439)..(439): n is a, c, g, or t
  modified_base (481)..(481): a, c, t, g, unknown or other
  misc_feature (481)..(481): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtcgacctcgaggggtccctgagacctctcctgtgcagcctctggacttcgcttcaaatacttcnggatgcacgtgggtccgacaagctacgaggggagggctgtagtttgggctacgacgtaattacatttggagtcgggatgctacacgtactagtcggacgtactcgtagggacggccgtattccaacctntccgtacaagacgaacaacgaccaagaaacactactgtactcagaactaagngancagcaagaacggccgacgacgcggtgtagttagtacttacgnggtacgaacgaacggggacggggacccaagtacccgtatttaaccccgtacccgttacctacccgttcccgacgtttaaccggcgggtacccgttacggggacccgggggaaacctaaaccgggggtaccccgtaaccggggg

SEQ ID NO: 203675 - DNA, 631 bp, Homo sapiens
  misc_feature: GYAE6OF01B18E3.24.85.H08.1.454.CMB.1.raw
  modified_base (267)..(267): a, c, t, g, unknown or other
  misc_feature (267)..(267): n is a, c, g, or t
  modified_base (488)..(488): a, c, t, g, unknown or other
  misc_feature (488)..(488): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggattcgccttcaatacttctggatgcacgtggtccncaagctccgagggaacgggctgagtttgggtctctacgtattaacattgagtgggagtagctcactactagtcgcggtactccggtaggaacgggcctacgttaccacctactttccgaagtaacgaaccgaacgaccaacgaaacctacaacttagtaactacgtagaacgaaatacgacgacaacgccctaagaaaccgtccggaacgacgaaccggtntagtacgttaagttacgtggtacgtaacggaacgggacgggtaccagtacctacgttaaccctaccgttacctaccgtccgtacgttacgtccgggtacgtcggtacggggaacccgacgggtaacccggtcgggtaaccccg

SEQ ID NO: 203676 - DNA, 699 bp, Homo sapiens
  misc_feature: GYAE6OF01CRAC2.24.85.H08.1.454.CMB.1.raw
  modified_base (346)..(346): a, c, t, g, unknown or other
  misc_feature (346)..(346): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggttcttcgtggctcacgtccaccaccacgcatgtgacctcgaggggtccctgagactctctgtgcacgcctgtggattccgccttacaaattacttcgtggattcgcacgtcgggtcccgccaagccgtaccgagggggaacgggcttaggtagttttcggggtctacgtacggttaactttaacgntttaggagtgggtaagttacggctaccaactacgtagtcggccggtaccgtccggtaggaacgggccgtacttccaacctactacctacgaaggaacgaaccaaccggaccgaacgaaaacctacgtaaccgtagttaagtacctacgaactaaaacgtggacgtacgacgtaccgtaagaaaccggccgaaccgacacgggtcttacgtagttaagttacgtggtacgacgtaacgggaacgggggcctaggacccgtaacttaccgttacccgtaacgttacccgttccggacgttacgtaccggtacgggttccgggacgggaaccgggaacggtacccggtaaccgggg

SEQ ID NO: 203677 - DNA, 553 bp, Homo sapiens
  misc_feature: GYAE6OF01DXUNR.24.85.H08.1.454.CMB.1.raw
  modified_base (242)..(242): a, c, t, g, unknown or other
  misc_feature (242)..(242): n is a, c, g, or t
  modified_base (268)..(268): a, c, t, g, unknown or other
  misc_feature (268)..(268): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggattcgccttnaatacttctggatgcactgggtcccncaagctccgagggagggctgatttgggctcagtatacattgatgggatagctcacactatgcggactccggtagaaggcccattccaccatcctaccagagacaacgcaagaacacactgtatctgacaaatgagcaagcctagaacgccgacgaccgacggctggtactagttacgtgtgacgaagggcggggacagcctaagttacctcccgttaacttacgtcccggtactagttacgggtaccgttacggtaggggacccgtaacggggaccgtacggggg

SEQ ID NO: 203678 - DNA, 557 bp, Homo sapiens
  misc_feature: GYAE6OF01AL4P6.24.85.H08.1.454.CMB.1.raw
  modified_base (511)..(511): a, c, t, g, unknown or other
  misc_feature (511)..(511): n is a, c, g, or t
tcagactactatgtcacgaccggtgctcgatttagtatcactcagtcgcgggggagccccagccctgggattcccagctgtttctgcttgctgatcaggactgcacacagagaactcaccatggagtttgggctgagctgggttttccttgttgctattttaaaaggtgtccagtgtgaggtgcagctggtggagtccgggggaggcttagttcagcctggggggtccctgagactctcctgtgcagcctctggattccgccttcaataacttctggatgctactcggggtccgccaagcctccgaggggaacggggctggtagttttgggtcctcgacgtattaacattggatgggagtacgctcacactatgcggactccggtagaacgggccattcaccatcctcagacgacaacgccaagaacacacgtgtatcctgacaaagtcgagtccagccgtaagaaacgccgaacgacacggctgtacgtattacgtgtagacgtaagggngggacaggacctaattacccgtcctacttaccgtccgatgtccggg

SEQ ID NO: 203679 - DNA, 804 bp, Homo sapiens
  misc_feature: GYAE6OF01CAW35.24.85.H08.1.454.CMB.1.raw
tcagactactatgtcacgaccggtgctcgatttagtatcactcagtcgcggggaggacgctgaccacacggtacgtgctgttgtactgctcctcccgcggctttgtcttggcattatgcacctccacgccgtccacgtaccagttgaacttgacctcagggttcttcgtggctcacgtccaccacacgcatgtgacctcgacggggtccctgagtaccttcctccgtgtcgcacggtccttcgtggacttccgcctttacaaacgttacctttcgtaggtacttcggaccaccggttcggggtacccaccaaggtccgtaccggaaggggggaaggggtccttaggtacgttttcggggtcctaccggtaacgttaacttaaaccgtaggttggaaggtgggtaatacgccttaacactacgttacgtcggaccgtaccgtacggacgggtaaccggcttacgtaccaaccgtcgttacccgacgaacgtaaccacccggaaacctaccgaaacggaaactacccgtaactttacggtaaccgtttacgaaacgtaaacctaaaggtccgacgaccgtaacgttacccgaaaggtaaccccgacggaaacgtaccggtacggtactttaggtacgtttaaacgttggaaccgttacggaacggggtaacgggtacccggggataaccggttacgttaaccttaaacccggtcccttaaaccggcccgttaccgggtcttaacgggttcccggttaacgggttcccgggtaaccggaaaccgggtaaacccgggtacggtacccg

SEQ ID NO: 203680 - DNA, 554 bp, Homo sapiens
  misc_feature: GYAE6OF01AQUCB.24.85.H08.1.454.CMB.1.raw
  modified_base (319)..(319): a, c, t, g, unknown or other
  misc_feature (319)..(319): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggattcgccttcaataacttctggatgcacgtgggtcccgccaagcctccgaggggaaggggctgtagtttgggtctcacgtattaacnttgatgggagtagctcacactatgcgactccggtggaacgggccgattccacctatcctcaagagaaccaacgaccaagaaaccactacgtatactctagacaaatgagacagacctagaacgccgaacgacgacggctgtagttacttacgtgtacgacgaagggcggggccagtcacgttacctcctactctccgatagcgggtactcggacgggaccgaagggccgtacggg

SEQ ID NO: 203681 - DNA, 694 bp, Homo sapiens
  misc_feature: GYAE6OF01AQJUD.24.85.H08.1.454.CMB.1.raw
  modified_base (269)..(269): a, c, t, g, unknown or other
  misc_feature (269)..(269): n is a, c, g, or t
  modified_base (307)..(307): a, c, t, g, unknown or other
  misc_feature (307)..(307): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcgaggggtccctgagactctcctgtgcagcctctggacttcgccttcaatacttctggatgcacgtggtccncaagctcgagggagggctgtattgggctcagtattacnttgagtgggatagctacacacgtatcggacgactccggtaggaacggcctattccaaccgtactccgtaccgaagtaacgaaccaaccggaccaacgaaaccactacgttacgtactacgtacgaactaaagtcgaacgtacaacggtcccgtaaggaaaccggcccgtaacggaaccgtaccgggtactttaggttacggtttaacgtttacgtacggtacggtaaccggaaacggggtaccgggggacctaaggtacccgttaacgtttacccgttacccttaaccggttacccgttaccccggtacgttaaccgggttacgggtaacccgggtttccggaccggggggtaccccgtaaaacgggggtccccggttaaccggggg

SEQ ID NO: 203682 - DNA, 676 bp, Homo sapiens
  misc_feature: GYAE6OF01BJ4GY.24.85.H08.1.454.CMB.1.raw
  modified_base (464)..(464): a, c, t, g, unknown or other
  misc_feature (464)..(464): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctgaggtcttcgtggctcacgtccaccaccacgcatgtcgacctcgaggggtccctggacgactctcctgtgcacgcctcgtggtacttccgccttactaattaaccttcgtaggaattcgactacgttcgggtacccaccaaaggcctaccggaaggggaacggggtctaggtagtttcggtactacgtaacgttattaactagttagagttgggatagcctacgaactacgtatcggacggtactacgtaggaacggcctattaccaccgtatacctaccgaggaacacgtaaccgaccaaacgaaccnctacgttacgtacgtactaacgaacgtaaacgtgtaacgccgtaacgccgtaaacggaacgtacccgaacggacccgtaagggtcttacgtacggttactagttgacgtaccgaagggtcccgggacaacgtcttaacctacgttcctaagtaccgtcccgtagtaacggtcgtccggtacgggaccgggtaaccaacggggtccggtaccg

SEQ ID NO: 203683 - DNA, 854 bp, Homo sapiens
  misc_feature: GYAE6OF01BIDTK.24.85.H08.1.454.CMB.1.raw
tcagactactatgtcacgaccggtgctcgatttagtatcactcagtcgcgggaggacgctgaccacacggtacgtgctgttgtactgctcctcccgcggtctttgtcttggcattatgcacctccacgccgtccacgtaccagttgaacttgacctgagggtcttcgtggctcacgtccaccaccacgcatgtcgacctcgacggggtccctgacgactctcctgtgcagcctcgtggtacttccgtaccttacaaagttaacttcgtggactcgaccgtacggtcgggtacccaccgaagtccgtaccggaagggggtaacggggtctaggttacggttttcgggtaccttaccgtaacggtttaacttaacgtagtttaggaaggttaggggtacgttaacgtccttaccgaaacgtaacgttacggtaccggtacccgggtaaccgtttccggtaaacggggtaaccgggtacccgtaactttaccccgaaccctacgttaccccgtaccgaaacggtaaccgaaaccgaacccgaacccgaaacggaaacctaccgtaaccgttacgttactacgtaacgtaaccgtaaagtcggaacgaccgtaaccggtaccgtaaaggaacccgaccggaaccgaccgtacggttacgtacggttagttaacgttacgtacgggacgtaaccgggaagggccggggtaacctaacgggttaccttaaacccgggttacccttacccggttaaacccgttacccggttacccgtaacggttacccgggttacgggtacccgggtaccgggggtaacccggggaaacccgggtaaaccggggtacccggtaacccgggg

SEQ ID NO: 203684 - DNA, 896 bp, Homo sapiens
  misc_feature: GYAE6OF01ACRC6.24.85.H08.1.454.CMB.1.raw
  modified_base (215)..(215): a, c, t, g, unknown or other
  misc_feature (215)..(215): n is a, c, g, or t
  modified_base (248)..(248): a, c, t, g, unknown or other
  misc_feature (248)..(248): n is a, c, g, or t
tcagactactatgtcacgaccggtgctcgatttagtatcactcagtcgcggaggacgctgaccacacggtacgtgctgttgtactgctctcccgcgctttgtcttggcattatgcacctccacgccgtcacgtaccagttgaacttgacctcagggtcttcgtgctcacgtccacaccacgcaatgtgaacccttcgagggtccctgagacttcnccgtgtgccagtcctctggtacttccgcctttnaaacttacttcctgggtaacttgcccgtaacgttcgggggtaccccacgtaacggtccgttacccggaaaggggtaaacggggtccttaggtaaccggtttttgggggacccttccgtaaacgggtttacctttaaaccaggtttttacgaaccgggttttgggaacccgtagggtacctttacccgaactttaccgtaaacggtttgggaaccccgggtaaccgttcccggttaacggaaaaccgggggtccctttaaaaggttccccctaacccggtaaaggtttccccgtaaacccgtaggaaacccgtttaacaacccccggtaaccgtacgtaaaaaccgtccgtaaacgttcggttaaaccttacgaacgtttaaccgaaaagttcccggaagttacccgaaacccgtcgttaaccgaaaaccggtccccggtaataccgggaacccgttgttaaacgtcggtttaactttacggtacgttacgggaaccctaagggggaccgggtaccctacggttaaaccgttcccttaaacggttccccttaacggtaaaccttcccccgggtattaaacggttaccgggttacccctagggtttaaccccggggaacccgtaaacgggggtttaccccgaacccgggg

SEQ ID NO: 203685 - DNA, 656 bp, Homo sapiens
  misc_feature: GYAE6OF01DOTI2.24.85.H08.1.454.CMB.1.raw
tcagactactatgtcacgaccggtgctcgatttagtatcactcagtcgcgggaggacgctgaccacacggtacgtgctgttgtactgctcctcccgcggctttgtcttggcattattccacctccacgccgtccacgtaccagttgaacttgacctcgagggtcttcgtggctcacgtccaccaccacgcatgtgacctcgaggggtccctgacgactctcctgtgcagcctcgtggattccgccttacaattaacttctggattgcacgtcggggtccgccaagcctacggaggggaagggctgtagtttgggtctacgagtattaacagttgagtgggagtacgctacacgtactagtggccgactccggaggaacgggccgtaattaccaaccgtatcccgtacagaacaactaaccgaaccaagaaacacctacgtagttactccgagaacaaagtggacgacgacgtacgtacgaaacgtccccgaacggacgacggtcgtagtcgttaacgtacgtggtacggacggtaacgggaccggggctaacgcttaaccgttaaccctaccttaacccgttacgaccgtacgtaacggttaccggaccggtttcgggacgggacccggtaaaagggcccggtaacgggtaccccg

SEQ ID NO: 203686 - DNA, 600 bp, Homo sapiens
  misc_feature: GYAE6OF01ASIHN.24.85.H08.1.454.CMB.1.raw
  modified_base (300)..(300): a, c, t, g, unknown or other
  misc_feature (300)..(300): n is a, c, g, or t
  modified_base (369)..(369): a, c, t, g, unknown or other
  misc_feature (369)..(369): n is a, c, g, or t
  modified_base (516)..(516): a, c, t, g, unknown or other
  misc_feature (516)..(516): n is a, c, g, or t
tcagactactatgtcacgaccggtgctcgatttagtatcactcagtcgcgggggagccccagccctgggattcccagctgtttctgcttgctgatcaggactgcacacagagaactcaccatggagtttgggctgagctgggttttccttgttgctattttaaaaggtgtccagtgtgaggtgcagctggtggaggtccgggggaggcttagttcaggccgtggggggtccctggagactctcctgtgcagcctctggacttccgcccttacaattaacttctggatgcacgtgggtccnccaagcctcgaggggagggctgtagtttggtctcgtagtattaacattgagtggagtagctcacactancggcggactccgtaggacgggcctattccactactctaccagacgaccaacgaccaaacgaaccacactgtaactctagactaaagtgaagtccagacctaaggaaaccgcccggaaccgacgaacggtctaggtacgtattaccgnggtacggacggaacggggacggggaccacggtacctacgtttaaccctcccgttaactaccgtcccgtgttaacggtaccgggg

SEQ ID NO: 203687 - DNA, 763 bp, Homo sapiens
  misc_feature: GYAE6OF01C8O8A.24.85.H08.1.454.CMB.1.raw
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggttcttcgtggctcacgtccaccaccacgcatgtgacctcgacggggtccctgacgactctcctgtgccacgcctcgtaggtcttcgtccctttacaaacttaactttcgtaggtatcgacctaccggtcgggtacccgaccgaaggtccgtaccggaagggggtaacggggtccttagggttacggttttcgggggtaccttaccgtaaccggtttaatttaaacctggttttaggtaaggttagggggtaacgttaaccggccttacgaaccgttaacgtaagttcggacccgggtaaccgttacccgggtaggaaccgggggtccctattacccacgtaactccgtaccgaagaaccggaacaacccgaccgtaacgaaacctaacgtaccttaggtaacctacgtacgaacgtaaacgtacgaacgacgaacgtacccgtaggaaaccgaccggaacgaccgaggtccgttaggttacttaacgtacgttggtaacgacggtaagggcgggtaccagaccgttacttaccgtacctaccgtaccctacggtcttacggacggtacggtaccgggacggggacgaaccggcggtaaccggg

SEQ ID NO: 203688 - DNA, 706 bp, Homo sapiens
  misc_feature: GYAE6OF01D1Y59.24.85.H08.1.454.CMB.1.raw
tcagactactatgtcacgaccggtgctcgatttagtatcactcagtcgcgggaggacgctgaccacacggtacgtgctgttgtactgctcctccgcggctttgtcttggcattatgcacctccacgccgtccacgtaccagttgaacttgacctcagggtcttcgtggctcacgtccaccaccacgcatgtgacctcgacggggtccctgagactctcctgtgcagcctctggacttccgccttacaaattaacctttcgtggacttcgacctacggtcggggtcccgaccaaacggtcctaccggaagggggaacggggtctggttaggttttcgggtcctacgtaacggttaattaacgagtttggagttgggaagttacgctcaactactagtcggccggtaaccttccggtaggaaacggggtcctaacttccacctacttccgacgaagacgaaccgaaccgccaaacgaaaccacgtacgttgtaactcctagaactaaagtcggagacgaacgaccgtaggaaaccggcccgaacgaccgtacggtcgttagtagttacgttactggtacgacggaacggggaccggggtccaacggtccttaaaccgttaccctacccgttaaccttaccggtcccgaacttggacccggttacgggtaccggttccggggaaacccgaacggggtacccggtccggg

SEQ ID NO: 203689 - DNA, 515 bp, Homo sapiens
  misc_feature: GYAE6OF01A5JB0.24.85.H08.1.454.CMB.1.raw
  modified_base (267)..(267): a, c, t, g, unknown or other
  misc_feature (267)..(267): n is a, c, g, or t
  modified_base (383)..(383): a, c, t, g, unknown or other
  misc_feature (383)..(383): n is a, c, g, or t
  modified_base (441)..(441): a, c, t, g, unknown or other
  misc_feature (441)..(441): n is a, c, g, or t
  modified_base (481)..(481): a, c, t, g, unknown or other
  misc_feature (481)..(481): n is a, c, g, or t
  modified_base (494)..(494): a, c, t, g, unknown or other
  misc_feature (494)..(494): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggattcgccttcaatacttctggatgcactgggtccnccaagctccagggagggctgatttgggtctcacgtattacattgatgggactagctacacacgtatgcggactccgtgaacgggccattcacatcgccagagacacgccagaacanactgtatctgcaaatgagccagccctgaaacgccgacgacacggtctagtgtattacngttgcaaggcggggccagcattacctcctactactcccgntagtggacttcgnggggccaaggggtccacgggg

SEQ ID NO: 203690 - DNA, 840 bp, Homo sapiens
  misc_feature: GYAE6OF01BVWPT.24.85.H08.1.454.CMB.1.raw
tcagactactatgtcacgaccggtgctcgatttagtatcactcagtcgcgggggagccccagccctgggattcccagctgtttctgcttgctgatcaggactgcacacagagaactcaccatgggagtttgggctgagcttgggttttccttgttgcttattttaaaaggtgtccagtgtgaggtgcagctggtggaggtccggggaggtcttaggttcagccgtgggggtccctgacgactctcctgtcgcacgcctcgtggtacttccgccctttactaaacttaaccgttcgtggatcggactaccgtcggggtccccgaccaacggtccgtaccgggaagggggaacggggtcgttgggttaacggttttcggggttacctaccggtaaacgtttaagtttaaaccgtagtttacggaaggttaggggaacgttacggtaccttaaccgaaccgtacgttaacgtccgggtaccggtacccgttaccgggtaacgggaacggggtacccgttaacgttacccaacccgtacgttacccgtaccgaacggtaacgaaacccgaaacccgacccgaaaacgtaaaccaaccgtaaccgtacgttaacctacgttaacgaaccgtaaagtacggaacgtaccgtaacgtacccggaaaccgtaaaccggaccccgtaaccggtaaccgtaccgggtaccttaggttaacgttaacgttaccgttacggtaacggaaccggtaaacggggaacgggggtacctaaacggtaccggttaacctttaccccgttaccttaaacccgttacccggttacccgtacgttacgggttaacccggg

SEQ ID NO: 203691 - DNA, 673 bp, Homo sapiens
  misc_feature: GYAE6OF01A50DT.24.85.H08.1.454.CMB.1.raw
  modified_base (252)..(252): a, c, t, g, unknown or other
  misc_feature (252)..(252): n is a, c, g, or t
  modified_base (413)..(413): a, c, t, g, unknown or other
  misc_feature (413)..(413): n is a, c, g, or t
  modified_base (554)..(554): a, c, t, g, unknown or other
  misc_feature (554)..(554): n is a, c, g, or t
  modified_base (607)..(607): a, c, t, g, unknown or other
  misc_feature (607)..(607): n is a, c, g, or t
  modified_base (618)..(618): a, c, t, g, unknown or other
  misc_feature (618)..(618): n is a, c, g, or t
tcagactactatgtcacgaccggtgctcgatttagtatcactcagtcgcgggaggacgctgaccacacggtacgtgctgttgtactgctcctcccgcggtctttgtcttggcattatgcacctccacgccgtccacgtaccagttgaacttgacctcgagggtcttcgtgctcacgtccaccaccacgcatgtcgacctcgacggggtccctgacgactctcctgtcgcagcctcgtggacttccgccttanaatacttctggatcgctacgtcgggtcccacaagcctacggaggggagggctaggtacgtttcgggtctacgtacgttaacttaacagtttggagtgggacgtagcctacaactagtagtcggacgtacctcgggtaggaacgggtcctacttaccgaacncgttaccaccgaagaacgaacccgaaccgaaccaagtaaaccactagttacgtaactacacggaactaaagtcggaactaccgacgtaccgtaaaggaacccggccgacgaaaccggcgtcttaggtttactagttaccgnggtaacggacgacgggaacgggctaagtaccgttaacttaccgtacccttacncccggtttacncggtttacgacggtcggttaccggaacggggacccggtaacggtaccggtcccgg

SEQ ID NO: 203692 - DNA, 905 bp, Homo sapiens
  misc_feature: GYAE6OF01CS1BB.24.85.H08.1.454.CMB.1.raw
tcagactactatgtcacgaccggtgctcgatttagtatcactcagtcgcgggaggacgctgaccacacggtacgtgctgttgtactgctcctcccgcgctttgtcttggcattatgcacctccacgccgtccacgtaccagttgaacttgacctcgagggtcttcgtggctcacgtccaccaccacgcatgtcgacctcgaggggtccctgacgactctcctgtcgcacgcctcgtggtactttccgccctttacaaacttaccttcgtgggtacttcgaccgtacggtcggggtaccccgaccgaacggtccgtaccggaaggggggaaacgggggtccttgggtaaggtttttcgggggaccttaccgtaacgtttaaacttaaacgtagtttaggaggttaggggtaatacggtacttaccgaacctaacgttacggtacggacggtacccgttccggggtaagggaaaccggggtacccttaacgtttaacccaccgtaacgttacccgtaaccgaaggaaccgaaacccgaaacccggaccgaaaacgaaaccctaccgtaacttacggtaactaccggtacgtaaacgtaaaggtacgaacgtaccgtaccggtacccgaaacggaacccggacccgggaacccgaaccgggtaccgggttaacgttacggtttaacggttttaaacttaccgggttacggttacgggaaccggggaacggggtaacccggggggcctaaaccgggttaacctttaacccggttttaaacccttcccccggtttaaacgttaccccggttaccccggttaacggttaccgggttacggggtacccgggtttacccgggtacgggggaaaccccgggtaaacccgggggtaccccggttaaccccggggg

SEQ ID NO: 203693 - DNA, 951 bp, Homo sapiens
  misc_feature: GYAE6OF01DU06L.24.85.H08.1.454.CMB.1.raw
  modified_base (933)..(933): a, c, t, g, unknown or other
  misc_feature (933)..(933): n is a, c, g, or t
tcagactactatgtcacgaccggtgctcgatttagtatcactcagtcgcgggggagccccagccctgggattcccagctgtttctgcttgctgatcaggactgcacacagagaactcaccatggagtttgggctgagcttgggttttccttgttgtcttaattttaaaaggtgtccagtgtgaggtgcagcgtgggtgggagggtccgggggaggtcgttagttcgacggccggtcggggggtccctggacgaccttccttccgtgtcgccacgccgttcgtgggtactttcccggttccctttaacctaaacgtttaaccgtttcgttaggtaacgttcgtacccgtacggttccggggtaccccgacccgtaaacggtccgtaacccgggaaggggggtaacggggtcgttacggttaacggtttttcggggttaccttaccgttaaacggtttaaactttaaaccgtaagtttggtaagggtagggtaacggttacgtacccgttaccaaccgtacttacggtacggaccgggtaaccgttacccgggacgggaacggggtacccgtaacttacccgaacctaccgttaccctaacccggaaaggaaccgaaacccgaaaccggaaccccgaaaacgtaaaacccgtaaccgttaaccgttacggttaacctttaccgtacgtaaaccggtaaaacgttcggaaaccgtaccgaacggtaaccccggtaaagggaaaccccggtaaccccggggaaaccgtaaaccccgggtaaccgggtttccggtttaacggggttaaacgttttacccgtttaaccgggttacgggttaccggaaacccgggtaaacggggggaccgggggtaaccctaacggtacccttaaacgttttaccccctacccgtttaacccttaccgttacccccggtnttaaccgggttaccgggg

SEQ ID NO: 203694 - DNA, 784 bp, Homo sapiens
  misc_feature: GYAE6OF01ENWNX.24.85.H08.1.454.CMB.1.raw
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggattccgccttacaaattaacttctggatcgcacgtcgggtccgaccaagcctaccgaggggaaggggctaggtagttttggggtcctccgtaacggttaattaactagtttaggagtggggtaagtacgcttacaactactagtcggaccggtacgttccgggtaggaacggggcccgtaatttacccgaacctagttcccgtaccgaaggaacgaaaccaaaccggaccctaaacggaaaaccctaaccgtaaccgtttaggttaacttcccgtagtaacctaaaacgttcggaacgtccgaacggtacccgtaaggaaaccggtccccggaaacgaacccgaccggggtactttacgggttacggtttaaacgttttacgttacgggttaacggaaccgggtaaacgggggtaccggggggaaccctagggtaacccttaacgtttaacccgtccccttaaccgttaacccggtcccgtacgttacggttacgggtaacccggtcggggtacccggggaacccgtaaaccggggtcccgtaacccggggg

SEQ ID NO: 203695 - DNA, 856 bp, Homo sapiens
  misc_feature: GYAE6OF01E2ZTX.24.85.H08.1.454.CMB.1.raw
tcagactactatgtcacgaccggtgctcgatttagtatcactcagtcgcgggaggacgctgaccacacggtacgtgctgttgtactgctcctcccgcggtctttgtcttggcattatgcacctccacgccgtccacgtaccagttgaacttgacctcgagggtcttcgtgctcacgtcccaccaccacgcatgtcgacctcgacggggtccctgacgtacctcctccgtgtcgccacgtcccttcgtacggtactttcccgaccctttacaaactttaacctttcgtaggatcggacctaccggttcgggggtaccccacccgaaacggtcccgttaccggggaagggggggtaacggggtccttagggtttacgggtttttccgggggtaccctttaaccgttaaaccggttttaaactttaaaaccgttaggttttaggggaaggtttacgggggtaacgttacccgtaccttaacgtaaccgttaacgttacggtcggggaaccccgggttaccgttccgggggtaaggggaaccgggtcccttaaacgttaccccgaacccgttagttaccccgtaacccgaaaggtaacccgaaacccgtaaacccgaccgtaaaccgaaactacctacgttagtactcgaagtaacaagtcgacgacgaccgtaccgtaaacggaaccgacccggtaaccgacgacggtcttaggttacgtacttcggtaggcgaacgggaagggccgggacctacggtactttacccgttaccgtcccgtaagttccccgtaccggttatacgggtaccgggtaccggttcccggggaaccgggacccggtaacggggacccgtccggg

SEQ ID NO: 203696 - DNA, 723 bp, Homo sapiens
  misc_feature: GYAE6OF01BEJXV.24.85.H08.1.454.CMB.1.raw
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggattccgccttcaataacttctggatgcacgtgggtccgccaagcctaccgaggggaacggggctggtagtttgggtctcgacgttattaacattgagtgggagtacgctcactactatcggacggtactccggtaggaaacggggcccgtatttccaaccgtacttaccgtacccgaaggaacggaaccaaaccggacccaaaggaaaccaccaacgttgtaactaccgtaggaactaaaagtggaacgtaccgacgtacccgtaacggaaaccggccccggaacgaacccgaccggaccgttaggttacgttaacgtttacggtacggttacggaacggtaacggggaaccgggggccaacgggtaccctaaacgtttaaccccgttacccttaaccgttaccccgtcccgtaccgttaacggttccggggtaaccggttaccgggtaaccggggggaacccgtaaacggggggtacccgtaaccggggg

SEQ ID NO: 203697 - DNA, 688 bp, Homo sapiens
  misc_feature: GYAE6OF01C9UWQ.24.85.H08.1.454.CMB.1.raw
  modified_base (289)..(289): a, c, t, g, unknown or other
  misc_feature (289)..(289): n is a, c, g, or t
  modified_base (543)..(543): a, c, t, g, unknown or other
  misc_feature (543)..(543): n is a, c, g, or t
tcagactactatgtcacgaccggtgctcgatttagtatcactcagtcgcgggggagccccagccctgggattcccagctgtttctgcttgctgatcaggactgcacacagagaactcaccatgggagtttgggctgagcttgggttttccttgttgacttaattttaaaaggtgtccagtgtgaggtgcagctggtcggaggtccgggggagcttagttcgagtccgtgggggtccctgagcctcgtcctgtgcagcctcgtaggcttcgtccttactaatactttcgnggtatcgctacgtcgggtccaccaacgtccgaccggaaggggtacgggcttaggtagttttcgggtacctacgtaacgtttaataacgtgttaggtagtagggagttacgtcctactacgacttaggcggttaccggaccgttccgggtaggaacgggtcccgtattcccgaaaccgttctaccgtacgaacgaacggaacccaacggacctaaacggaaaacctacctagtacttagacctaggaactaaggngacgacgacgacgtaacgaaccggaccgtaaccgacgtacggttactaggttactacgttaagtcggaaacggcgggaaacggggccggtacacgtaacgtttacctaacccgttcgtaaccctccggtctggtacggtaccggg

SEQ ID NO: 203698 - DNA, 600 bp, Homo sapiens
  misc_feature: GYAE6OF01A5VZV.24.85.H08.1.454.CMB.1.raw
  modified_base (229)..(229): a, c, t, g, unknown or other
  misc_feature (229)..(229): n is a, c, g, or t
  modified_base (241)..(241): a, c, t, g, unknown or other
  misc_feature (241)..(241): n is a, c, g, or t
  modified_base (267)..(267): a, c, t, g, unknown or other
  misc_feature (267)..(267): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgacttgacctcagggtcttcgtggctcacgtccaccaccacgcatgtgacctcaggggtccctgagactctcctgtgcagcctcnggattcgccttnaatacttctggatgcacgtgggtccncaagctccgaggggacgggctgatttgggctcacgtatacattgatgggatgctcactactagtgccggtactcccggtaggaacgggccctagttccacctatcctaccgaggactacgaacgaccaagaaaccacactacgtactctacgactaaatggacgtcacgccgtagaacgccggaacgaccgacgggtataggttacgtaacgttcgacgttaggaccgaagggaccgggggtacacggtactaacgttacccgtacgtacctacccgtccgtacgttacggtacggtaccgtcggtagggacccgaacgggtccgtaaccggg

SEQ ID NO: 203699 - DNA, 743 bp, Homo sapiens
  misc_feature: GYAE6OF01CKLGY.24.85.H08.1.454.CMB.1.raw
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggacttccgccttcaaatactttcgtggatgcacgtcgggtccgaccaagcctaccggaggggaaggggctggagtttggggtctacgacgttattaacagttgagtgggagtagctacactaacgtagtcggcgtactccggtaggaaacgggtccgtaattccgaacctacgttcctaccgaaggaaccggaaccctaaacccggacccgtaaacgaaaacctaaccgtaaccgtttacgtaacttacgtaacgtaactaaaagttcggacgaccgtaacggtacccgtaagggaaaaccgtcccggaaacgaaccggtaaccggtcgttaggttacgttaactttaccgttggtaacgacgggtaaggggaccggggtacctacgggtacctaaccgttttaacccgtcccttaacccttaccggtccccgttaacgttagggttacccgggtaaccgttacgggtaccgggggaaacccgggtaacgggggtaccccggttaaccgggg

SEQ ID NO: 203700 - DNA, 743 bp, Homo sapiens
  misc_feature: GYAE6OF01AOTRJ.24.85.H08.1.454.CMB.1.raw
  modified_base (597)..(597): a, c, t, g, unknown or other
  misc_feature (597)..(597): n is a, c, g, or t
  modified_base (605)..(605): a, c, t, g, unknown or other
  misc_feature (605)..(605): n is a, c, g, or t
  modified_base (632)..(632): a, c, t, g, unknown or other
  misc_feature (632)..(632): n is a, c, g, or t
tcagactactatgtcacgaccggtgctcgatttagtatcactcagtcgcggggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcgaggggtccctgacgactctcctgtgcagcctcgtggtacttccgtccttacaaattaaccttcgtggatcgacacgttcgggtcccgccaaggcctaccggaagggggaacggggtcttggtagttttcggggtcctaccgtaacggttaacttaaacgtagtttacggtaaggtgggggtaagtaacggtccttaccgaactacgttagtcggacccgggtaccgttacccgggtagggaaaccggggtcctaacgttccgaacctacgtccctaccggaagtaaccgaaccgaacccggacctaaacggaaaacctaaccgtacgttacgttacgtaccctagggtaactaaagtcgacgtacacgtacgaagaaccgtcgaacgtacgacggtntaaggttntaacgttgaggtacggaagaacggggngggccaggtactaccgtttaccgacccgttaccttaccgccggttagttaccggtacggtacccggttccgggaaacggggtcccgtaaacggggtacccggttaaccggg

SEQ ID NO: 203701 - DNA, 821 bp, Homo sapiens
  misc_feature: GYAE6OF01CLD99.24.85.H08.1.454.CMB.1.raw
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcgagggtcttcgtggctcacgtccaccaccacgcatgtgacctcgacggggtccctgacgactctcctgtcgcagcctgtggtacttccgccttacaaacttaccttcgtggatcgcacggttcgggtcccgaccaaggtccgtaccggaagggggtaacgggtcttaggttacggttttcggggtacctaccgtaacggttaacttaacgtagtttacggaggtgggtaagtacgtacctacaactacgtagtcggaccggtacgtacggtagggaacggtccgtacttaccaacctacttccgtaaccgaaggaaccgtaaccgaaaccggtaccgaaaacgtaaaccctaccgttaacgttagttaactacgtaacggaactaaaacggtcggaacgtaacccgaagtacccgtaaacgggaaacccggtacccggaaccggtaaccggtaaccgggttcgttacgggtttaacgtttaaccgttacggtacgggtaaccgggaaccgggtaacggggggtaacccggggtcctaacggttaccttaaacccggttttaccctaaaccccgttaccgttaccccgttccggtaaccggttaacggtccgggtacccggttcgggtaaccgggggaaacccgtaacggggtacccggtaccggg

SEQ ID NO: 203702 - DNA, 730 bp, Homo sapiens
  misc_feature: GYAE6OF01BU9ZI.24.85.H08.1.454.CMB.1.raw
  modified_base (516)..(516): a, c, t, g, unknown or other
  misc_feature (516)..(516): n is a, c, g, or t
  modified_base (589)..(589): a, c, t, g, unknown or other
  misc_feature (589)..(589): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcgaggggtccctgagacctctcctgtgcacgcctcgtggacttcgccttacaacttaacttcgtggatcgctacgtcgggtccaccaagctaccggaaggggaacgggtcttggtacgttttcggggtccttacgtaacgtttaattaaacgagtttaggagttacggggagttaacgccttacgaactacgttagtcggaccggtacctccggtaggaacgggtacctacgttaccaaccgtattcccgaccgaaaggaaccgtaaacccgaaccggaccaaacggaaaaccctaccgaacgttacgtactacgttanaaccgttaaaaagtcgaaccgacgtaaccgtaccgtaaaggaaacccggaacccgtaacggaaccgaccggtntacgttacgttaacgttcgtaggtacgaggtaagggaccgggacctagaccgtacttaccgtaccttaccgttacctccgtacgttaggtccggttaccggtcggtaaccggggacccgtaaacggggtacccgtaccggg

SEQ ID NO: 203703 - DNA, 647 bp, Homo sapiens
  misc_feature: GYAE6OF01EVQ26.24.85.H08.1.454.CMB.1.raw
  modified_base (262)..(262): a, c, t, g, unknown or other
  misc_feature (262)..(262): n is a, c, g, or t
  modified_base (513)..(513): a, c, t, g, unknown or other
  misc_feature (513)..(513): n is a, c, g, or t
  modified_base (551)..(551): a, c, t, g, unknown or other
  misc_feature (551)..(551): n is a, c, g, or t
tcagactactatgtcacgaccggtgctcgatttagtatcactcagtcgcgggggagccccagccctgggattcccagctgtttctgcttgctgatcaggactgcacacagagaactcaccatggtagtttgggctgagcttgggttttccttgttgcttaattttaaaaggtgtccagtgtgaggtgcagcgtggtgggaggtccgggggagtcttagttcgaggtccgtgggggtccctgacgactctcctgtgcagcctntgtacttcgccttacaattaacttcgtggatgctacgtcgggtcccaccgaacgtccaccggaggggaacggggtctggttagtttcgggtctacgtaacgttattaactagttagagtgggagtacgcttcactacgtagtcggaccggtaccgtcggtacggaacgggtccgtaacttccacgtatccgtaccgaagacgacaaccggacaaacgaaccataccgtagtactcgtagactaagcgaacncgaacgaccgtaaggaaaccgccgtaacgacgacggtntacgttcgttacgtacgttagaccgtaacggaacgggccgggacctagtaccgtacttacccgtccttacgtacccgcgtacgttggtacccgggg

SEQ ID NO: 203704 - DNA, 759 bp, Homo sapiens
  misc_feature: GYAE6OF01CC1JJ.24.85.H08.1.454.CMB.1.raw
  modified_base (251)..(251): a, c, t, g, unknown or other
  misc_feature (251)..(251): n is a, c, g, or t
tcagactactatgtcacgaccggtgctcgatttagtatcactcagtcgcgggaggacgctgaccacacggtacgtgctgttgtactgctcctcccgcgctttgtcttggcattatgcacctccacgccgtccacgtaccagttgaacttgacctcgagggtcttcgtgctcacgtccaccaccacgcatgtgaccctcgaggggtccctgacgtactctcctgtgccagccttcgtggattccgtccttanaaatacttcgtggatgcctacgtcgggtcccacaagtccgtaccgaagggggtacgggcttaggtacgttttcgggacctacgtaacgttaattaaaccgtgtttacggagtggggtaacgtctccgtactaactaaccgttagccgggtaccgtaccgttaccggggtaggaaccggggtcccttacgttacccaaccgttactacccgttaccgaaaggtaaccaaacccgtaaaccggacccgaaaacggaaaccctaaccgtaaccgtttagtaaaccttccgtaaacgtaaccgtaaaagtcggtaaccgaccgtaaccggtacccgtaaacggaaaacccggtccccgaaacgacccgtacggttacttacggttacgttattaacggtggtacgaacggaaggggccgggtaacaggtaccttacgtaccctaccgttactacccggtctaacgttaggcggtaccgcgggtaccggggaaccgtaacgggtccgtaccgg

SEQ ID NO: 203705 - DNA, 834 bp, Homo sapiens
  misc_feature: GYAE6OF01C02PE.24.85.H08.1.454.CMB.1.raw
  modified_base (645)..(645): a, c, t, g, unknown or other
  misc_feature (645)..(645): n is a, c, g, or t
tcagactactatgtcacgaccggtgctcgatttagtatcactcagtcgcgggaggacgctgaccacacggtacgtgctgttgtactgctcctcccgcggtctttgtcttggcattatgcacctccacgccgtccacgtaccagttgaacttgacctcgagggtcttcgtggctcacgtccaccaccacgcatcgtcgacctcgacggggtcccctaggacgaccttccgtcctggtcgctacgtccttcgttcgggtactttccgtaccctttacaaactttaaccgtttcgtagggtaactcggaccgtaccggtcggggtacccaccgaacggtccgtaccgggaagggggtaacggggtccttagggttaggttttcgggtaccttaccggtaacgtttaactttaaacgtgtttaggaggttagggaacgttacgccttacgacgtaccgttagtccggtaccggtaccgtcgggtaacggaacgggtcctaactttcccaaccgtactccgtaccgaacgtaacgaacccgaaccgaccgaaacgaaacccgtaactaccttagtacttacgtaacaacgtaaagtcgaaccgtacgacgtaaccgaacggaaaccgccgtaaccgggaacgtccggttnttacgggtttaagttacgttacggacgtaggaaccggtacggggaccgggtcctaacggtacctttaaaccgtttacccgtacccgttacccttaacccggttcccgttaaacggttaccggttaccggggtaccggttaccgggaacccgggggtaacccggaaaccgggggttcccggtaccccggg

SEQ ID NO: 203706 - DNA, 838 bp, Homo sapiens
  misc_feature: GYAE6OF01AO141.24.85.H08.1.454.CMB.1.raw
tcagactactatgtcacgaccggtgctcgatttagtatcactcagtcgcgggggagccccagccctgggattcccagctgtttctgcttgctgatcaggactgcacacagagaactcaccatggagtttgggctgagtcgttgggttttccttgttgtcttaagtttaaaggtgtcagtgtgaggtgcagcgtggtggacggtccgggggagtcttagttcgaggccggttcggggggtccctggacgtacctctccgtgtcgccacgtcctcgtggtacttccgtccttactaattaacgttcgtaggtactcgccgtacggtcgggtacccaccgaacgccgtaccgggaaggggtacgggtcgtaggtaggtttcgggtaccttacgtaacgtttattaaacgtagttacggaggttacgggtacgtacgtcctaacgtacgtaacgtacgtccgggaccggttaaccgtccgggtagggaaccgggtaccgttaactttaccgaaccttaacgtccctaacggaacggaacgaaccccgtaaacggtacccaaaagaaccctaaccgttacgttaggtaaaccttccgggaaataaaccgaaaggttcgggaaacctaccgggtaaccgttaacccgaaacgggaaaccccgggtccccgggtaaaaccggtacgggttaacggttaacggtttcggttaaacgtttaaaccggtttcggaacggggttaacgaaaccggggtaaacgggggccgttaactaccggttaaccttaaccgtttaccccgtaacgttacccccggtagtacccgttggttaaaccgggtaccgggg

SEQ ID NO: 203707 - DNA, 758 bp, Homo sapiens
  misc_feature: GYAE6OF01E5KF3.24.85.H08.1.454.CMB.1.raw
tcagactactatgtcacgaccggtgctcgatttagtatcactcagtcgcgggggagccccagccctgggattcccagctgtttctgcttgctgatcaggactgcacacagagaactcaccatggagtttgggctgagcttgggttttccttgttgctaattttaaaaggtgtccagtgtgaggtgcagcgtgggtggaggtccgggggaggtcttaggttcagccgtggggggtccctgagactctccgtgtgcagcctcgtggattcgccttacaattaacttctggatgctacgtcgggtcccgaccaacgcctccggaggggaaggggtctggtagtttgggtctacgagttattaactattggagtgggagtaacgcctacaacgtacttagtcggaccggtaccgttaccgggtacgggaacggggtacccgacgtttacccaacccgtattcccctaacccgaaggacgaaacccgtaaacccggacccgaaaacggaaaccctaacgtaaccgttaggtaacttcgtacgtaactaaacgtcggaacgaccgaacgtaccctaaacggggaaaccgtacccccggtaaaggaacccggtaacccgggttacgttacgggtttaacgtttaaccgtttaaccggtggttaacgggaaccgggtaaagggggtaccggggaccccgtaaggtacccttaacgtttaccccgtaccttaacccgttaaccgtccccggttaagtcggtacgggg

SEQ ID NO: 203708 - DNA, 805 bp, Homo sapiens
  misc_feature: GYAE6OF01AG8WM.24.85.H08.1.454.CMB.1.raw
  modified_base (590)..(590): a, c, t, g, unknown or other
  misc_feature (590)..(590): n is a, c, g, or t
  modified_base (676)..(676): a, c, t, g, unknown or other
  misc_feature (676)..(676): n is a, c, g, or t
  modified_base (702)..(702): a, c, t, g, unknown or other
  misc_feature (702)..(702): n is a, c, g, or t
  modified_base (743)..(743): a, c, t, g, unknown or other
  misc_feature (743)..(743): n is a, c, g, or t
  modified_base (753)..(753): a, c, t, g, unknown or other
  misc_feature (753)..(753): n is a, c, g, or t
tcagactactatgtcacgaccggtgctcgatttagtatcactcagtcgcgggaggacgctgaccacacggtacgtgctgttgtactgctcctcccgcgtcttgtcttggctattatgcacctccaccgccgtccacgtacccagttcgaaccttcgacctcgagggttccttcgtcggtacctcgaccgtcccaacccacccgacgctagtgtcgaccctcgacggggtccctgacgtacctcctccgtgtcgctacgccttacgtggtaccttccgcccttaacaaacttaccttcggtagtactcgtaccgtaccggtccgggtacccgtaccgaacgtccgtaaccggaacgggggacggggtccttagggtacgttttcgggaccttaccgtacggttaaacttaacgtgtaggtaggtcgggtaaagtcgtacctacgtaaccgtaaccgttagtccggggaaccggtacccgttaccgggtaggggtaacccggtaccttacgttacccgaaccgtaaccgttccgtacccgaaggtaaccgaaacctacccgaacaacgtaaacacctacgtagtactacganacgaactggacctacgtaaccgacgaaaggaaccgacccggtaaacgaccgtcggtaccgttaacgtacgtttaacgtttaccggnggtaacgaaccggaagggggtacccnggtactaacccggtatttaacccccgcctttaaccgtcccncggttaaacncggttaccgggtcctacgggtaaccgggaccccggaaggtccggtaaccccg

SEQ ID NO: 203709 - DNA, 929 bp, Homo sapiens
  misc_feature: GYAE6OF01CWPBU.24.85.H08.1.454.CMB.1.raw
tcagactactatgtcacgaccggtgctcgatttagtatcactcagtcgcgggggagccccagccctgggattcccagctgtttctgcttgctgatcaggactgcacacagagaactcaccatgggagtttgggctgagtcgttgggttttccttgttgtcttaagtttttaaaaggtgtccagtggtgaggtgcagtcgtggtgggaggtccgggggagtcttagttcaggtccggtcgggggtcccgagaccgtctccgtgtgcagcctgtggtacttccgtaccttactaaatttaaccgtttcgtaggtacgttcgaccgtacggtacggggttccccgaccgtaaacggtcccgtacccgggaaagggggtaaacgggtacgttaggtaacgttttcggggtaccttacggtaacgtttaatttaaaccgtagttaggaacggttaggggtagtacgtctaacgaaccttacgtacgttcggtaccggtaccgttaccggtacggggtaaccgggtcctaacgttacccaaccgttacttccgtaaccgtaacgaaccgtaaccgaaacccggaacccgaaacggtaaaacctaccgttaacgttacgttaacgtccgttaaacggaacctaaacgtacggtaaacggtaccgtaaccggtaacccggtaaacgggaaaccggtaaccccggaacgggtaacccggtaccgggttacgtttaacgggtttaccggttaaacgttttacccggtttacgggaccgggttaaaccggggtaaaccgggggtaaccggggggtaacccccgtaaaggttaaaccccgtttaaacccggtttttaacccccttaaccccgtttaaccggtttaaccccggttacccgggttaacggtttaacccgggttaccgggggttaaccccgggg

SEQ ID NO: 203710 - DNA, 819 bp, Homo sapiens
  misc_feature: GYAE6OF01BIS9P.24.85.H08.1.454.CMB.1.raw
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtgctcacgtccaccaccacgcatgtgacctcgacggggtccctgagtacctctcctgtgcacgtcctctggattccgccttacaaattaacttcgtaggatgactacgtcgggtccaccaagtcctaccggaaggggacggggtcctaggtagtttcgggtctacgtacggttaacttaacgagtttggacgtagggtagttacggtaccttacgaactacgttacggtcggaacccggtacgttacccgggtaaggtaaccggggtcctaaacgtttacccaaaccgtacgtttaccctaacccggaaacggaaaccgaaaaccggtaaccccggaaccgaaaggtaaaacccctaccgtaaccgttacgttaaacgttacccgtaagaaccgttaaagtcgggaacgaaccgtacggtacccggtaacgggaacccgacccggaacgtaacccggaggtagtttaccgggtattaaacgttcgttacgggtacgaacccgggaaggggccggggtaaccaacggtccgtttaaaccgttttaaccgtacccgttaacgttaccccggtcccgggttaataaccgggttccggttaaacccgggttcgggttaacccggggacccggggtaaaccgggtccccggtaccggg

SEQ ID NO: 203711 - DNA, 774 bp, Homo sapiens
  misc_feature: GYAE6OF01DDBJZ.24.85.H08.1.454.CMB.1.raw
tcagactactatgtcacgaccggtgctcgatttagtatcactcagtcgcgggggagccccagccctgggattcccagctgtttctgcttgctgatcaggactgcacacagagaactcaccatggagtttgggctgagcgttgggttttccttgttgcttaattttaaaaggtgtccagtgtgaggtgcagcgtggtggaggtccgggggagtcttagttcagccgtgggggtccctgagactcctcctgtgcacgcctcgtggatttccgtaccttacaaacttaacttccgtaggtactcgtaccgtaccggttcggggtccccgaccgtaaacggtcccgtacccgggaaagggggtaacggggtcttagggtacgttttcggggtacctacggtaaacggtttaacttaaacgtagttaggtaggttagggaacgttacgccttaccgaactaacgttagtcggtaccggaccgttccggtagggaaaccgggtcctaactttcccgaacctcttacccgtaccgaaggtaaccgaaccaaacccgggaccctaaagaaaaccctccacgtttagtactaccgtagaaccgtaaagtcggactaccgagtaacccgaaggaaaccgtccgaacgacgtacggtagttagtaacgttacgttagcggttaaccggaacgggtaaacggggtaccgggtacctaacgttacccgtttaacttaccccgttaccttaacccgtacccgtcccggtagttacggtaacccggggg

SEQ ID NO: 203712 - DNA, 855 bp, Homo sapiens
  misc_feature: GYAE6OF01CNELR.24.85.H08.1.454.CMB.1.raw
tcagactactatgtcacgaccggtgctcgatttagtatcactcagtcgcgggggagccccagccctgggattcccagctgtttctgcttgctgatcaggactgcacacagagaactcaccatgggagtttgggctgagtcgttgggttttccttgttgtacttaagtttttaaaaggtgtccagttgtgaggtgcagcgtggtggaggtccgggggagtcttagtcgagtccggtcgggggtcctgacgacctctctgtcgcacgtcctgtggacttcgtaccttaactaaacgttacttcgtggtaactcgaccgtaacggttccggggtccccaccgtaaacggtcccgtaccgggaagggggtacgggtcgttaggtacgttttcgggtacctacgtaacgttaattaacgtagttaggaggtagggagtacgtactactaacgaacttaggtcggtaccggaccgttacgggacgggtaaacgggtcccgtaacttcccaaccgttatcccgtaaccgaaggtaaaccggaacctaaacccggacccgtaaaacgaaaaccctaacgtccgtttaacggtaacgttcctaacggtaacgtaaaagtcggaaaccgacccggtaaccggaaaacccccggaaacggtaccccggaaaacccggcggtaaaccccgggttagtttacgggttaccttttaaacggtttacccggagggttaaaccgggaacccgggaaacggggggtacccggggaaccctaacggttaaccgtttaaacccgtttaccccttaaacccgttacccgtttaacccggccggttaaacgttacgggtacccggggtaaccgggg

SEQ ID NO: 203713 - DNA, 668 bp, Homo sapiens
  misc_feature: GYAE6OF01CCCZB.24.85.H08.1.454.CMB.1.raw
  modified_base (252)..(252): a, c, t, g, unknown or other
  misc_feature (252)..(252): n is a, c, g, or t
  modified_base (269)..(269): a, c, t, g, unknown or other
  misc_feature (269)..(269): n is a, c, g, or t
tcagactactatgtcacgaccggtgctcgatttagtatcactcagtcggcgggaggacgctgaccacacggtacgtgctgttgtactgctcctcccgcggctttgtcttggcattatgcacctccacgccgtccacgtaccagttgaacttgacctcaggtcttcgtggctcaccgtccaccaccacgcatgtgacctcaggggtccctgagactctcctgtgcagcctctggattcgccttcaatacttcnggatgcacgtgggtccnccaagcctaccgaggggaacggggctgagtttggggtctcgtacgttattaacagttgagtgggtatagcttacactactatgcggtacctccggtgaacgggcctattccgaacctatcctaccgagaacgaaccgaacgacccaaggtaaaccacgtactacgtaatccgtagactaaaagtgacgacaggtcccctaaggaaaccgcccgtaacgaaccgacgtactgggtcgtttaaacttcgtaggtcgaacggtaacgggcgggggaccctaggcccttaaacttttacccgacccgtttaaccgaccggttacccgacttaaacgggtttcggggaacccgttacggggtacccgggaaacccgggtaagggtaaccccgggtaacccgggg

SEQ ID NO: 203714 - DNA, 741 bp, Homo sapiens
  misc_feature: GYAE6OF01D4DD7.24.85.H08.1.454.CMB.1.raw
  modified_base (558)..(558): a, c, t, g, unknown or other
  misc_feature (558)..(558): n is a, c, g, or t
  modified_base (603)..(603): a, c, t, g, unknown or other
  misc_feature (603)..(603): n is a, c, g, or t
  modified_base (661)..(661): a, c, t, g, unknown or other
  misc_feature (661)..(661): n is a, c, g, or t
  modified_base (667)..(667): a, c, t, g, unknown or other
  misc_feature (667)..(667): n is a, c, g, or t
tcagactactatgtcacgaccggtgctcgatttagtatcactcagtcgcgggggagccccagccctgggattcccagctgtttctgcttgctgatcaggactgcacacagagaactcaccatggagtttgggctgagcgttgggtttttccttgttgtcttaagtttttaaaaggtgtccagtgtgaggtgcgagcgtgggtggaggtccggggaggtcttagttcgagccgttgggggtccctgacgaccttctcctgtcgcgacgtcctcgtggtacttccgtccttaactaattaaccgttcctagggtaacttcgaccgaccggttcggggtaccccgacccgtaaggccgttaccgggaagggggaacggggtcttagggtacggttttgggtaccttacgtaacgttaactttaaactggtttaagaggttacgggaagttaccgtcgtaccgaactacgtaacgtcggacccggttaccggttaccggtacgggtaaacgggtcccgtaactttacccgaactccgtaacctaacccggaacggtaaaccnccgaaaaccggaccctaaaggaaaccctaccgttacgtagttacnccgtaagaacgtagtcgaacgtcgacgtaaccgagaaaccgccgtaacgcgtaacgtntagttntacgtactggacggacggaagggtacggctaagcttaaccgttccgacttacccggctcccggattcggtcggg

SEQ ID NO: 203715 - DNA, 753 bp, Homo sapiens
  misc_feature: GYAE6OF01CLI6L.24.85.H08.1.454.CMB.1.raw
  modified_base (535)..(535): a, c, t, g, unknown or other
  misc_feature (535)..(535): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcgagggtcttcgtggcctcacgtccaccaccacgcatgtcgacctcgacggggtccctggacgtactctcctgtcgcacgtcctcgtggacttccgtaccttacaaattaactttcgaggtactcgactacgtcgggtacccgaccgaagcctaccgggaaggggacggggtcttggttacgttttcgggtacctaccgttaacggttaactttaaccgtaggttttaggagttacggggaacttacggccttaccaactacgtagtccggacggtaccgtcggtaagggaccggtaccctacttccgaacctactcccgtaccgaaggtaccaaccgaaccgaccaaacgaaaccctactacgttacgtacttacgtanaactaaaggtgaccacgtacgtacccgaagaacccgggaccgacgaaccggacgttcgtacgttacgttacgttaccgtaggtaccggaacgggtacgggaccgggtacaccggtacctaaccgttaccgttacccttaccgttacccgtaccgttccggtaggtacccggtcggtacgggtaccgggaacggtaccggggtacccgttaacccgggg

SEQ ID NO: 203716 - DNA, 1035 bp, Homo sapiens
  misc_feature: GYAE6OF01D6TBN.24.85.H08.1.454.CMB.1.raw
tcagactactatgtcacgaccggtgctcgatttagtatcactcagtcgcgggggagccccagccctgggattcccagctgtttctgcttgctgatcaggactgcacacagagaactcaccatggagtttgggctgagtcgttgggttttccttgttgacttaattttaaaaggtgtcagtgtgaggtgcagctggtggaggtccgggggagtcttagtcagccgtgggggtcctgagctctccgtgtgcacgtcctcgtggtacttccgccctttacaaattaaccttcgtggtaactgcctaccggttggggttaccccgacccgtaaacggccgttacccggaaggggggtaaacggggggtcccttagggttaacggtttttcgggggtaccctttaccggtaacggtttaaacttttaaaccgtaggtttttaacgggaacggttgggggtaaacggttaacggtaccgttaacctaaacccgtaaccgtttaacggtttacgggaccccggggttaacccgtttaccccggggttaagggggaaaacccgggggttaccccggtttaaacgttttaccccggtaaaacccccttaaccgtttacccccgttaaccccgaaaacggggtaacccggtaaaccccgaaaaccccgggtacccccgtaaaaacggaaaaaccccctaaaccgttaacccgtttaagggttaaacctttaaccggtttaaaggttaaaacgttacgggaaccgtaccgtaaccggaaccccggtttaaaccggaaaacccgggtccccgggtaaaacccgtaacccggtaaccggggttaccgtttagggtttaaccggtttaaccgttttaaacccggttacggggtaaccgtaaccgggggtaaagggggtaacccggggggtaaccctaaaccggggttcccttaaaaacccggttttaccccttacccccgtttaaacccgtttaacccccggttacccggttaaccctttaaaggggtcccggggtttaaccccggggg

SEQ ID NO: 203717 - DNA, 629 bp, Homo sapiens
  misc_feature: GYAE6OF01D5XID.24.85.H08.1.454.CMB.1.raw
  modified_base (274)..(274): a, c, t, g, unknown or other
  misc_feature (274)..(274): n is a, c, g, or t
  modified_base (323)..(323): a, c, t, g, unknown or other
  misc_feature (323)..(323): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcgaggggtccctgagactctcctgtgcagcctctggacttcgccttacaattacttctggatgctacgtcgggtccncaagctacgagggagggctgtagtttcgggctacgtacgttattaacgngttcgagttgggatacgctacaactactagtcggaccggtactccggtaggaacgggtcctaagttccaacctattccgtaccgaagaacgaaccaaccgccaagaaacctcacgttgtactcgtacgaacaaagtcgaacgacacgaccgtaaggaaccggcccgaacgaccgacggtcttaggtacgttaacttacgtggtacgacggaagggtacgggacctagtctaacttcccgtacctaccttacgtccgacgtacggtacggtaccgtcggacggggacccgaaagggcccgtacgggg

SEQ ID NO: 203718 - DNA, 1029 bp, Homo sapiens
  misc_feature: GYAE6OF01DK9Z3.24.85.H08.1.454.CMB.1.raw
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtgctcacgtccaccaccacgcatgtcgacctcgaggggtccctgacgtacctctcctgtcgcagcctcgtggacttccgtaccttacaaattaaccttcgtaggtattcggacctaccggttcggggtacccgacccgtaaacggtccgtaccggaaggggggtaaacggggtccgtttaggttaacggtttttcgggggttacctaccgtaaaccgggttttaaacttttaaaaccgtaggtttttacgggaaggtttcggggggtaaacgtttacggaccgttacccgtaaaccgtaaacgttacggttaccggggtacccgggttaaccgttccccggggtaaggggtaaacccggggtcccggttaaactttacccgaacccgttaacgttaccccgtaaccgaaacggtaaccgaaacccgaaaccccggacccgaaaacggtaaaaccccgtaacctaaccggtttaacggttaaccgttaccgttaaacggaaaccgttaaacggtaacggaccggaacgtaacccgtaacccgttaaacgggaaaaccccggtacccgggaaaccgggtaacccggtaacgggttaccgtttaacgttaacggtttaacctttacggtaaccgggttacggaaaacccgggggacgggggaaacccggggggtaaacccctaggttaaaccccgttaaaccgtttttacccccggtaacccgttttaacccccggttaaccggttaccccggttaacggtttaacccgggggttaccggggttaccccgggttttaacccggggggaacccgggggggttaaccccgggaaaacccggggggtttacccccggtaaacccggggg

SEQ ID NO: 203719 - DNA, 641 bp, Homo sapiens
  misc_feature: GYAE6OF01AKO3T.24.85.H08.1.454.CMB.1.raw
  modified_base (274)..(274): a, c, t, g, unknown or other
  misc_feature (274)..(274): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcgaggggtccctgagactctcctgtgcagcctctggattccgccttcaaattaacttctggatgcacgtcgggtccncaagctccgaggggacggggctgtagtttgggtcctacgacgttattaacagtttgagtgggagtacgctacactactagtcggcggtacctcggtaggaacggcctattccaacctatcctcgaagacgacaacgaccaagaacacactgtactcgtagaacaaagtgacgacacgaccgtagaaaccggcccgaacgaccgacggtctaggttacttaagttcgtgacggtacgaaggggacggggaccaacgtaccttaacgtttacccgtcccgttaacttaccgtcccgttagttaaccggttccgggaacccggtttccgggtaacgggggacccccgtaaagggggtcccgtaaccgggg

SEQ ID NO: 203720 - DNA, 784 bp, Homo sapiens
  misc_feature: GYAE6OF01BNNI5.24.85.H08.1.454.CMB.1.raw
tcagactactatgtcacgaccggtgctcgatttagtatcactcagtcgcgggggagccccagccctgggattcccagcttgtttctgcttgctgatcaggactgcacacagagaactcaccatggagtttgggctgagcgttgggttttccttgttgtcttaagttttaaaaggtgtccgagtgtgaggtgcagcgtgggtgggaggtccgggggaggtcttaggttccgaggtcccggttcggggggttcccctggacgtaccgttccgttcccgttggtcgccgtaccgtcccgttcggttacggtactttcccggtaccctttaactaaaacgtttaaccgtttcgtaggtatcgcgtaccgtcgggtaccccgaccgaacgccgtaccggaaggggaacgggtctaggtagtttcggtctacgtaacgttaattaacgtagttagaggtagggtaagtacgacgtacgaacgtacgtagtcggtaccggtacgtaccgggacggaacgggtaccctacttacccgaaccgtacgtaccgtaccaaacggtaaccgaaccgtaaaccggacccaaaacggaaacctaacctaacgttacgtaacgtaccgtaagtaaacctaagtcgaacgaccgtaaacgccgtaagggaacccggcccgaacggtaaccgtccggtacgttagttacgttaagttacgtaggtaccgaacgggaacgggacgggtaccaacgtacgttactacccgttacctacgtacccgtcgttagtccggtacggg

SEQ ID NO: 203721 - DNA, 806 bp, Homo sapiens
  misc_feature: GYAE6OF01E38PL.24.85.H08.1.454.CMB.1.raw
  modified_base (443)..(443): a, c, t, g, unknown or other
  misc_feature (443)..(443): n is a, c, g, or t
tcagactactatgtcacgaccggtgctcgatttagtatcactcagtcgcgggggagccccagccctggattcccagctgtttctgcttgctgatcaggactgcacacagagaactcaccagtggtagtttgggctgaggtcgttgggtttttccttgttgtcttaagtttttaaaaggtgtccagttgtgtaggtgcgagtcgtgggtgggtacggtccgggggagtcttagttccgacggtccggtcgggggtccctggtacgtaccgttctccgtgtcgctacgtccgttcgtgtacttccgtacctttactaaacttaaccgttcgtggatcgacctacggtccggtccgaccaacggccgtaccggaaggggacggtcgtggttacgtttgggtcctacgtacgtttaattaacgtagttcggtagtaggtaacgtacnctacaccgtagtgtcggacggtactcggtacggacggtcctatccgacctactccacgagaccaacgaccgacgaaacgaaacacgtacgtacgtactacgtaaccgaacgtaaacgtcggtaaccacggaacgttaacccgaaaccgggtaacccggggtaaccccgaaaccggtacccgggttaacggttacgtttaccgggtttacgtttaaggtttaacggttaaccgggtacggaaaacgggggtaccgggtaacccgggggaacctaaaccgggttacccgttaaaaccgtttcccccgttaaacccgtttaccccttaaccccgtttaccggtaccgttacgggttaacccggggg

SEQ ID NO: 203722 - DNA, 678 bp, Homo sapiens
  misc_feature: GYAE6OF01DCYTW.24.85.H08.1.454.CMB.1.raw
  modified_base (204)..(204): a, c, t, g, unknown or other
  misc_feature (204)..(204): n is a, c, g, or t
  modified_base (239)..(239): a, c, t, g, unknown or other
  misc_feature (239)..(239): n is a, c, g, or t
  modified_base (400)..(400): a, c, t, g, unknown or other
  misc_feature (400)..(400): n is a, c, g, or t
tcagactactatgtcacgaccggtgctcgatttagtatcactcagtcgcgggggagccccagccctgggattcccagctgtttctgcttgctgatcaggactgcacacagagaactcaccatggagtttgggctgagtcttgggttttccttgttgctaattttaaaggtgtcagtgtgaggtgcagctggtggaggtcggggngcttagtcagcgtcgggggtccctgagactctccngtcgcagcctcgtggatttccgccttacaaacttaaccttcgtaggatcgccgtacggtcgggtcccaccaacggtcgtacccgaaggggacggggtcttggttagtttcgggtcctactaacgttattaacattgaacgtgggatcgctacactactagnggacggacgtccggaggtaccggcgtattccgactctactacccgaggtaaccaacaaccgtaccaaagaaacctacgccgttagagttcccaggacctaaatcgaacgaccgaagtaacccgtaaggaaaccgcccggaacgaacggcccgtgtttacgtacgttaaacttcgagggttagaaccgggaaaggggcccggggaacctagtaacccgttaacgtttacccccgtaccgttaaccctaccccgttacggaccgtttaaggtacccgggg

SEQ ID NO: 203723 - DNA, 702 bp, Homo sapiens
  misc_feature: GYAE6OF01AIR4O.24.85.H08.1.454.CMB.1.raw
  modified_base (171)..(171): a, c, t, g, unknown or other
  misc_feature (171)..(171): n is a, c, g, or t
  modified_base (364)..(364): a, c, t, g, unknown or other
  misc_feature (364)..(364): n is a, c, g, or t
tcagactactatgtcacgaccggtgctcgatttagtatcactcagtcgcgggggagccccagccctgggattcccagctgtttctgcttgctgatcaggactgcacacagagaactcaccatggagtttgggctgagcttgggttttccttgttgcttattttaaaaggtntccagtgtgaggtgcagctggtggaggtccgggggagcttagttcagccgtggggggtccctgacgactctccgtgtgcagcctcgtggtacttccgccttcaattaaccttctggtatgctacgtcgggtccgcctaaggcctccggaaggggaagggtctggtagttttcgggtctcgtacgtaattaacnttggagtgggactagctacactacgtatcggaccggtacgttaccgggtaggaacgggcccgtattcccaacccgtacttcctacccgaaggaccggtaacccaaacccggtacccaaacgaaacccaccgtaacttacgttaactccgtagaacctaaagtcgaacgccgaacgtcccgtaaacggaaccggcccgtaaccggaccgtaccggtcttacggtacgttaacttcggtacgtacggaaccggaagggtacccgggggactaacggaccttaaccctttacccgttaccccctaacgttaccccgtacccgtccgttaaggtacccgggg

SEQ ID NO: 203724 - DNA, 805 bp, Homo sapiens
  misc_feature: GYAE6OF01E2B2E.24.85.H08.1.454.CMB.1.raw
tcagactactatgtcacgaccggtgctcgatttagtatcactcagtcgcgggaggacgctgaccacacggtacgtgctgttgtactgctcctcccgcggctttatcttggcattatgcacctccacgccgtccacgtaccagttgaacttgacctcagggtcttcgtggctcacgtccaccaccacgcatgtcgacctcgacggggtccctgagactctcctgtgcagtcctcgtggacttccgccttacaaattaacttctggatgctacgtcgggtccaccaagccgtccggaaggggaacggggtcttagtagttttcggggtacctactaacggttaattaactagtttaggaggttgggaacgttcgcctaccaaccacgttagtcgggaccggtaccgtccgggtagggaaaccggggcccttaactttacccgaacctacgttacccctacccgaaaggaaccgaacccaaaccggaacccaaaacggaaacccacctaacgttaggtacttccgtaaagaacctaagtacggacgaaccgtaacggtaccgtaaacgggaaaccgaccccgggaacgaccgtaccgggttacgttacggttacgtttaacgttacgttaggtacggaccggtaaacgggggtccgggtaacccaaggttaacccttaaaccttttaccccgacccgtttaaacccgtacccggtacccggtttacgaacgggtttacccggggacccgggtttacggggaacccggggggaaccccggtaaaacggggtccccggttaacccggggg

SEQ ID NO: 203725 - DNA, 544 bp, Homo sapiens
  misc_feature: GYAE6OF01B1DBE.24.85.H08.1.454.CMB.1.raw
  modified_base (148)..(148): a, c, t, g, unknown or other
  misc_feature (148)..(148): n is a, c, g, or t
  modified_base (176)..(176): a, c, t, g, unknown or other
  misc_feature (176)..(176): n is a, c, g, or t
  modified_base (237)..(237): a, c, t, g, unknown or other
  misc_feature (237)..(237): n is a, c, g, or t
  modified_base (243)..(243): a, c, t, g, unknown or other
  misc_feature (243)..(243): n is a, c, g, or t
  modified_base (329)..(329): a, c, t, g, unknown or other
  misc_feature (329)..(329): n is a, c, g, or t
  modified_base (344)..(344): a, c, t, g, unknown or other
  misc_feature (344)..(344): n is a, c, g, or t
  modified_base (350)..(350): a, c, t, g, unknown or other
  misc_feature (350)..(350): n is a, c, g, or t
  modified_base (381)..(381): a, c, t, g, unknown or other
  misc_feature (381)..(381): n is a, c, g, or t
  modified_base (423)..(423): a, c, t, g, unknown or other
  misc_feature (423)..(423): n is a, c, g, or t
  modified_base (497)..(497): a, c, t, g, unknown or other
  misc_feature (497)..(497): n is a, c, g, or t
tcagactactatgtcacgaccggtgctcgatttagtatcactcagtcgcgggggagccccagccctgggattcccagctgtttctgcttgctgatcaggactgcacacagagaactcaccatggagtttgggctgagcggtgttcgtntaggcgtattaaagtgtcagtgtgagtncagctggtgagtccggggagctagtcagccgtgggggcctgagctctcctgtgctagcctntaggtnttcgaccttacaattaacttcgtagatgcacgttcggccacaagctccgaaggggaggtctaggatttgggctacgtatattaatnttgagtggatgctanacatangacgtctacggtgacggctattcaactctcncgaagagacacgtacaagaaactcaactgtactagaccgaanacgtgagacctacgccgaagaccgaccgacgaccggtgtacgttagtattacgtcgtagacgaacggtacgggnggaacctagtactacgttaccgtactacgtaccgcttacgtggtcgg

SEQ ID NO: 203726 - DNA, 890 bp, Homo sapiens
  misc_feature: GYAE6OF01E3RML.24.85.H08.1.454.CMB.1.raw
tcagactactatgtcacgaccggtgctcgatttagtatcactcagtcgcgggaggacgctgaccacacggtacgtgctgttgtactgctcctcccgcggtctttgtcttggcattatgccacctccacgccgtccacgtaccagttgaacttgacctcgtagggtcttcggtggctcaccgtccaccaccacgcatgtcgacctcgacggggtccctggacgaccttctcctgtcgcacgtcctgtggtacttccggtcctttacaaacttaaccttcgtggtactcgtcctaccggtccgggtcccgaccgtaacggtaccgtacggaacgggggtaacggggtcttacggttaggtttcgggtcctaacgtaacggttaacttaaacgtaggtttaggtaacggtaggggtacgttacgtaccgtaccaaaccgttacgtaacggtacggtacccgggttaccgtaccgggtaacggggaaccgggtacccgttaacgttacccgtaacccgtaacgttcccgtaaacccgaaaggtaaccgaaacccgaaaccgtaacccgaaacgtaaaacccgtaccttaacgttaacgttaccttaccggtacgtaaaccgtaacgtacgaacccggtagtaacccgttaacccgggaaacggacccgggaaaccccgtaaaccggaaccggtaccggtttacgtaacggttaccgtttaacgtttacgaacggggttacgaaaccggggtaacgggggaccgggtaacctacgttaaccctaaaccgtttacccggtaacccttacgttaccccggttccgtaccggttacgacccggggttacggtacgggtaacccggggaacccgggttaaaccgggcggttaccccggg

SEQ ID NO: 203727 - DNA, 627 bp, Homo sapiens
  misc_feature: GYAE6OF01AVKKK.24.85.H08.1.454.CMB.1.raw
  modified_base (253)..(253): a, c, t, g, unknown or other
  misc_feature (253)..(253): n is a, c, g, or t
  modified_base (271)..(271): a, c, t, g, unknown or other
  misc_feature (271)..(271): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcgacggggtccctgagactctcctgtgcagcctctggattcgccttcaatacttcnggatgcacgtcgggtccnccaagcctccgaaggggagggtctgtagtttgggtctacgacgttaattacagttgagtgggatgctcactactagtcggcgtacgtcggtaggaacgggtccaattccaactctccgtacgacgagaaccaacgaccaagaaccacactagtactcgagaacaatcgacgacgacgaccgtaggaaccgtcccggacgaccgacggtctaggttacgttaattacgtgtacgaccggaaggccggggaccagtaccgtaacttacccgtccctaaccgttaccgtcccgtacgttaaggcccgggtaaccggttcccgggacgggaaacccggtaacgggtacccggtaaccggg

SEQ ID NO: 203728 - DNA, 820 bp, Homo sapiens
  misc_feature: GYAE6OF01D17TD.24.85.H08.1.454.CMB.1.raw
  modified_base (646)..(646): a, c, t, g, unknown or other
  misc_feature (646)..(646): n is a, c, g, or t
tcagactactatgtcacgaccggtgctcgatttagtatcactcagtcgcgggggagcccagccctgggattcccagctgttctgcttgctgatcaggactgcacacagagaactcaccagtgggtagtttgggctgagtcgttgggttttccttgttcgtacttaagttttaaaaggtcgtctagtgtggaggtgccagtcgtgggtacggtacgggtccgggggtagtacgttacggttccgaccggggtccccgggggtcctgacgtacctctcgtcgtgaccgcgtccgtgtggtacttccgtaccttactaacttaaccgttcgtaggtactcggaccgtaccggtcggtacccgacaacgtccgtacggaggggtaaggtctaggtcgttacggacttacgtaattaacgttacgtagttacggaggtcggtagtaccgtctaccgtaacgtacgtacgtacggtccggtaacgttacccggtacgggtaaaccggtaccgtttacctacccgaaccgttaccgttaccgaacgtaacggacccgtaaccaacgaaccgtaaacaaaaccgtcgtagttaacgtacgtacgtaacgaataacgcgtacggactaacgcgtaaacgggaccgtccggtaacncccggttaggttacgttcgttacgttaaccggtgttcgggtaaaccgaaaccggggtaacgggggtaccctaggttaaccgtaaccccttttaaccgtttacccccctaacccggtttaacccggtaaccctttccgggtaacccgggttaaggtccccggggtaaaccggggg

SEQ ID NO: 203729 - DNA, 707 bp, Homo sapiens
  misc_feature: GYAE6OF01A2VQ2.24.85.H08.1.454.CMB.1.raw
  modified_base (182)..(182): a, c, t, g, unknown or other
  misc_feature (182)..(182): n is a, c, g, or t
  modified_base (242)..(242): a, c, t, g, unknown or other
  misc_feature (242)..(242): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccnccacgcatgtgacctcaggggtccctgagactctcctgtgcagcctctggattcgccttnaatacttcgtggatgcacgtcgggtccgaccaagcctaccgaggggaacggggtctggtaacgttttggggtacctactacggtaatttaacagtttggagttggggaagttacgcttacaaccgtactagtcggaccggtaaccgtcccggtaggaaacggggtccctaattccgaaccctagtcccgtacccgaaggaccgaaaccgaaccgacccaacggtaaacctaacctaacgttacggttaacttaccgtaacgaactaaagtcgaacggtacccgaagaccccgtaaggaaaaccggcccgaacgtaaccgaacgggtcttaggtacgtttacttaacgtggtacgacggtaagggaaccggggcaacggtcttaacttacccttcctacctacccgtcccgtacttacgtcgggtacccgttacggagggggacccaaaggggtcccgtaaccggg

SEQ ID NO: 203730 - DNA, 870 bp, Homo sapiens
  misc_feature: GYAE6OF01EM7M7.24.85.H08.1.454.CMB.1.raw
  modified_base (219)..(219): a, c, t, g, unknown or other
  misc_feature (219)..(219): n is a, c, g, or t
  modified_base (232)..(232): a, c, t, g, unknown or other
  misc_feature (232)..(232): n is a, c, g, or t
tcagactactatgtcacgaccggtgctcgatttagtatcactcagtcgcgggaggacgctgaccacacggtacgtgctgttgtactgctcctcccgcggtctttgtcttggctattatgcacctccacgccgtccacgtaccagttgaacttgacctcgtagggttcttcggtggctcaccgtccaccaccacgcatgtgacctcgaggggtccctganactctccgtgtcnctagtcctgtaggtacttccgtacctttacgaaacttaacgttcgtgggtactcggtacctacggttccgggtccccaccgtaacggtccgtaccgggaaagggggaacggtccgttaggttacgttttgggacttaccgtaacgtttaacttaaacgtagtttacgggtagtaggggtaacgtacgtacctacctaaccgtacttaacgccgggtaccggttaaccgttccgggtaaagggaaccgggtaccggtaactttacccgaaaccgtcttacccgaacccggaaggtaaacccgaaaccaaccccggaacgaaacggaaaccctacgtaacgttacgttaaccgttaccgtacgaaacctaaacggttaacggaccgacccgaacgttaccgtaaacggaacccggtacccgaaccggtacgacccggttacgtttacggtaaccgtttaggttaccgtacgggttaacgaaccgggaacgggggtaccggggtaccctaaccggtccttaaaccggtttaccccgttacccgtaaccctttacccggaccgttaccggtttaacggtaccgggttacccggttacgggaacccggggtaacccgttaacggggacccccggttaaccggg

SEQ ID NO: 203731 - DNA, 801 bp, Homo sapiens
  misc_feature: GYAE6OF01DN6H3.24.85.H08.1.454.CMB.1.raw
  modified_base (144)..(144): a, c, t, g, unknown or other
  misc_feature (144)..(144): n is a, c, g, or t
  modified_base (234)..(234): a, c, t, g, unknown or other
  misc_feature (234)..(234): n is a, c, g, or t
tcagactactatgtcacgaccggtgctcgatttagtatcactcagtcgcgggaggacgctgaccacacggtacgtgctgttgtactgcctcctcccgcggtctttgtcttggctattatgcacctccacgccgtccacgtaccngttagaacttgacctcgagggttcttcggtggctcacgtcccaccaccacgcatgtcgacctcggacggggtcctgacgcctctctgtcncacgtcctcgtaggtacttccgtaccttacaaattacttcgaggatcgacgtacgtcgggtacccaccaacgtccgtaccgggaaggggaagggtccttaggttacggttttcggggtaccttacgttaacgtttaacttaacgtagttaggtagtacgggtaagtacgtcctacgaacctacgtacgtcggaccgtacgtaccggtaagggaaccgggtcctaacgttaccaaccgtactaccgtaccgaaaggaaccgtaaaccgaacccgtacaaaccgtaaaccacctacgttagtacttacgacgtaaacgaaagtacggacgactaccgtaaccgaaggaacccgacggaaccgtaacggacggtacttaggttacgttaacgttaccgtaggtaacgaacggggtaacggggacgggtaaccctagttacccgttaaccgtttaacccttacccggttaaccttccccgtaccgggttaacgtaccgggttaccgggtacccgggttaccggggaacgggggttaaccccggtaaacggggtcccggttaaaccccgggg

SEQ ID NO: 203732 - DNA, 730 bp, Homo sapiens
  misc_feature: GYAE6OF01A0CCO.24.85.H08.1.454.CMB.1.raw
  modified_base (677)..(677): a, c, t, g, unknown or other
  misc_feature (677)..(677): n is a, c, g, or t
tcagactactatgtcacgaccggtgctcgatttagtatcactcagtcgcgggggagccccagccctgggattcccagctgtttctgcttgctgatcaggactgcacacagagaactcacatggagttgggctgagtcttgggttttccttgttgcttaagttttaaaaggtgtccaggtgtggaggtgcagcgtgggtgggacggtccgggggaggtcttagttcgaggtccggtcggggggtccctggacgaccttctccgtgtgcacgtcctcgtggtctttccgtcctttacaaattaccttcgtggactggctacgtcgggtacccacgaagtccgtacggaggggtagggctgttagttcgggttactacgtacgttaagttaactagttggagttagggtactaacgctaccaactacgttactcgggtaccggtaccgtaccgggtagggaaccgggtcccgtaattcccaacccgtactcccgtaacgaacggtaaccgaaacccgtaaaccgacccgaaaacgtaaacctaaccgtacttacgtaacttccgtaagaactaaagtcggacgacgtacgcgtaaacggaaaccggacccaaccggtaaccacgggtcgtttagtattaccgttagttaccggaggccgggtaaaacggggcgggtaacncgggtacctacgtttacccgtccgttaactcccggttacgtctacgggtacgg

SEQ ID NO: 203733 - DNA, 655 bp, Homo sapiens
  misc_feature: GYAE6OF01BJZ7O.24.85.H08.1.454.CMB.1.raw
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtcgacctcgaggggtccctgagactctcctgtgcagcctcgtggtacttccgccttacaattaaccttcgtggatcgcctacgttcggggtcccgaccaaggcctaccggaagggggaacggggtctaggtagttttggggtcctacgtacgttaattaacgtagttggagtggggatagctacaactatagtcggacgtactccggtaggaacgggcctattccgacctactcctaccgagacaacgtaaccgaccaagaaaccactactagtactcgtacgaactaaagtgacgacgtacggacctaaggaaaccgcccgaacgaccgacggtctagtagttacttacggtgtacgacggaaggggaccgggacctaggtacctacgttaccctaccttactaccgtaccgtcgtaaggtcggtacggtccggaggggacccgaacggggtccgtaaccggg

SEQ ID NO: 203734 - DNA, 869 bp, Homo sapiens
  misc_feature: GYAE6OF01BTPBJ.24.85.H08.1.454.CMB.1.raw
tcagactactatgtcacgaccggtgctcgatttagtatcactcagtcgcgggaggacgctgaccacacggtacgtgctgttgtactgctcctcccgcggtctttgtcttggcattatgcacctccacgccgtccacgtaccagttgaacttgacctgagggttcttcgtgctcaccgtccaccaccacgcatgtcgacctggacggggtccctgaacgtcctccttcctgtacgcacgtcctcgtaggtacttccgtacctttacaaagttaccgttcgtaggtacttacggccgtacgggttccgggtacccgaccgtaaacggccgttaaccgggaaggggggtacggggtctttagggttacggtttttcgggggtaccttacggttaaacggtttaactttaaccgttagtttaggtagggttacggggtaactacgtacctacgtaacctacttacggcggtaccggtacgtccgggtaggaacgggtcctaacgtaccgtaccgtacttccgaaccggtagaaccggtaaccaaccggtaaccaaacgtaaccctacgtaacgttagttaccgtacgtaagaacgtaaagtcgaacgaccgtaacgtacccggtaaaaggacccggtacccggaaccgtaacccgggtaccgggtttattaaccgggttttaacgtaccgtttaaaccggttcggggtaacccgtaaacggggtaacggggtacccgggtaccttaaacgttccgtttaaacccgtttacccggtacccttaacccggtccttcccggtaacgttacgggtacccgggttacggtacccgggtaacccgggggaaccgaaacggggttcccgggtaccccggg

SEQ ID NO: 203735 - DNA, 841 bp, Homo sapiens
  misc_feature: GYAE6OF01B9DAV.24.85.H08.1.454.CMB.1.raw
  modified_base (627)..(627): a, c, t, g, unknown or other
  misc_feature (627)..(627): n is a, c, g, or t
tcagactactatgtcacgaccggtgctcgatttagtatcactcagtcgcgggggagccccagccctgggattcccagctgtttctgcttgctgatcaggactgcacacagagaactcaccatggagtttgggctgagtcgttgggtttttcctttggtttgtactttaagtttttaaaaaggtgtaccgaggttgtggaggtgcaggtcgtgggtgggagggtccggggggaggtcgtttacggttccacggtcccgggttcgggggggttcccctaggacggtaccttccttcccgttggtcgccacggtcccttcgtggtactttccggtaccctttactaaactttaaccgtttacgtagggtactcgtaccgtacggtccggggtccccgaccgaacgccgtaccggaagggggaacgggtcgtaggttacggttttcggtactacggttaacgttaaactttaacgtattaggtaggttacggggtacgttacggtcctacaacgtacgttacgtcgggtaccggtaccgttaccggtagggtaaaccgggtcctacttacccaaccgtacgtacccctaacgaaggtaacgaacccgtaaaccgaccgaaaacgtaaaccncgtacgttagtactacgagtaaccgaagtcgaacggacccgtaagccccggtaaagaaacccggcccggtaaacggaccgtacgggtactttaggtagtttaccgttaggtacggtacggaaacggacggggggtaccccgggtactaacggtccttaaacccgtttacccgttacccgtaacgttccccggaccgtttgtaaccggttcgggg

SEQ ID NO: 203736 - DNA, 769 bp, Homo sapiens
  misc_feature: GYAE6OF01DWOV3.24.85.H08.1.454.CMB.1.raw
  modified_base (185)..(185): a, c, t, g, unknown or other
  misc_feature (185)..(185): n is a, c, g, or t
  modified_base (188)..(188): a, c, t, g, unknown or other
  misc_feature (188)..(188): n is a, c, g, or t
  modified_base (654)..(654): a, c, t, g, unknown or other
  misc_feature (654)..(654): n is a, c, g, or t
  modified_base (736)..(736): a, c, t, g, unknown or other
  misc_feature (736)..(736): n is a, c, g, or t
  modified_base (749)..(749): a, c, t, g, unknown or other
  misc_feature (749)..(749): n is a, c, g, or t
  modified_base (762)..(762): a, c, t, g, unknown or other
  misc_feature (762)..(762): n is a, c, g, or t
tcagactactatgtcacgaccggtgctcgatttagtatcactcagtcgcgggggagccccagccctgggattcccagctgtttctgcttgctgatcaggactgcacacagagaactcaccatggagtttgggctgagcttgggttttccttgttgcttattttaaaaggtgtcagtgtgaggtgnagntgggtggaggtccgggggagtcttagttcaggtccggttcgggggtccctgacgtactcttccgtgtcgacacggtcctcgtacggtcttccgtacccttactaaacttaacgtttccgtagggtatcggaccgttacggtaccggggttaccccgacccgtaacggtccgttacccggggaagggggaacgggggtaccgtttggttacggttttacggggtccttacgtaaacggtttaacgtttaaccgtagtttagggacggttgggaagttacgccttacgaactaccgttaggcggtaccggtaccggttaccgggtaggtaaacccgggtcctaactttcccgtaacccttagttaccccaaccggaagtaaacccgaaacctaaacccggacccaaaacggaaacctacgtaacgttacgtaacttacccgttaggaaacccttaagtcggaacgtanaccggtaacgtaacggaaaccgccccgtaagaccgccggtaagtcgttagtcttaacgtggacgtaacgagggacgggtcanacgttacttaccncttactctacgtntcggtcg

SEQ ID NO: 203737 - DNA, 840 bp, Homo sapiens
  misc_feature: GYAE6OF01C462F.24.85.H08.1.454.CMB.1.raw
  modified_base (332)..(332): a, c, t, g, unknown or other
  misc_feature (332)..(332): n is a, c, g, or t
  modified_base (484)..(484): a, c, t, g, unknown or other
  misc_feature (484)..(484): n is a, c, g, or t
  modified_base (496)..(496): a, c, t, g, unknown or other
  misc_feature (496)..(496): n is a, c, g, or t
tcagactactatgtcacgaccggtgctcgatttagtatcactcagtcgcgggaggacgctgaccacacggtacgtgctgttgtactgctcctcccgcggtctttgtcttggcattatgcacctccacgccgtccacgtaccagttgaacttgacctcgagggtcttcgtggctcacgtccaccaccacgcatgtcgacctcgacggggtccctgacgtacctcctcctggtcgacacgtccttcgtcggacttccgccttacaattaacttcgtaggtactcgacctcggtcggtacccgacgtaacgccgtccggaagggggaaccgggtntaggttaggttttcggactacgtaacgttaattaacgtagttgtaggtgggtagtacgctacgaacgtcttagcggaccgtactaccgggtaggaaccggtcctactaccaccttacgtctaccgaagacgtaacccacgacgtaacaaccnaacgttgtaacnccgttaagaactaaacggtgacgaaccgtaaccggtaccgtaacgggaaacccgtacccgggaacggttaaaccgcccgggtttatttacggggtttaagtttaaaccgttacccggttgggttaacccggtaacggggtaacgggggaacggggaccccttaaaggggttaccccctttaaacgtttttaacccccgggttaaccccttaaccgggtttaacccccgtacccgggttttaaacgggaaccggttttacccgggggtaaaccccgggttttacggggggtaaccccgggaacccccggggttaaaacggggtccccccggggtttaaaccgggg

SEQ ID NO: 203738 - DNA, 745 bp, Homo sapiens
  misc_feature: GYAE6OF01CGTRX.24.85.H08.1.454.CMB.1.raw
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcgaggggtccctgagactctccgtgtgcagcctctggtacttccgccttacaaatacttctggatgcctacgtcgggtcccgaccaacgccgtaccggaaggggaagggtcttaggtagttttcgggtcctacgtaaccgttaagttaaacagtttaggagtagggtagtacgcttacaactactagtcggacgtaccgtcggtaggaacggtcctacgttaccacctactcctaccgaaggaaccgaaaccgtaaccggacccaaaaggtaaaccctacgtaaccgttagtacttacgtacgaaactaaagtcggacacgacgtacccgtaaagggaaacccgcccgtaacggaaccgtaccggtcgtttaacgggttagtttaaccgtttaccggtaggtaccggaacgggtaacggggcccggggtacctaggtacccttaaacgtttacccctacccttaaaccgtaccctcccggtaacgttcggtcgggtaaccccggttcgggacccggggaaaccgtaaccggggtcccgtaacccgggg

SEQ ID NO: 203739 - DNA, 791 bp, Homo sapiens
  misc_feature: GYAE6OF01E45AF.24.85.H08.1.454.CMB.1.raw
tcagactactatgtcacgaccggtgctcgatttagtatcactcagtcgcgggaggacgctgaccacacggtacgtgctgttgtactgctcctcccgcggctttgtcttggcattatgccacctccacgccgtccacgtaccagttgaacttgacctcagggtcttcgtggctcacgtccaccaccacgcatgtcgaccgtcgacggggtccctgacgactcctcctgtgcacgtccttcgtggacttccgccttacaaattaaccttcgtaggactcgacctacggttcgggtacccaaccgaacggccgtaccggaagggggacgggtctcggttacgttcgggtacctacgtaacgttaattaacgtagttggaagtgggtagtacgctacactacgtagtcggacggtaccgtacggtaggaaccgggtacctacttaccgaacctacgttacccgtaccgaaaggtaaccgaaacccgaaccgaaccgtaaaacgaaaccctaacgtaccgttaaggttacctacgtaacgaaaccgtaaaggtacgaaccgtacgtaacggacccgtaaaggaaccccggccgaaaccggtccgtaacggttcgttaacggtaacgtttaccgttacggacgggtacgaacgggtaacggggaccgggtacctacggtacctaacgtttacccgtacccgttaccttaacccggtcccgttaacggttagggtacccgggtaccggtaccggggaacccgggaacccgggtaaaccgggtccccgggttaacccgg

SEQ ID NO: 203740 - DNA, 655 bp, Homo sapiens
  misc_feature: GYAE6OF01BZ8P6.24.85.H08.1.454.CMB.1.raw
  modified_base (270)..(270): a, c, t, g, unknown or other
  misc_feature (270)..(270): n is a, c, g, or t
  modified_base (307)..(307): a, c, t, g, unknown or other
  misc_feature (307)..(307): n is a, c, g, or t
  modified_base (392)..(392): a, c, t, g, unknown or other
  misc_feature (392)..(392): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggattcgccttcaataacttctggatgcacgtcgggtccncaagctcgagggagggctgatttggctcacgtatacnttgatgggatagctacacactatgcggactccggtagaacgggccattccacctatcctccgagacgacaaccgccaagaaaccncactagtatccgtagacaaatggacgctacggaccctaggaaaccgccgacgtaaccgcggtctaggttgttaacttccgtggttacgaccggtaaaggggaccggggggtacccaagggtacccttaaagttttacccccgtacccgtttaaacccgtaacccgttccccggtaacgttaaccggttaccgggggtacccggtttaccggggaccggggggtaacccccgtaaacggggggtaaccccccgttaccgggggg

SEQ ID NO: 203741 - DNA, 631 bp, Homo sapiens
  misc_feature: GYAE6OF01AXMKD.24.85.H08.1.454.CMB.1.raw
  modified_base (281)..(281): a, c, t, g, unknown or other
  misc_feature (281)..(281): n is a, c, g, or t
  modified_base (350)..(350): a, c, t, g, unknown or other
  misc_feature (350)..(350): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcgaggggtccctgagactctcctgtgcagcctctggattccgccttacaaattaacctttctggatgctacgttcggggtcccnccgtaaagccgtaccgaagggggaaggggtctaggtagttttcggggtctacgaacgttaattaaacgntttggaagtggggagttagcctacgactacgtatggaccggtactccggtaggaacgggcctaattccaaccacttccaccgaggaaccacaaccgccaagaaaccacactgtactcgtagaactaaagtgacgcacgtacctaggaacgccgaacgaccgacggtcgtagtacgttattacgtgtacgacggaagggcggggaccagtacctaacttacctaccgtacttaccgcctagtacgtcggtacgttcggacgggaccgacgggtaccggtcgg

SEQ ID NO: 203742 - DNA, 865 bp, Homo sapiens
  misc_feature: GYAE6OF01DE5S5.24.85.H08.1.454.CMB.1.raw
  modified_base (247)..(247): a, c, t, g, unknown or other
  misc_feature (247)..(247): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtgcctcacgtccaccaccagcatgtcgacctcgaggggtccctgacgcctctctgtgcagcctcgtggacttcgaccttanaaacttacttcgtggtaagttcgaccgtaccggtcggggtaccccgaccctaaacggtccgtaccggaaggggggtaacggggtccttaggttaacggttttcgggggtacctacgttaacggtttaacttaaaccgtagtttacgggtaaggtcggggtaacgtttaacggtacctacccgtaaaccgttaaccgttacggtccgggtaacccggtttaaccgggttacccgggttaagggggaaaccggggttaccccggttaaacgttttaccccacccgtaaccgtttcccgaaccgtaagggtaaaccggaaccctaacccgggaaccgaaaacgtaaacccgaaccttaacgttacggtaaacttccccggtaagaaacctaagtacggaccgtacgacccgttagaaccggtaaaccggaccccggaacgtacccggtaggttaccgtacggtttaagttaccgttacgtggggaccgtaacggggaggggtaaccccggggtctaaacgcgtttaacgttacccctaccgtaacctttcccggaccttaccggttacggacgttaccgggttacggaacggggtaacccctggggaaccccttaccgggg

SEQ ID NO: 203743 - DNA, 861 bp, Homo sapiens
  misc_feature: GYAE6OF01AXMDW.24.85.H08.1.454.CMB.1.raw
  modified_base (256)..(256): a, c, t, g, unknown or other
  misc_feature (256)..(256): n is a, c, g, or t
tcagactactatgtcacgaccggtgctcgatttagtatcactcagtcgcgggggagccccagccctgggattcccagctgtttctgcttgctgatcaggactgcacacagagaactcaccatggagtttgggctgagctgggttttccttgttgcttattttaaaaggtgtccagtgtgaggtgcagctgggtggaggtccgggggaggtctttaggttcaggccgtcggggggtccctgagtactctcctgtgcngcctctggtattccgccttacaattaacttcgtggatgactaagtcgggtccgaccaagccgtaccggaaggggacggggtcctaggtagttttcgggtcctacgtaacgtttaacttaaactagtttcggaaggttaggggtaacttacggtccttacgaaccgtaacttacgtacggtacccgggtaccgttacccggggttacgggaaaccgggggtaccccttaagttaccccgtaaaccctacgtttaccccgttaaccgaaagggtaacccgaaaccccgtaaacccgggaccccaaaacggtaaaacccaccgttaaccgttaggttaaacccttagtaacgaaccgttaaaagtcgggaacgaaccgtaaccggtaacccgaaacgggtaaacccggaccccggtaacggtaaccgtacccgggttacgtttaggttaccggttaaccttttacggaggttaacccggggaacggtaaaaccggggggcggggtaaccccacggttaaccccgtttaaaccgtttacccccggttaaccccgttaaaccgtttcccccggaacccgtttacggttaacgggtttaaacccccggggg

SEQ ID NO: 203744 - DNA, 777 bp, Homo sapiens
  misc_feature: GYAE6OF01C8OJV.24.85.H08.1.454.CMB.1.raw
tcagactactatgtcacgaccggtgctcgatttagtatcactcagtcgcgggaggacgctgaccacacggtacgtgctgttgtactgcctcctcccgcggtcttttgtcttggcattatcgcacctccacgccgtccacgtaccagttgaacttgacctcgagggttcttcgtggctcaccgtcccaccaccagcagttgtacgacccgtcgacggggttccctgacgaccttcctcctggtccgacacgtccttcgtcggtacttccgtacctttacaaactttaccttcggtagagtcgacctaccggtccggtacccgaccgtaagtcccgtacgggaagggggtacggtcgttaggttacggtttcgggtacctacgttaacgtttaacgttaaccgttgttaggaggttacggaacggttctactacctaaccgtagtacgtcgggacccgtaaccgtcggtaacgggacggtaccttacgtacctacgtactccgaacgaagtaaccaacgtaacccgacgaaacgtaacctccgtaacgttactacgttacgaacgtaaccgtaagcgtaaccgcgtaacccgtcgaaacggacccgacccggtaacggaccgttacggtaaccggtttagtacgtttaccgttaaggcgttaacgaaccgggtacggaccgggtactacggtaccttaccgtaaccgtccgttacccgttaccgtctaaggtccgtacgggaaccgttcgggaccggaaccggtacggtccgtacccgg

SEQ ID NO: 203745 - DNA, 861 bp, Homo sapiens
  misc_feature: GYAE6OF01BU8A7.24.85.H08.1.454.CMB.1.raw
tcagactactatgtcacgaccggtgctcgatttagtatcactcaggttcggcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtcacctcgacggggtccctgacgactctcctgtcgcagcctctggacttccgaccttacaaacttaacttcgtaggactgactacgtcgggtccgacctaacggccgtaccggaagggggaacgggggtcttaggttaacgttttcgggggtccttccgtaacggttaactttaaacgtagtttaggtaacggttacggggtaacgttacggtcctaccgaacctaacgtacgttcggaccggtaccgttaccgggtacgggaaaccggggtccgtaacgtttcccgaaaccgttacgttacccgtaaccgtaacggtaaccgtaaaccgtaacccggtacccaaaacggaaaacctacccgttaacgtaacgtttaacttacgttaacgaactaaaaggtttccgggaacgtaccggaacccggtaacccgttaaaggaaacccggccccggtaaacggtacccggtaaccgggttactttaacgggttaacggtttaaccgttaccggttacggtaccggaaccgggaaaccggggtacggggacccttaacggtaccttaaccctttaccgtacccgttaaccgttacccggtcccgtacttaagggtccgggtaaccggttccgggaacggggaaccccggaaagggtacccggtaaccgggg

SEQ ID NO: 203746 - DNA, 1034 bp, Homo sapiens
  misc_feature: GYAE6OF01BV095.24.85.H08.1.454.CMB.1.raw
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggttcttcgtggctcacgtccaccaccacgcatgtgacctcgaggggtccctgagactctcctgtgcacgtcctcgtggtacttccgtcctttacaaattaaccttcgtggtacttcgaccgtaccgttcgggggtacccgacccgtaacggcctacccgggaaggggggtaacgggggtccgttaggtttacggtttttcgggggttaccttaccggtaaaacggtttaaacttttaaaaccgtaaggttttaggtaagggtttaggggaaacggtttaaccggtacccttaacccgtaaaaccgtaaccgtttaacgggtaccggggtaacccgggttacccggttaacccgggttaagggggtaaaacccgggggtcccgtttaaacttacccgaaacccgtacttaccccgtaccgaaacggtaaaccggaaaacccgaacccgaaccgaaacggtaaacccaacgtaaccgtttagttaaccttaccggtaacgtaaccttaaaaggtaccgaacgtaccgtaaaccggtaaccgtaaaccgggaaaccggaccccggtaaaccggtaaccgggtacccgggttaccggtttagggtttaaccgtttaacgggtttaccgtttaacgggtaccgggttaaacggggaaccgggggaacccggggggtaacctaacggggtttaaccttaaaccccggttttaaccccgtttaccccggttttaaaacccccgtttaaccccggtcccggtttaaaccgggtttagggggtttaaccccggggtaacccgggtttcccggggggtaaccccggggggggtaaaacccccggtaaacccggggggggttaaacccggttaacccccggggggg

SEQ ID NO: 203747 - DNA, 646 bp, Homo sapiens
  misc_feature: GYAE6OF01C7IYE.24.85.H08.1.454.CMB.1.raw
tcagactactatgtcacgaccggtgctcgatttagtatcactcagtcgcgggaggacgctgaccacacggtacgtgctgttgtactgcctcctcccgcggtctttgtcttggcattatgcacctccacgccgtccacgtaccagttgaacttgacctcagggtcttcgtggctcacgtccaccaccacgcatgtgaccctcgacggggtcccctggagacctcctcctgtgccagcctagtggtattccgccttacaaattacttctggatgctacgtgggtcccaccaagcctaccgaggggaacggggctggtagtttcgggtctcgaacgtttaattaaacagtttggagtgggtaatacgcctacacgaactagtgccggaccttcggtaaggaacgggccgaattccaccgtatcctaccgaagacgaaccaaccgacaagaaccactactgtactcgtagaactaaagtggacgcgaacgtccgaagaacgcccgaacgaccgcggtcgtgttagtacgttgaggtacgacggaagggcgggacctagtactaacgtttaccctaccttaacctaccccgtcgtacgttagtaccggtaccgtccgggtacggggaacccgtaacgggtcccggtacggg

SEQ ID NO: 203748 - DNA, 797 bp, Homo sapiens
  misc_feature: GYAE6OF01DZVOK.24.85.H08.1.454.CMB.1.raw
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcgaggggtccctgacgacctctcctgtcgcagcctcgtggtacttccgccttacaaacttacttcgtggtatgcctacggtcgggtcccgaccaaggcctaccggaggggaacggggtcttggttagtttcggggtacctacgtaacgtttaatttaactagttggaggtggggtagtacgtctaccaacgtacttagtcggaccggtaccgtaccgggtagggaacgggtaccgtacttaccacctactccgtaccgaagaacgtaacccgaaccgtacgaaacgaaaccctacgtaacttacgttactacgtacgaaacgtaaagtcgacgactaacggtacccgtaaaggaaacccgggtacccgaacggtaaccccgtacgggttacgtttacgggttaacgtttaccgtttacgggtacgggttaacgggaacgggtaacggggggtcccggggaaccctaacggttaaccctttaacccggtttaccccgttaaccccggtttacttaacccggtcccgtaaggttacggtacccggggttaccggtaaccggggtaccggggaaacccggtacgggggtaacggtaccccggg

SEQ ID NO: 203749 - DNA, 877 bp, Homo sapiens
  misc_feature: GYAE6OF01AT2G0.24.85.H08.1.454.CMB.1.raw
tcagactactatgtcacgaccggtgctcgatttagtatcactcagtcgcgggaggacgctgaccacacggtacgtgctgttgtactgcctccgtcccgcggtctttgtcttaggcattatgcacctccacgccgtccacgtaccagttgacttgacctcagggtcttcgtgctcacgtccaccaccacgcatgtcgacctcgacggggtccctggacgtaccgtcctccgtgtcgcccacgtccttcgtcggtaccttccgtacctttaccaaattaaccttttcgtacggtattccggacctaccggttccgggtccccgaccgtaaacggtcccgtacccgggaagggggaacgggggtccttaggttaacggttttgggggtccttaccggttaacggttaacttttaaaccgtagttttagggtaaggttagggggtaacgtttacgtcccttaaccgaacttaaccgttaacgtcggggacccggtaaccgttaccggggacgggtaaaccggggtccctaacgtttacccgacctactttacccgaccgtaaggaaccgtaacccgaaccggaacccgtaaaacgtaaaacccacccgttaacgtttacggttaacccttacggtaacgtaaccgtaaaagtccggaacgtaccgtaaccggtaacccggtaagaaaacccgggccccgtaaacggtaccggtaccgggttattacggtttaacgttaaaccgtttcggttaggaaccggacgggtaaacgggggccggtaaccagtacccttaacgtttacccgccttaacgaccccgttcgaagttccgggtaacgggtccgtacgggtacccggggaaaccgtacgggacccggtcgg

SEQ ID NO: 203750 - DNA, 714 bp, Homo sapiens
  misc_feature: GYAE6OF01BY0NB.24.85.H08.1.454.CMB.1.raw
  modified_base (246)..(246): a, c, t, g, unknown or other
  misc_feature (246)..(246): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcgaggggtccctgacgactctcctgtgcagcctcgtggacttcgccttnaatacttctgatgctacgtcggtcccgacagcctaccgaaggggaacgggtctggtagtttgggtctacgtacgttattaacgagtttgaggttagggagttacgcttccaacgtaacttagtcggacggtacctccgggtaaggaacgggaccgtacttccgaacctacgtaccctaccgaaaggaccgaaccgaaaccgaccaaacgaaaccaccgtactagttaactcgtagaacaaagtcgaacgtacctacggacctaacggaaaccgtaccgaaccgtaaccggtacggtcgttaaggttaccgttagttaccgtggtacgaacggaaggggaccgggtccaacgttaccctaacgttttaccccgaccttttaacccgacccgttacccggtacgttaaacggtcccgggtaacggttaccggtacgggggaacccgttaaaccggggccgttaaccgggg

SEQ ID NO: 203751 - DNA, 715 bp, Homo sapiens
  misc_feature: GYAE6OF01ASBNE.24.85.H08.1.454.CMB.1.raw
  modified_base (546)..(546): a, c, t, g, unknown or other
  misc_feature (546)..(546): n is a, c, g, or t
  modified_base (688)..(688): a, c, t, g, unknown or other
  misc_feature (688)..(688): n is a, c, g, or t
  modified_base (699)..(699): a, c, t, g, unknown or other
  misc_feature (699)..(699): n is a, c, g, or t
tcagactactatgtcacgaccggtgctcgatttagtatcactcagtcgcggggagccccagccctgggattcccagctgtttctgcttgctgatcaggactgcacacagagaactcaccatggagtttgggctgagcttgggttttccttgttgtcttaattttaaaaggtgtccagtgtgaggtgcagctgggtggaggtccgggggaggtcttagttcacggtccggtcgggggtccctggagacctctcctgtcgcagtccctcgtggtacttccgtcccttacgtaaacttaaccttcgtggtaatcgacgtacgtcggggtcccaccgaacgccgtaccggaaggggaacgggtcgttaggtaggtttcgggtcctacgtaacgttaacttaaacgtagttaggaggtagggtaacgttaacggtcctaacgtaacgtaacgttagtccggaccggttaaccgtaccggggttacggaaacgggtccgtaacttaccaccgtactccgtacgaacgaccgaaccaccgaacgaaacgaacngtactagtactacgtaacgaatacgtagaccgatacccgtaacgaacggaacccgaccggaaccgtaccggtaccgttgttacgttaacgttacgtgtacggagaacggggcggaaccggactacgtacctaactttacccncttacgtaccncgtagttcgtaccggg

SEQ ID NO: 203752 - DNA, 728 bp, Homo sapiens
  misc_feature: GYAE6OF01BDB2G.24.85.H08.1.454.CMB.1.raw
  modified_base (563)..(563): a, c, t, g, unknown or other
  misc_feature (563)..(563): n is a, c, g, or t
tcagactactatgtcacgaccggtgctcgatttagtatcactcagtcgcgggggagccccagccctgggattcccagctgtttctgcttgctgatcaggactgcacacagagaactcaccatggagtttggctgagcttgggttttccttgttgtcttattttaaaaggtgtccagtgtgaggtgcagcgtgggtggaggtccgggggaggtcttagttcgaggtccggtcggggggtccctgacgaccttcctccgtggtgccacgtccctcgtggacttccgtccttactaacttaacttcgtaggatcgcgtacgtcgggtcccgacctaacggccgtaccggagggggtaacggggtcgttaggttaggtttcgggttcctacgtaacgtttaacttaactagttggaagtgggagtacgtcctacactacgtagtcgcggtaccgtccggtacggaacggtccgtacgttccacctactacctaccgaacgaaccgaaccaaccggaaccctaaaggaaaccctaccgtaacgttagttactacccgtagaactaagngtaccgactacgaacccgtaaggaaacccgccggaacgaccgtacgggtcgttacgttaagttacttacggtggtacgacgggtaacggggacgggttaccacggttccttaaacctttacccgtaccttaacccggttaccctcccggtagttcggtacccggg

SEQ ID NO: 203753 - DNA, 725 bp, Homo sapiens
  misc_feature: GYAE6OF01BF8U6.24.85.H08.1.454.CMB.1.raw
  modified_base (234)..(234): a, c, t, g, unknown or other
  misc_feature (234)..(234): n is a, c, g, or t
tcagactactatgtcacgaccggtgctcgatttagtatcactcagtcggcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcgaggggtccctgacgactctcctgtcgcagcctcnggacttcgccttacaataccttctaggatcgcacgtcgggtccaccaagctaccgagggacgggctgagtttcgggtctcgtacgtattaacgagtttcggagtggggatacggccttacaactactatcggccggtaactccgggtaggaacgggcctagttaccacctacttcctacccgaagtacgaaccaacgtacccaaggaaaccactaccgttaggtaacttcgtacggaactaaacggttgaacggtacctaacggtacccgttaaaggaaacccgggtcccggaacgtaaacccgtacggggttacccttaagggttaccggtttaaatttacccggtacggggttaacgaacccgggaaacggggtaccgggggacctaacggtaccttaacgttaccccgtacccttaacggtacccgttccgaaccgttacgtcgggtacccttgggaccgggtaccgtaaaccggggtaccgtacggg

SEQ ID NO: 203754 - DNA, 728 bp, Homo sapiens
  misc_feature: GYAE6OF01EGWC0.24.85.H08.1.454.CMB.1.raw
tcagactactatgtcacgaccggtgctcgatttagtatcactcagtcgcgggggagccccagccctgggattcccagctgtttctgcttgctgatcaggactgcacacagagaactcaccatggagtttgggctgagcttgggttttccttgttgcttaattttaaaaggtgtccagtgtgaggtgcagctggtggaggtccggggagcttagttcagccgtgggggtccctgagacctctcctgtgcagtcctctggacttcgccttacaaattaactctaggatgctacgtcgggtcccgaccaagccgtaccggaagggggtaacggggcttaggtacgttttcggggtccttacgtaacgttaattaactagtttagagtgggagtacgcttacacactagtcggcggtacctcgtaggaacggtccgatttaccacctattcccgtaccgaagaacgaacccaaacgtacccgaaagaaaaccacgtacgttagtacttcgtaacggaactaaacgtcggaagtccgaacgacccgtaagggaaaacccgccccgggtaaacggaacccgtaccgggtacgtttacgggttaagttaaaccgtttacgcgggtttaagaaccgggaaacgggggttaccgggggacccaagggttacccttaaacgttaccccgtttacccctaacttacccccggttaccgtaaccgttacgggtaccgggg

SEQ ID NO: 203755 - DNA, 736 bp, Homo sapiens
  misc_feature: GYAE6OF01AYSVK.24.85.H08.1.454.CMB.1.raw
  modified_base (719)..(719): a, c, t, g, unknown or other
  misc_feature (719)..(719): n is a, c, g, or t
tcagactactatgtcacgaccggtgctcgatttagtatcactcagtcgcgggaggacgctgaccacacggtacgtgctgttgtactgctcctcccgcggtctttgtcttggcattatgcacctccacgccgtccacgtaccagttgaacttcgacctcgagggttcttcgtggctcaccgtccaccaccacgcatgtgacctcgacggggtccctgacgtactctctgtgcacgcctcgtcggtacttccgtccttactaaacttacttcgtaggtatcgaccgtaccggttcgggtcccgaccgaacgtccgttaccggaagggggacggggtcgttaggttacggtttcgggtccttaccgtaacgttaacgtttaacgttagttagggtaggttacggggtagttacgtacttaccaacgttactagtcggaacccgtacggtcccggtaagggtacgggtacctacttccgaacctcgtaccgtaccgaacgacgaacctaaccgaccgaacgaacctactacgttagtacttacgacgtaactaagtacgacgtacacgaccgtaaggaaccgccgacggaccgacgggtacttacggttagtacgttacgtggttacggaggacgggacgggaccacgtacctaaccgttccctaaccgttcgtaccgtcctacgtacggtaccggtacggtaccgggtacggtaacccgggnggtaacccgggtaccgg

SEQ ID NO: 203756 - DNA, 851 bp, Homo sapiens
  misc_feature: GYAE6OF01B0U5U.24.85.H08.1.454.CMB.1.raw
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcgagggtcttcgtggctcacgtccaccaccacgcatgtcgacctcgacggggtccctgacgacctctcctgtcgcagcctctggacttccgccttacaaacttacttcgtggatcgctacgtcgggtcccaccaagcctaccggaggggaacgggtctaggtagttttcggggtcctacgtaacggtttaacttaaacgtagtttaggaggttaggggaagtttacggccttacgaaccgtaacgttacgtcggtaccgggtaccttacccgggtaaggggaaaccgggtcccgtaactttacccgaaccctaacgttcccgtaacccgaaaggaaaccgaaacccgaaaccggacccgtaaaacggaaaacccctaaccgttaaccgtttaacggtttaaaccttaccgtaacggtaaaccgtaaaaagttcgggaacggtaacctaacgggtaaccccgtaaacgggaaacccgacccggtaaccggaaccgtacgggtcttaaggttacgttaacgttacgtggtaacgacgggaacggggtaccgggggacctacggttaccctaacgttttacccgtacccgtttaacgttaccccgttcccggtacgtttaaggtacccggggttaacccggtttaccggggtaacccgggggaacccgtaaaccggggggtaccccggttaacccgggg

SEQ ID NO: 203757 - DNA, 830 bp, Homo sapiens
  misc_feature: GYAE6OF01ECBZF.24.85.H08.1.454.CMB.1.raw
  modified_base (171)..(171): a, c, t, g, unknown or other
  misc_feature (171)..(171): n is a, c, g, or t
tcagactactatgtcacgaccggtgctcgatttagtatcactcagtcgcgggggagccccagccctgggattcccagctgtttctgcttgctgatcaggactgcacacagagaactcacatggagtttgggctgagcttgggtttttcttgttgcttaattttaaaaggtntccagtgtgaggtgcagtcgtgggtggacggtccgggggaggtctttagtcgagccggtcggggggtccctagacgactctccgtgtgcagccgttctggtacttccgtaccttacaaattaacttcgtaggatcggactacggtcgggtacccgaccaacggccgtaccggaagggggtaacggggtccttagggttaagttttcggggtaccttacggtaacgttaagtttaaacgtagtttaggaaggttacggggaagttacgacttaccaacaacgttagtacggaccgggtaccgtaccggtagggtaaaccggggtaccctaagtttacccaacccgtacttacccgtaaccgaaaggaacccggtaaaccgaaaacccggaaaccccaaaaacggaaaaacccaaccgttaaaccgttaacggttaacgttacccgtaaagtaaccgtaaaggtacggaacgccgtaaaccggtaccgtaaacgggtaaaccggaccccgggaaaccgtaccggaaaccgggttctttacgggttagtttaaccgttaccgttaggtaacgtaaccgggaaaggggtaccggggacccaggtaacccttaactttaacccgttacccgttaactacccggtaccgtacgtaggttacgggg

SEQ ID NO: 203758 - DNA, 742 bp, Homo sapiens
  misc_feature: GYAE6OF01DV2UU.24.85.H08.1.454.CMB.1.raw
tcagactactatgtcacgaccggtgctcgatttagtatcactcagtcgcgggggagccccagccctgggattcccagctgtttctgcttgctgatcaggactgcacacagagaactcaccatggagtttgggctgagctgggttttccttgttgcttattttaaaaggtgtccagtgtgaggtgcagctggtggaggtccgggggagcttagttcagccgtgggggtccctgacgactctcctgtgcagcctctggattcgccttacaattaacttcgtggatcgctacgtcgggtcccacgaagccgtaccggaggggaacggggctggtacgttttcggggtactacgtaacgttaattaacgtagtttaggagtagggtaagttacgcttacgaactaacgttagtacggaccggtaaccgtccgggtaaggaaaccgggtcccgtaacgtttaccgaaccctactacccgttaccgaaaggaaccgaaaccgaaacccgaacccgaaacggaaaacctaaccgtaaccgttacgtaacttaccgtaacgtaacgaaaagttggaacgaccgaacggtaccgtaaacggaaaccgacccggaacgaaccgtaacgggtcttacggttacgttaacgttacgtaggtacggtaacggaaacggggcgggggaacctaggtaacctaacgtttaccccgttacccttaaccgtaccgttacccgtagtacggttaccgggg

SEQ ID NO: 203759 - DNA, 895 bp, Homo sapiens
  misc_feature: GYAE6OF01DVOEM.24.85.H08.1.454.CMB.1.raw
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtgctcacgtccaccaccacgcatgtgaccctcgaggggtcccctgagaccttctcctgtgccacgcccttcgtggtacttccgtaccctttcaaaactttaaacctttccgtagggaattcggaccaaccgttcggggtccccgacccaaaggtcccttacccgggaaggggggaaacggggggtccttgggttaacggtttttcggggggttacccttaccgtaaacgggtttaactttaaaaccgtagttttaggggaacgtagggggttaagttaacgcctttaccaacctaccgttaagtcggaccggtaccgttccgggtaacgggaacgggtcccgtaatttcccaacccttactacccttaccgaaaggtaaacccgaaaccgaaacccggaccgaaaaccggtaaaacctaaccctaaccggtttacggtaacttaccgttaacgaaaccgtaaaagtcggtaacgacccgaacggtacccgtaagggaaaccgacccggtaacggaaccgtacgggtaccgttaggtttacttaacggtttaacgtcgggttacgaaccgggaacgggggccggggtacccaacgttaccgttaaacctttaaccccgttccttaaacccgtcccgttccccggtacgttaacgggttcccggggttaaccggttcccgggggaccggggaaaccccgggttaaacggggtaaccccgggtaacccgggg

SEQ ID NO: 203760 - DNA, 696 bp, Homo sapiens
  misc_feature: GYAE6OF01E0DRN.24.85.H08.1.454.CMB.1.raw
  modified_base (279)..(279): a, c, t, g, unknown or other
  misc_feature (279)..(279): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcgaggggtccctgagacctctcctgtgcagccttcgtggtacttcgccttacaattaacttcgtggatgcacgtcgggtccncaagcctacgaggggacggggctggtagtttcgggtctcgaacgttaataactagttgagtgggatacgctacactactagcggccggtacgtccggaggaaccgggccgtacttaccacctatacccgtacaggaacgaaccaaccgacctaacgaaaacctaccgtagttagtacctacgtacgaactaaagtcgacgactaacgaccgtaagaaccgacccgaacgaccggacggtccgttaggtacgtttacgtttaacgcgggttagaaccggaacgggggtccggggaccctaacgttacctaaaccgttttccccgtaacccttaaccgttacccggtccccgtaagttacggtacgggttacccggttcgggtaaccgggggaccctaaacggggccggttaacccggg

SEQ ID NO: 203761 - DNA, 717 bp, Homo sapiens
  misc_feature: GYAE6OF01EN6QC.24.85.H08.1.454.CMB.1.raw
  modified_base (319)..(319): a, c, t, g, unknown or other
  misc_feature (319)..(319): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtgctcacgtccaccaccacgcatgtgacctcgaggggtccctgagctctcctgtcgcagcctcgtggtacttccgccttacaaattaacttcgtggatcgcctacggttcggggtcccgaccgaacgccgttaccggaagggggtaacggggnttggtaggttttggggtccttaccgtaaacggtttaacttaaacgtagtttaggagtacggggtataacgtctaaccacgtatagtcggaccggtacgtccggtagggaacgggtcctacgttaccgaacctacgtcccgtacgaaggaacgaaaccgaacccgaccgtaaacgtaaaacccactaaccgttacgtaacgttacacgtaactaaaagtcgaacggtaacaccggttaacgaaacggaaccgaccggaaccgtacgacggtgttagtacgtacttacggtggacgaacgtaggggccggacagtaccgtaacttacccgttactacccgttacgccgtaacgtcggtacggtaccggtacggaccgggaacggaacccggtcgtaccgg

SEQ ID NO: 203762 - DNA, 755 bp, Homo sapiens
  misc_feature: GYAE6OF01E0TRK.24.85.H08.1.454.CMB.1.raw
  modified_base (353)..(353): a, c, t, g, unknown or other
  misc_feature (353)..(353): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgacttgacctcagggtcttcgtggctcacgtccaccaccacgcatgtgacctcgaggggtcccctgagacctctcctgtgcagcctctggtacttcgccttacaacttaccttcgtggatgcacgtcgggtcccaccaagtccgtaccggaagggggaacggggtcttaggttagttttcgggtcctaccgtaacgttaatttaaacgngtttaggagttaggggaacgtacgtctaccaacctacttagtcggccggtaccgttcggtacgggaacgggccttatacccacctacttccctaccgaagaaccggaaaccaaccgtaccgaaacgtaaaacccgactaacgtttgttaacctcgtaacgaaacgtaagtacggaactcgtaaccggtaccctaacgggaaaccgccccggtaacgaccggacgggttcctttaaggttacggtttaacgtaccggttagtaccggtaacgggaacggggtacggggcccaaggttaacctaaccgtttacccctacggttacctacccggtccgttacttaggtaccgggtaccgggttaccggtacgggggaacccggtaaaccgggacccgggtacggg

SEQ ID NO: 203763 - DNA, 772 bp, Homo sapiens
  misc_feature: GYAE6OF01CPOBY.24.85.H08.1.454.CMB.1.raw
  modified_base (158)..(158): a, c, t, g, unknown or other
  misc_feature (158)..(158): n is a, c, g, or t
  modified_base (230)..(230): a, c, t, g, unknown or other
  misc_feature (230)..(230): n is a, c, g, or t
tcagactactatgtcacgaccggtgctcgatttagtatcactcagttcggcgggaggacgctgaccacacggtacgtgctgttgtactgctcctccgcgtctttgtcttggcattatgcacctccacgccgtccacgtaccagttcgacttgacctcngggtcttcgtggctcaccgtccaccaccacgcagtgtcgacctcgagggtccctgacgtcctctcctagacnctcgtcctcgtggtacttcctcctttacaaacttactttccgaggtaacttcgacctaccggttcgggtacccgacccgaacgtccgtacccggaaggggtaagggtcttaggtacgtttcgggtacctacgtacgttaacttactagttggacgtgggagtacgtctacacgtactagtcggtacgtaccgtacggtacggaaaccggtccgtacttacccacgtactaccgttacgaacgacgaaccgaacgacgaacgaaccagtacgtatacgtactacgaacaaagttcgaagtacgtaaccgttaactaacggtaaccgtacccggaacggtaacccgtacgggttacgtttacggttacggtttaaccgttacggtaagggtcggttaacgggaacggggttaccgggacgtaacggtaccttaccgttaacccgttacctttacccggtacccgttccggtaacgttacggtaccggttacccgggttacggaacccggggttacccgaaccggggttacccggttaacccggg

SEQ ID NO: 203764 - DNA, 742 bp, Homo sapiens
  misc_feature: GYAE6OF01B6C3I.24.85.H08.1.454.CMB.1.raw
  modified_base (141)..(141): a, c, t, g, unknown or other
  misc_feature (141)..(141): n is a, c, g, or t
  modified_base (221)..(221): a, c, t, g, unknown or other
  misc_feature (221)..(221): n is a, c, g, or t
  modified_base (567)..(567): a, c, t, g, unknown or other
  misc_feature (567)..(567): n is a, c, g, or t
tcagactactatgtcacgaccggtgctcgatttagtatcactcagtcgcgggggagcccccagccctgggattcccagctgtttctgtcttgctgatcaggactgccacacagagaactcaccagtaggagtttgggctgngtcgttgggttttcttgttgtacttaagttttaaaggtcgtacagtggtgaggtgacagtcgtggtggacgggtcggggngtacttagtcgacggtccggtcgggggtccctaggtacgtaccttcgtccgtgtcgacgacgtccttcgtaggtacgttaccgttaccttactaacttaacttcgtaggtatcgacctacggtccggtacccgaccgtaacgtaccgtaccgggaggggtacgggtcgttaggttacggttttcgggtacttacgtaaccgttttaacgttaacgttaggttaggtagggttagggtaacgtacgtactacgtactagtacggcgtaccggtaccgtacggagggtaacgccgttacaccgtactactaccgtacgacggaaccacgaaacgacgaaactaaaccncgtaactgtttaacacctaagtaactaagtacgaaccgtcgaactaccggtaaacgaaaccgtacccggagtaccgaggttggtacttacgtacctaggtgaacccgggaggtaaacgggcgaacgactttaaccgtacctaccgtaaccctactacggtacttgacggttcggg

SEQ ID NO: 203765 - DNA, 764 bp, Homo sapiens
  misc_feature: GYAE6OF01DF94C.24.85.H08.1.454.CMB.1.raw
  modified_base (549)..(549): a, c, t, g, unknown or other
  misc_feature (549)..(549): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcgagggtcttcggtggctcaccgtccacccaccacgcatgtcgaccctcgaacggggtcccctggacgaccttccgtcccttggtcgccacggtcccttcgttgggtacctttccgtaccctttaactaaacgttacctttccgtaggaacttcggtacctaccggtcgggttccccgaccgaacggtccgtacccgggaaggggtaacgggtccttaggtacgtttcgggtactacgtacgttattaactagttgaggtggtagtacgctacacgtactagtcgacggtccgttccgggtaggaaccggccgtacttcccacgtactccgtaccgaagaccgaaccgaaccgacaaacgaaccaccgtagtacgtaatccgtagaacgttaangtaccgacgaccgaccgtaacggaaccggtccgaccggacgtccggtacgttggttaacgttacgttacgaggttaacggaacgtacggggaacggtccctaggtaacccttacgttcccccgttaacgttaacctacccggttcctaccggttagtaccggtcccggtttacggggacccgggtaaaccgggaacgggtcccggttaacccggg

SEQ ID NO: 203766 - DNA, 681 bp, Homo sapiens
  misc_feature: GYAE6OF01D1MAX.24.85.H08.1.454.CMB.1.raw
  modified_base (274)..(274): a, c, t, g, unknown or other
  misc_feature (274)..(274): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctcgtggacttcgccttacaattaacttctggatgcacgtcgggtccncaagcctaccggaggggacggggtctggtagtttcggggtcctacgtacgttaattaactagttagagtgggatagctcaactactagtcggcggtaccgtcggtaggaacgggtccgtaacttccaacgtactccgtaccgaagaacgaaccaaccgaccaaagaaaccactaacgttacgtactcgtacgactaaagtgacgaccgtacgaccgtagaaaccggtccgaacgaccgtacggtcttacggttaggttaacttacgtggtacggaacggaacggggtaccggggcctaaggtccctaacgtttacccgtaccccgttaactcctacccggtacgttacggcgggtaaccggttccggggaccggggaacccggtaacggggaccccgtaaccggggg

SEQ ID NO: 203767 - DNA, 805 bp, Homo sapiens
  misc_feature: GYAE6OF01DG4JO.24.85.H08.1.454.CMB.1.raw
  modified_base (313)..(313): a, c, t, g, unknown or other
  misc_feature (313)..(313): n is a, c, g, or t
  modified_base (700)..(700): a, c, t, g, unknown or other
  misc_feature (700)..(700): n is a, c, g, or t
tcagactactatgtcacgaccggtgctcgatttagtatcactcagtcgcgggggagccccagccctgggattcccagctgtttctgcttgctgatcaggactgcacacagagaactcacagtggtagtttgggctgagtcgttgggttttccttgttgtacttaagttttaaaggtcgtccgtaggtggtgaggtgccgagtcgtgggtgggtacgggtccggggtagtcgtttagtcgacggtccggttcgggggtcctaggacgtccttccgtcgtgcgcgtcgtccgtgtcggtacttccgtaccttaanaacttacgttcgtaggtactcgtaccgtcggtccggtacccaccgtaacggtccggtaacggaaggggtacggtcttcggttacggtttcggtaccttaacgttaacgtaatttacgtagttaggaggttagggactacgctacgactagtagcggacgtacggtacggacgaacggtactaccttaccgactaacgtccgtaacgaggaaaccgtacccgaaacccggaactaaaaccgtaaccacgtttaccgtaacggtataaccgtaacggtaaacgaacgttaccggaggtaaccctaaccggggtacgtaaaccgggaaacccgtaccccgggtaaacgaccggttacgtttagggtacttacccggtttaaggttaccgngggttaaaccggaccggggaaaacggggttccgggaccttagggttaccctaaacgtttcccaaacccgtttcgaacccgtccggttaggtacccgggtacgggg

SEQ ID NO: 203768 - DNA, 794 bp, Homo sapiens
  misc_feature: GYAE6OF01CYD6D.24.85.H08.1.454.CMB.1.raw
tcagactactatgtcacgaccggtgctcgatttagtatcactcagtcgcgggaggacgctgaccacacggtacgtgctgttgtactgctcctcccgcggtctttgtcttggcattatgcacctccacgccgtccacgtaccagttcgaacttcgaccttcagggtcttcgtggctcaccgtccaccaccacgcatgtcaccgtcgacggggtccctgacgtccttctccgtgtacgcctagtcccttcgtggtacttccgtacctttactaaacttaacctttcgaggtactcgctacggtcggtccgactaacggcctaccggaagggggaggtctaggtaggtttcgggtctacgttaccgtaattaacgtagtttggaggtgggtacttacggacctacgaacgtacgtagtccggacggtaccgttccgggtaggaaccggtctaacgttccacctacgtcctacgaacggtacaacccgaaacgaccgaaacgaaaccacgttaacgtactaacgtacgtagaacttaacgagacgacgtaccgtaccgtaaccgggaaaccgtccccggaaacgaccgggtacggtaccggtttatttaaggtttacctttaagggcgggtaacgtaaccggggacggggaccggtaaccgtaggtaccccttaggtttaccccccgttaaataacccccggttaccttaccggtacggtttaaccggtccggtttaaccccggggtacggggttaacccgggaacccgggtaaaccggggtccggttaaacccgggg

SEQ ID NO: 203769 - DNA, 754 bp, Homo sapiens
  misc_feature: GYAE6OF01A7RF2.24.85.H08.1.454.CMB.1.raw
  modified_base (223)..(223): a, c, t, g, unknown or other
  misc_feature (223)..(223): n is a, c, g, or t
tcagactactatgtcacgaccggtgctcgatttagtatcactcagtcgcgggaggacgctgaccacacggtacgtgctgttgtactgctcctccgcggctttgtcttggcattatgcacctccacgccgtccacgtaccagttgaacttgacctcagggtcttcgtggctcacgtccaccaccacgcatgtgacctcgaggggtccctgacgactctcctgtncagcctcgtgacttcgccttacaattacttctggatgacctacgtcgggtccgcaagtcctaccgaggggaacggggtctggtagttttgggtacctacgaacggttaattaactagtttagagttggggtaacgtacgtccgttccaacgtacgttaagtcggtacccggtaccgttccggtagggaaacggggtcctaacgttaccgaacctacgttcccgaccgaaaggtacggtaaacaacccggtacccaaagtaaaaccctactaccgttagtaaccttcgaggtaacctaaagtcggaacgcgaaaccgtaccgtaaacggaaccggaccccgtaacggaaaccgtccggttaccgttagtttacggttaacgttaaccggtttggacgtaaccgggaaggggtacgggggaccctaagggtcccgtttaaacttaccccggtacttaaccaccggtttccgacgttacgggtacggttaccgtccgggtaaccggggaaccggaaaccgggtccggttaccgg

SEQ ID NO: 203770 - DNA, 709 bp, Homo sapiens
  misc_feature: GYAE6OF01DOEMY.24.85.H08.1.454.CMB.1.raw
  modified_base (173)..(173): a, c, t, g, unknown or other
  misc_feature (173)..(173): n is a, c, g, or t
  modified_base (608)..(608): a, c, t, g, unknown or other
  misc_feature (608)..(608): n is a, c, g, or t
tcagactactatgtcacgaccggtgctcgatttagtatcactcagtcgcgggaggacgctgaccacacggtacgtgctgttgtactgcctcctcccgcggtcttttgtcttggcattatgccacctccacgccgtccacgtaccagttgaacttgacctcgagggttcttcgnggctcacgtccaccaccacgcatgtcgacctcgacggggtccctagagacctctcctggtcgccacgtccttcgtaggtacttccacctttacaaacttaccgttgtaggactcggactacggtcgggcccacgaacgtccgtacggaagggggacgggtctaggttacgtttcggactacttaacgttaacttaactgttaggaggtagggatacgctacaactacgtgtaccggacggtactccgggaaaggtaccggtcctactaccgaacctactttcccaacggaagaaaccgaaccgaaccggaacaaacgaaaaccctcgtaacgtttcgaactacgtaaaggaactaaaggtcgaacgactaaccgacctaaagggaacccgccggtacgaaccgttacgtcgtttaacgtaacgtttaacgtacgngggtaacccggaagaacgggggcgtaacacgttacttaacgttcccgacacgtaccgctagtaccggcggttacgacgggtacggaacccgtaaggcgtcg

SEQ ID NO: 203771 - DNA, 640 bp, Homo sapiens
  misc_feature: GYAE6OF01EF34Y.24.85.H08.1.454.CMB.1.raw
  modified_base (249)..(249): a, c, t, g, unknown or other
  misc_feature (249)..(249): n is a, c, g, or t
  modified_base (452)..(452): a, c, t, g, unknown or other
  misc_feature (452)..(452): n is a, c, g, or t
  modified_base (464)..(464): a, c, t, g, unknown or other
  misc_feature (464)..(464): n is a, c, g, or t
  modified_base (494)..(494): a, c, t, g, unknown or other
  misc_feature (494)..(494): n is a, c, g, or t
tcagactactatgtcacgaccggtgctcgattttagtatcactcagtcggcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcgacggggtccctgagactctcctgtgcagcctcgtggacttcgccttanaatacttctgatcgcacgtcgggtcccgcctaacgcgtccgaggggaaggggtcctaggtacgttttggggtcctacgtacggttaattacgtagttagagtgggagtagtctacacactagcggacggtactccggtaggaagggcctattccaccattccaccgaagaacgacaacgaccaagaaaccacactagtactgnaacaaatgacanacgactaggaaaccgccgaagaccacggtnttacggtagttaacttacggtggagaacggaaggggccgggtacctagaccttaacgtttaccctcgttaccgtaacccgttccgacgtttacggacgggtaccggttacccggagggggaacctaaaccggggtccgtaccgggg

SEQ ID NO: 203772 - DNA, 749 bp, Homo sapiens
  misc_feature: GYAE6OF01ASBBB.24.85.H08.1.454.CMB.1.raw
  modified_base (312)..(312): a, c, t, g, unknown or other
  misc_feature (312)..(312): n is a, c, g, or t
  modified_base (640)..(640): a, c, t, g, unknown or other
  misc_feature (640)..(640): n is a, c, g, or t
  modified_base (734)..(734): a, c, t, g, unknown or other
  misc_feature (734)..(734): n is a, c, g, or t
tcagactactatgtcacgaccggtgctcgatttagtatcactcagtcgcgggggagccccagccctgggattcccagctgtttctgcttgctgatcaggactgcacacagagactcacagtggagtttgggctgagtcgttgggttttccttgttgtcttaagttttaaaaggtcgtcctagtggtggaggtgcagcgttgggtgggacgggtccgggggagtcttaggttcgaggtccggttcggggggtccctggacgtaccttccgtccgtggtcgctacggtccttcgtggtactttccgacctttanaaacttacttcgtaggatcgacctacggtcgggtacccgaccgtaacggtccgtaccggtaagggggacgggtccttgggttacgttttcggggtcttacggtaacgtttaattaacgtagtttcggaagttacgggtaagttacgccgttacaacgtaactaggtcggtaccggtaccgtcgggtacggaacgggtaccctattaccgacctactccgtacgaagaacgaaccgacgtacaaacgaacctagtcctagtacttccgagaactaagtcaacgaccgaaggttcccaaaggtaccggaacccgtaagtaccgacggttnttacggttaattacgttagggtagaaccgggtaggtaacggggccgggaaccctgaccctttaacttacccgttctaaacccgtccgtttacgngttacggtaccgggg

SEQ ID NO: 203773 - DNA, 982 bp, Homo sapiens
  misc_feature: GYAE6OF01EDBIW.24.85.H08.1.454.CMB.1.raw
  modified_base (313)..(313): a, c, t, g, unknown or other
  misc_feature (313)..(313): n is a, c, g, or t
tcagactactatgtcacgaccggtgctcgatttagtatcactcagtcggcgggggacgccccagccctgggattcccagctgtttctgcttgctgatcaggactgcacacagagaactcaccatggtagtttgggctggagtcgttgggtttttccttggttgtcttaaagtttttaaaaggtcgtaccgtaggttggtaggtacggtgcgaggcgttggggtcgggacgggtccggggggtaggtcgtttaacggttcgacgggtccgggttcggggggttccctaggacgtaccgttcctccggtgtcgcncggtcctgtggtcttccgtcttactaacttacgttcgtggtacgtgtacgtccggttacgggtaccccgaccgtaacggccggtaaccggggtaaggggggtaacgggggtcgtttaacgggtttacgggtttttccgggtccgtttacccgtaaacggttttaactttaaaccgtaggttacggttaacggggtagggtaacgggtttaaccgtaccttaacgtaacccgttaaccgtacggtaccggggtaaccccggttaacgggttaccccgggaaacggggtaaccgggggtaccccgttaaacctttacccgaaacccgttacgttttacccgacccgggtaacggaaaacggaacccggaaaacccccgaaacccgtaaaacgtaaacccgtaacgtaacccgtttaggttacctacgtaaacgaacgttaaacgaggtaaccgtccggaaacgtacccgaaacgggaaacccggacccgggtaaaccgacccgggtacggttagttaaccggtttaattaacccggtttagtaaccggggtaccggagggtaaacccggggggtaagggtcccctaaacgttacggtttaaccccctaacccgtttaaccccgtttaacctcccgggtttaacccctagggttacggggttaaccccgggg

SEQ ID NO: 203774 - DNA, 809 bp, Homo sapiens
  misc_feature: GYAE6OF01BFDOX.24.85.H08.1.454.CMB.1.raw
  modified_base (650)..(650): a, c, t, g, unknown or other
  misc_feature (650)..(650): n is a, c, g, or t
  modified_base (721)..(721): a, c, t, g, unknown or other
  misc_feature (721)..(721): n is a, c, g, or t
  modified_base (736)..(736): a, c, t, g, unknown or other
  misc_feature (736)..(736): n is a, c, g, or t
  modified_base (790)..(790): a, c, t, g, unknown or other
  misc_feature (790)..(790): n is a, c, g, or t
tcagactactatgtcacgaccggtgctcgatttagtatcactcagtcggcgggggagccccagccctgggattcccagctgtttctgcttgctgatcaggactgcacacagagactcacatggtagtttggctgagtcgttgggttttccttgttgtactttaagttttaaaaggtgtacctaggttgtaggaggtgcaggtcgtggggtgggtacgggtccggggggtagtacgtttaggttacgacgggtcccgggttcggggggtcccttaggacgtccttccgtccgtaggtcgaccgacgtccgttagttacggtactttcccgtacctttaaccgtaaattttaaccgttggtacggtaagttccggaccgtaaccgggttccgggtacccgaccgtaaccggccggtaaccggggaaggggtaacgggtcttaaggtttcggttttaccgggtacttaccggttaaacgtttaattaaacggttggtaggtacggtaagggtactacgtctaacgactacgttaggtcggaaccggtccgtacgggtacggaacgggctaactaccgtactaccgtacgaacggaaacgacggtaaccaaccggtaaccaaacaacccgtatacgttaatcgtaacacgtaanaaagtcgacgacgtacgtacgaacggaccgacccgtaagaccggttagtacttaggtacttaagttacggnggtaacgaaccgggnggggtaaccgtacctacggtacgtttaacccttactccccgttaggttaacccncgttaaccggtggtaccgg

SEQ ID NO: 203775 - DNA, 751 bp, Homo sapiens
  misc_feature: GYAE6OF01DM5SM.24.85.H08.1.454.CMB.1.raw
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcgagggtcttcgtggctcacgtccaccaccacgcatgtgacctcgacggggtccctgacgacctctcctgtgcacgtcctcgtggactttccgacctttcaaacttaactttcgtaggactgcctacggtcgggtcccgaccgaagtccgtaccggaaggggtagggtctgttaggtttcgggtacctacgtacgttaattaactagtttggaggtgggaagtacgactaccgaactacgttagtcggaccggttacgtccggtaaggaccgggccttaacgttccacctacgtccctacgaaggtaacgaaccgaaccgaccaaacgaaactaccgtacgttacgtactacgtacgtaactaaagacgtacgaccgtaacggaccgtaacggaaccgacccggaaccgaccgtacggtacgttaggttaacgttacgtttacgtacggtacgaacggggtaagggaccggggacctaaccggtaccttaacgttaccccgttaccgttacccgttaccgttacccgtacggttacggtaccgggttaccggtaccgggtaccggggaacccggtaaacggggtcccgtacccggg

SEQ ID NO: 203776 - DNA, 562 bp, Homo sapiens
  misc_feature: GYAE6OF01DJ2NV.24.85.H08.1.454.CMB.1.raw
  modified_base (252)..(252): a, c, t, g, unknown or other
  misc_feature (252)..(252): n is a, c, g, or t
  modified_base (269)..(269): a, c, t, g, unknown or other
  misc_feature (269)..(269): n is a, c, g, or t
  modified_base (302)..(302): a, c, t, g, unknown or other
  misc_feature (302)..(302): n is a, c, g, or t
  modified_base (340)..(340): a, c, t, g, unknown or other
  misc_feature (340)..(340): n is a, c, g, or t
  modified_base (373)..(373): a, c, t, g, unknown or other
  misc_feature (373)..(373): n is a, c, g, or t
  modified_base (389)..(389): a, c, t, g, unknown or other
  misc_feature (389)..(389): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagacctctcctgtgcagcctctggattcgccttcaatacttcnggatgcacgtgggtccnccaagcctccgagggaagggctgatttgggctnacgtataacatgatgggatgctcacactatgcggtacncgtagaacggcctattcgacctatcctacaganacaacgcaacgaaacncactgtactctgacaaatgacgcagcctagaacgccgaacgacgacggctcggtagttaacttacgtgtacgtacgaaggacggggacctacggacctacgttacctaccgtaactaccgtcccgacgtagtacggtacgttacggcggggaccgaacgggacccgtaacggg

SEQ ID NO: 203777 - DNA, 679 bp, Homo sapiens
  misc_feature: GYAE6OF01EDZJP.24.85.H08.1.454.CMB.1.raw
  modified_base (498)..(498): a, c, t, g, unknown or other
  misc_feature (498)..(498): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtcgacctcgacggggtccctggacgacctcgtcctgtcgcacgtcctcgtggacttccgccttactaaacttaacttcgtggaattcggaccgacgttcgggtacccgaccaacggtcctaccggaagggggaacggggtcgttggtagttttcggggtcttacgtaacgtttaattaacagttggacgtggggtaatagctcacacgttacgcggaccggtcgtacggtagggacggtccgtacgttccacctatcctacgaagacgaacacgacaagaacacactgtactcgagaacaagtcgancgacgccaaggaaccgccgacgtacgacgtcttacggagttacttaggtcgtaacgacggaaggggcgggaccaacggtaccttaattacccctaccgttaacccgtcgtaacccgtacttaacgggacggttaccgggtcgggtaacccggggaaccggaaccgggccgggttacccggg

SEQ ID NO: 203778 - DNA, 688 bp, Homo sapiens
  misc_feature: GYAE6OF01BU4YQ.24.85.H08.1.454.CMB.1.raw
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctcgtggtacttcgcccttcaaataacttctggatcgcacgtcggggtccacaagctaccgagggggagggtctggtagttttggggtctacgtacgttattaaccgtagttggagtggggagtagccttcaactacttagtcggaccggtaccgttccggtagggaaacggggtccgtaactttccaaccgtacttccctaccgaagtaacgaaccaaaccggaccaaacgaaaccaaccgtacgtagttactacgtagaactaaaagtgaacgtcgaacgtaccgtaggaaaccgccgaacgacgtacggtctaggttacgtacgttacgtggtacgaacggaagggacggggacctagccttaaccgttaccctccgttaacccttaccctcccgtacgttacggttcgggtacccgttcggggaaccggggacccctaaagggggtcccctacggggg

SEQ ID NO: 203779 - DNA, 754 bp, Homo sapiens
  misc_feature: GYAE6OF01BMWUA.24.85.H08.1.454.CMB.1.raw
  modified_base (244)..(244): a, c, t, g, unknown or other
  misc_feature (244)..(244): n is a, c, g, or t
  modified_base (275)..(275): a, c, t, g, unknown or other
  misc_feature (275)..(275): n is a, c, g, or t
  modified_base (499)..(499): a, c, t, g, unknown or other
  misc_feature (499)..(499): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgacttgacctcaggtcttcgtggctcacgtccaccaccacgcatgtcgacctcgaggggtccctgagactctcctgtgcagcctctggacttcgccttanaattaacttcgtggatgctacgtcgggtccnccaagccgtaccggaagggggaacggggtctggtagtttcgggtcctacgtaacgtacttaacgtagttggagtgggagtacgctacacatcgtggccggacgtccggtaggaaccgggtactacttaccgacctacttaccgaccgaacggtaccgaaccaaccggacaaacggaaaccctaacgtacgtacgtaactccgtacgaactaaaacgtcggaacnccgaacggtacccgtaacgggaaaccgtcccggaaaccgtaaccgggtaccggtgttacggtaggttaaccgtttacgtggttacggaaccggtaaagggggccgggtaccgtaacgtacctttaacccgtttaaccccgtacccggtttaacctaaccccgggttcccgtaacgttaacgggttaccggggtaacccggttccggggaacccgggggtaacccggtaaccgggggtaacccggttacccggggg

SEQ ID NO: 203780 - DNA, 778 bp, Homo sapiens
  misc_feature: GYAE6OF01BWZBX.24.85.H08.1.454.CMB.1.raw
  modified_base (762)..(762): a, c, t, g, unknown or other
  misc_feature (762)..(762): n is a, c, g, or t
tcagactactatgtcacgaccggtgctcgatttagtatcactcagtcgcggggagccccagccctgggattcccagctgtttctgcttgctgatcaggactgcacacagagaactcaccatggagtttgggctgagcttgggttttccttgttgcttaattttaaaaggtgtccagtgtgaggtgcagcgtggtggaggtccggggagcttagttcacgccgtgggggtccctgagactctccgtgtgacacgtcctcgtggtacttccgaccctttactaaattaaccgttcgtaggtatcggaccgtacgtcggggtacccccgaccgtaacggtcccgtaccgggaagggggaacggggtctttagggttacggtttttacgggtcccttacgtaaaccgtttaaactttaaacgttagttacgggtagttaggggtagttacgtaccgtaccgaacgtaccgttagccgggtaccggttaacccgttccgggtacgggaaaccggggtcccgttaacttaccccgtacctaacgtttcccgaacccgaaaggaccgtaaaccccgaacccgtaccaaaacgaaaccctacgtaacttagtaactcgtaggtaaacaaaggtcgtaacaccgtacggtacccgtaaaggaacccggtccccgtaaaggcccggttagctttaggtacgtttaactaggtcggtaggaaccggaagggtccgggacctagacttaccgtttaccctaccgtacgtacccncggtaatcgggtacgg

SEQ ID NO: 203781 - DNA, 554 bp, Homo sapiens
  misc_feature: GYAE6OF01AM9UR.24.85.H08.1.454.CMB.1.raw
  modified_base (545)..(545): a, c, t, g, unknown or other
  misc_feature (545)..(545): n is a, c, g, or t
tcagactactatgtcacgaccggtgctcgatttagtatcactcagtccgggggaggcttagttcagcctggggggtccctgagactctcctgtgcagcctctggattcgccttcaataacttctggatgcactgggtccgcaagctccagggaagggctgatttgggtctcacgtattaacattgatgggatagctcacactatgcggactccgtgaagggccattcaccatctcagagacaacgccagaaacacactgtatctggaaatgaccagcctgagagtcgaggacacggctatgtattactgtgcgaccatactcagcacctggacgtcgcatcagaactacttccagcagttcggggaccagggccacccgtggtccaccgtcgtccctcacgcctccaccgaacgggccctaagtccggtccttcccccgtcgcctacccctcctccaacgacgcctaccgtcgtcggggccacgacgccggccgtcgggctcggcctggcgacgtacctaccgttccaacgtaagtacgtctagnggtaccggg

SEQ ID NO: 203782 - DNA, 774 bp, Homo sapiens
  misc_feature: GYAE6OF01CWN9T.24.85.H08.1.454.CMB.1.raw
  modified_base (582)..(582): a, c, t, g, unknown or other
  misc_feature (582)..(582): n is a, c, g, or t
  modified_base (658)..(658): a, c, t, g, unknown or other
  misc_feature (658)..(658): n is a, c, g, or t
  modified_base (684)..(684): a, c, t, g, unknown or other
  misc_feature (684)..(684): n is a, c, g, or t
tcagactactatgtcacgaccggtgctcgatttagtatcactcagtcgcgggggagccccagccctgggattcccagctgtttctgcttgctgatcaggactgacacacagagaactcaccagtggtagtttgggctgagtcgttcgggtttttcctttgttgtactttaaagttttaaaaggtcgtaccgtaggttggtaggagggtgacgagtcggtgggtacgggacgggtccggggggtagtcgtttacggtcgacgggccggtcggggggtcctaggacgtactcgtcgtgtgcgacgtcctgtggtacttccgtaccttataacttacgttgaggactcggaccgtcggtccggtacccgaccgacggtcccgacgggacggggtacgggtaccttaggtttaggtttcggtacctacgttaacgtttaagttaacgttagttagggtagtagggtaacgtacgttaccgacgtaaccgtagtacggtcggaccggtaccggtacggtaacgggaccggtaccgtactaccgtaccgtacgtcgtaacgaacggacaaccgaccgtaaaccgaaanaacccgtactacgtactacgtacgacgaaactaagcgaagaccgaacggtaacgaaggaaccccggagtacgacgngttacgttagtaccgttagtaccggngaacgggaacgggacgggaccgtactcggttaacctaacccgtttacccacccgttaacgtacccggtacgttacgggtcggttaccggg

SEQ ID NO: 203783 - DNA, 728 bp, Homo sapiens
  misc_feature: GYAE6OF01C6WY1.24.85.H08.1.454.CMB.1.raw
  modified_base (452)..(452): a, c, t, g, unknown or other
  misc_feature (452)..(452): n is a, c, g, or t
  modified_base (482)..(482): a, c, t, g, unknown or other
  misc_feature (482)..(482): n is a, c, g, or t
tcagactactatgtcacgaccggtgctcgatttagtatcactcagtcgcgggaggacgctgaccacacggtacgtgctgttgtactgcctcctcccgcgtctttgtctggcattatgcacctccacgccgtccacgtaccagttagaacttcgacctcgagggtcttcgtggctcacgtccaccaccacgtcatgtcgacctcgacgggtccctgacgctcctcgtgtgcacgtcctcgtggtacttccgtcctttacaaacttacttcgagggtactgaccgtaccggtcggggtccccaacaacggtcctaccgggaagggggtaagggtctaggttaacgtttcggggtacctcggtaaccttaagttaacgtagttaggacggttgggaatacgccttacgaactacgtgtcgcggtaccgtacgtagggacggtcctacttacactntcctacgatacgacaccgtacaagtaaccntacttgtactctacgacttaaagcgtacgacgtaacgtaccggtaacgaacccgtcccgaaacggtaccgtacggttcccgttaggttaacgtacggttacgtagggacggtaacggacgggaccgggtaccctaaggtcccgttaaacctccgttaacccgttacgaaccggttcccgagtttacggtacgggtcccggtaaccgggtaccgggtaacccgggacgggttacccggtaccccggg

SEQ ID NO: 203784 - DNA, 862 bp, Homo sapiens
  misc_feature: GYAE6OF01D6HTL.24.85.H08.1.454.CMB.1.raw
  modified_base (97)..(97): a, c, t, g, unknown or other
  misc_feature (97)..(97): n is a, c, g, or t
  modified_base (253)..(253): a, c, t, g, unknown or other
  misc_feature (253)..(253): n is a, c, g, or t
  modified_base (307)..(307): a, c, t, g, unknown or other
  misc_feature (307)..(307): n is a, c, g, or t
tcagactactatgtcacgaccggtgctcgatttagtatcactcagtcgcgggaggacgctgaccacacggtacgtgctgttgtactgctcctcccgnggtctttgtcttggtatatgcacctccaccgccgtcctaccgtaccgtagttagtaccttacgacctccgtagggtcgttcgtggctacacccgtccacccaccacgcatgtacgacctcggacgggtcccgtagagacctccttccgtgtcgacncgtccttcgttcggtattcccgtaccttaataacgttacttcgtagggacgttncccgtaacggtccgggtacccgaccgtaacgtccgtaccggaagggggaacggggtctagttacggttttcggtacgtacgtaacttacttaacgtagttgacgggtaggtacgtacgccttacaccgtagtacgtcggtaccgtaaccggttacggtacgggaacgggtacccttacttaacccgacctaccgtaaccgtaacccgaaagggaacccgtaaccgaaaacccgggtacaaaccgaaaaccgtaccgtaacggtaagtacccgtttaacgaacgtaacgttaaacgtaggaacggttaccgaacccgttaaacccggtaaggaaaaccggccccggaaacgacccggttacgggtaaccgttaggtttaacgttaaccgttaccgtaagggtacgggtaaccgaaccgggggtaaccgggccctaaaggtccttaaacccgttacccgttccgtaaacccgtttcggtaacccccgtgttaggggtaccccctaggggttacccgggccccggtaaacggaccggggtaaccgtccggttaacccg

SEQ ID NO: 203785 - DNA, 871 bp, Homo sapiens
  misc_feature: GYAE6OF01EPXZA.24.85.H08.1.454.CMB.1.raw
tcagactactatgtcacgaccggtgctcgatttagtatcactcagtcgcgggaggacgctgaccacacggtacgtgctgttgtactgctcctcccgcggtctttgtcttggcattatgcacctccacgccgtccacgtaccagttgaacttgacctcaggtcttcgtgctcacgtccaccacacgcatgtgacctcgacggggtccctgagactctcctgtgcagcccttcgtggtacttccgaccttacgaaattaaccttcgtaggatcgacctacggtcgggtcccaccgtaagccgtaccggaagggggtaacggggtcttaggttacgttttcggggtaccttaccgtaacggtttaacttaaactagtttacggaggttacggggtaagtaccgtccttaaccgtaacctacgtaacggtcggtaacccggtaccgttccggggtagggaaaccgggtcccttaacgtttacccgaacctacgtttacccacccggaaagaacccgaaaccgaaacccgaacccgaaaagtaaaacccctaccgttaacgttacggttaaccgtttaccgtaacggtaaacctaaaaggttaccgggaccgtaaccgaaccggtaaccggtaaacggaaacccgggtaccccgaaaccgggaacccgtacgggtcgtttaacgggttaacgttaaccgtttacgggtagggttaaccggaacgggaacgggggtaacccggggaacctaaggtacccgttaaacctttacccgtaccctttaaacccggtacccgtccggtaacgttaacgggtccgggttacccgttccggggtaaccggggaacccgtaaaccggggtaccggttaacccggg

SEQ ID NO: 203786 - DNA, 960 bp, Homo sapiens
  misc_feature: GYAE6OF01D9XHO.24.85.H08.1.454.CMB.1.raw
tcagactactatgtcacgaccggtgctcgatttagtatcactcagtcggcgggggagccccagccctgggattcccagcttgtttctgcttgctgatcaggactgcacacagagactcacatgggtagttgggctgagtcgttgggttttccttggttgtactttaaagttttaaaggtgtcctaggttgtggaggtgcgaggtcgtgggtgggacgggtacgggggacgttcgtttaacggttcgacggtccgggttcggggggtccctaggtacgtaccttcgtccgtgtcgtacgtaccgtccttcggtacggttacgtttcccgtaccttaacgtaaacgttttaaccttggtacggtagttccggaccgtaaccggttccgggtacccccggaccaacggggtacccgtaccggggtaagggggtacgggtacgtttcgggttaaccggttttcgggtacccttacggttaaacggtttaaacgttaaaagttaagtttaggggtaaacgggttgggtaacgtttaccggacttaaaccgaacgttaacttcgggtacggaccggttaccggtaccggggtaaggggaaccgggttacctaacgttacccaaccggttacttaccggtaaaccggaaccggaaaccgtaaccgaacccggtaacccaaaaacgtaacccggtaactaaccggtttaaggttaacctacgtaaacggtaacaacttgggaaacccaccggttaacgaaccggttaacgggaaacccggtaaccgttaaaccgggaccgttccggttacttacggttaacggtttaaccgtagggttaccgtaaggggaaccggggaaaccggggttaccgggaccgtaaacgttttaaaccgtccccgtttaaaccgttttccccctaaacggtttaaccccgggtacttaaaccgttcgggggttaaaccccggg

SEQ ID NO: 203787 - DNA, 746 bp, Homo sapiens
  misc_feature: GYAE6OF01AJVE0.24.85.H08.1.454.CMB.1.raw
  modified_base (375)..(375): a, c, t, g, unknown or other
  misc_feature (375)..(375): n is a, c, g, or t
  modified_base (463)..(463): a, c, t, g, unknown or other
  misc_feature (463)..(463): n is a, c, g, or t
tcagactactatgtcacgaccggtgctcgatttagtatcactcagtcgcgggaggacgctgaccacacggtacgtgctgttgtactgctcctcccgcgtctttgtcttggcatttatgcacctccacgccgtccacgtaccagttgacttgacctcgaggttcttcggtggactcgacgtccaccaccacgcagttcgtgacctcgacggggttccctggacgtaccttccttccgtggtcgcctacggcccttcgtgggtactttccgaccctttagaaactttacgttcgtggtactcgctacggttcgggtccacaacgccgtacgaaggggtacgggtctggttacgttggttccacgtacgtatttaacngttagagtagggacttagctacacgtatagtggaccgtacgtaccgggtagaacgggtccgtaacttccgacctagttcccagacganaccgactacgaacgaacacgacgtacgatacgtacgaactaacgtacgaggtaccgaacgtacccgtaaagaacccggtcccggaacgtaaaccggaccggttacggtacgttacggtttacgtttaaccgacggtttaacggaacggtacggggcgggtaactcggtaaaccgtacgttaacccgtttaccgtacccggttaacctccggtacgttaacggttaaccgggttcgtacccgggttaaacggggttcccggaaacggggtccgttaacccgggg

SEQ ID NO: 203788 - DNA, 732 bp, Homo sapiens
  misc_feature: GYAE6OF01DRGNK.24.85.H08.1.454.CMB.1.raw
tcagactactatgtcacgaccggtgctcgatttagtatcactcagtcgcgggaggacgctgaccacacggtacgtgctgttgtactgctcctcccgcggtctttgtcttggcattatgcacctccacgccgtccacgtaccagttgaacttgacctcgagggtcttcgtggctcacgtccaccaccacgcatgtcgacctcgaggggtccctgacgacctctcctgtcgacacgtccttcgtggtactttccgccttacaaacttaacttcgaggtaatcgactacgtcgggtcccaccgaacgccgtaccggaagggggtaacggggtcttgggttacgttttcgggtaccttacgtaacggttatttaaacgagttggaggtgggtaagtacgcctacgaacctacgttagtcgacccgggtaccgttaccgggtaagggtaaaccgggtccttaaacgttacccaacccgtaacttcccggtaaccgaacggtaaacgaacccgaaaccgccgaaaaaccgaaaccctcgtaacgttgtaaaccttcaagaacgtaaagtcgaacgaccaggttaacccaaggaaaccggccgaacgacgtacgtgttacgtagttactagtgacgtaacggaggggacggacctagcccttaacttaccgtacctaacgtcctccggattagggtccggtcggtacgggtaccgggaaccgtaggggccgtaacccgg

SEQ ID NO: 203789 - DNA, 640 bp, Homo sapiens
  misc_feature: GYAE6OF01ART4L.24.85.H08.1.454.CMB.1.raw
  modified_base (224)..(224): a, c, t, g, unknown or other
  misc_feature (224)..(224): n is a, c, g, or t
  modified_base (473)..(473): a, c, t, g, unknown or other
  misc_feature (473)..(473): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtgctcacgtccaccaccacgcatgtcgacctcaggggtccctgagactctcctgtgcngcctctggattcgccttacaatacttctggatgcacgtgggtccgccaagcctccggagggacggggtctaggtacgttttggggtctcgaacgttaattaacgattagagtgggtagtagctcgactacgtagtcggccggtacgtccggtagggaacgggtcctaacgttccaacctacgtcctaccaggaacgaaccgaaccgaccaagaaccacgtacgtagtactactagaactaaagtcgacncgacgaccgtacgaaccggccgaaccgaccacggtcgtaggttagtacgttactggtcgaaccgagggacggggacctagtacctaacgttaccctacccgttactaccgtccgttacgtagttcggtaccggttacggaccgggaccggaagggtcccggtacggg

SEQ ID NO: 203790 - DNA, 753 bp, Homo sapiens
  misc_feature: GYAE6OF01EG2AA.24.85.H08.1.454.CMB.1.raw
tcagactactatgtcacgaccggtgctcgatttagtatcactcagtcgcgggaggacgctgaccacacggtacgtgctgttgtactgctcctcccgcggtctttgtcttggcattatgcacctccacgccgtccacgtaccagttgaacttgacctcgagggtcttcgtggctcacgtccaccaccacgcatgtgacctcgacggggtccctgacgctctcctgtgcagcctcgtggtacttccgcctttacaaacttaacttcgtggatcgacctacgtcggggtacccaccaacgtccgtaccggagggggaacggggtcctaggttagttttcggggtcttaccgtaacggtttaatttaaccgagtttacggaggttaggggagttacgtctaccaactacgttagcggaccggtacgtccgggtagggaaccgggtcctaacttaccaacctactaccgaccgaagacgaaccgaaccacaaacgaaacctacgtactagttacgttacacgaactaaagtcggaacgccgaaacggtacccgtaaacggaaacccgtcccggaaaccggtaccgtaaccgggtctttaacggttaacggtttaaccgtttacggtacggtaacgtaacgggaacggggtaccggggtacacgtaccgttaacgtttacccgtacccgttaccgttacctcggtaactacggtcggtacgggttaccgacgggggaaacctcgggaaccgttaccggg

SEQ ID NO: 203791 - DNA, 780 bp, Homo sapiens
  misc_feature: GYAE6OF01BCS9X.24.85.H08.1.454.CMB.1.raw
  modified_base (485)..(485): a, c, t, g, unknown or other
  misc_feature (485)..(485): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcgaggggtccctgagacctctcctgtgcagcctctggtacttccgccttacaaattaacttcgtggatcgcacgttcggggtcccgaccgaacggcctaccggacgggggaaaggggtcttaggtagttttcggggtcttactacggtttaattaaccgtatttaggacgttagggaagttacgcctacaacacgttaagtggaccggtacgtaccggttaggaacggggcctacttaccgacctataccctcgaaggaacgtaccaaccggaccaaacgtaaaaccnccgtaacgttacggttaaacttcccggtaagtaacccgtaaagttacgggaacgtccgaaacgttcccgtaaaggaaacccggaccccggaaccggtaacccgtacgggtaccttagggttacctttagttaccgtttacgggacgaaccgggaacgggtacggggaccaacggtactaaccgtttaccgtttaaccccgtagttaaccgttcccggtaacgttaggtacccggggtaaccggttcccgggtacggggggaaccccgttaaaagggggccccgttaacccggggg

SEQ ID NO: 203792 - DNA, 765 bp, Homo sapiens
  misc_feature: GYAE6OF01COPJC.24.85.H08.1.454.CMB.1.raw
tcagactactatgtcacgaccggtgctcgatttagtatcactcagtcgcgggaggacgctgaccacacggtacgtgctgttgtactgctcctcccgcggtctttgtcttggcattatgcacctccacgccgtccacgtaccagttgaacttgacctcgagggtcttcgtggctcacgtccaccaccacgcatgtcgacctcgacggggtccctgacgacctctcctgtgctagcctctggtacttccgtacctttacaaattaacctttgtaggattcgacctaacggtcggggtaccccaccaaacggtccgtaccggaaagggggacggggtccttagggtacgttttggggtaccttacgtaaccgtttaagttaactagtttaggagttaggggaaattccgactacaaccgtaattagtcgaccggtacctaccgggtagggaaccggtacctactttacccaacctacgttcccaccgaaggaaccaccgaaaccgtccaaacgaaacctacactacgtactcgtagactaaagtgacgactacgccctaaggaaccgtcccggaacgaacccgtcggtacgttcgggttaactttaacgtttacggtggtaacggtaacggaacggggaccgggtaccaacgtacgtttaaccgttacccgttaccgtacccgttacccggtccgtaaccgttagggtcgggttaacccggttacggggaccgggggttaacccgaaacggggcccggttaacccggg

SEQ ID NO: 203793 - DNA, 631 bp, Homo sapiens
  misc_feature: GYAE6OF01BTK5J.24.85.H08.1.454.CMB.1.raw
  modified_base (275)..(275): a, c, t, g, unknown or other
  misc_feature (275)..(275): n is a, c, g, or t
  modified_base (459)..(459): a, c, t, g, unknown or other
  misc_feature (459)..(459): n is a, c, g, or t
tcagactactatgtcacgaccggtgctcgatttagtatcactcagtcggcgggaggacgctgaccacacggtacgtgctgttgtactgctcctcccgcggctttgtcttggcattatgcacctccacgccgtccacgtaccagttgacttgacctcagggtcttcgtggctcatgtccaccaccacgcatgtgacctcgaggggtccctgagactcctcctgtgcagcctgtggattcgccttacaatacttctggatgcctacgtcgggtcccnctaagcctaccgaggggacgggtctagtagtttcgggtactcgtaacgttacttaacatttggagtgggataggccttacactacgtatcggcggtacctccggtagaacggggcctattccacctatcaccgagacaaccgaaccgacctaaggaaccacgactcgtactcgtagaactaagngacgtcgacgtaccgtacggaaacgcccgacgaaccgcggtactaggtacgttaacttacgtggtacgacgaacgggcggggtacccaggttacctaccgttccgtacccttacgtacccgtccgtacttaggtcccggtacggtccggtcgggaccggaacgggtacccgg

SEQ ID NO: 203794 - DNA, 566 bp, Homo sapiens
  misc_feature: GYAE6OF01BAN7M.24.85.H08.1.454.CMB.1.raw
  modified_base (269)..(269): a, c, t, g, unknown or other
  misc_feature (269)..(269): n is a, c, g, or t
  modified_base (420)..(420): a, c, t, g, unknown or other
  misc_feature (420)..(420): n is a, c, g, or t
  modified_base (446)..(446): a, c, t, g, unknown or other
  misc_feature (446)..(446): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggattcgccttacaataacttctggatgcactgggtccnccaagctccgaggggagggctgtatttgggctcgacgtattacattgagtgggagtagctcacactatgcggactcgtaggaacgggcctattccactactcctaccagacgacaaccgcaacgaacacactgtactctagacaaatgacncaggccagaacgccgacgacgacggntacgtgtattactggacgacggaagggcggggaccaggctaacttaccgtcccttaacgtacctccgtcgttagtcgggaccgttcgggacggggaacccgaacggggtcccgtacgggg

SEQ ID NO: 203795 - DNA, 908 bp, Homo sapiens
  misc_feature: GYAE6OF01DGNN6.24.85.H08.1.454.CMB.1.raw
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccagcatgtcgacctcaggggtccctgacgactctcctgtcgcagcctctggacttccgcctttacaaattacttcgtggattgcctacgtcggggtccccaccgtaagccgtaccggaagggggtaacggggcttaggtaagttttcgggggtaccttaccgaacggtttaacttaaaccgtaagtttcggtaaggttaggggtaacgttaagccgttacaaaccgtaaccttaagtcggtacccggtaaccgttacccgggtaagggaaaccggggttccgtaaacttttacccaacccttaacgtcccgttaacccgaaggtaaaacggaaacccgaaaaccccgggtccgaaaaaacggaaaaacccctacccgtaaaccgtttacgggtaaaccttaccccggttacggaaaaccgttaaaaagttcccgggtaaacggaacccgttaaaccgggacccgttaaacgggaaaaccgggtcccccggaaacggtaacccggtacggggtacctttagggtttaccgtttaaactttaccggtgggtaccgtaacgggaacgggggttaccgggggccctaagggttacctaaacccgttttaaccgcccccgttttaaaccgttaaccccggttcccgtaaacgtttacggtcggggttaacccgttaccgggggtaacccggggtaaaccggaaacccggggggtcccttaaacccggggg

SEQ ID NO: 203796 - DNA, 1029 bp, Homo sapiens
  misc_feature: GYAE6OF01BZ5U8.24.85.H08.1.454.CMB.1.raw
tcagactactatgtcacgaccggtgctcgatttagtatcactcagtcggcgggggagccccagccctgggattcccagctgtttctgcttgctgatcaggactgcacacagagacctcgaccatggagtttgggctgagtcgttgggttttccttgtttcgtacttaaagtttttaaaaggtcgttacctaaggttggtaggaagggttggaccctaaggtccgttgggtacgggtaacgggttcccggggggaggttccgtttaacggttccgaacgggttccccgggttaccgggggggtttacccccgtaggtaaccggtaaccgtttcccgttcccgttcggtacgtacccaccggttacccgttccggttcggtaaccgttttcccggtacccttttaacgtaaacgtttaacccgttccgttagggtaacttcggacccgtacggttccggggtaccccaacccgaacggtccgtacccggggaagggggttacggggtcctttaggtaccggtttacgggttacctaccgtaacggtttaattaacgttaggttaggtagttacgggtaacgtttaacgaccgtaaccgtaacgtaacccgttaggtacccgggtaaccggttaacccggttacgggtacggggaaccgggtacccggttaactttaccccgaacccgttaacgttacccgttaaccggaaccggtaaaccgaaccccggtaaaaccccggaaccccaaaaaggttaaaccccgaacgtttaacggttaccgttaaaccgtttacccgacgtaaaaaccccgttaagccggtaaaccggtacccgtaacggtaacccgggttaaaccggaaaaccccgggaccggttttaaacccgaccgggtttaaacccgggttgttttaacgggtacttttaacgtacgttacggtaaccggacccgggtaaaggggtacccccggactactaaacgttcctttaacccgaacttacccgaacccgttcgtaaacgttcggggtaccgg

SEQ ID NO: 203797 - DNA, 854 bp, Homo sapiens
  misc_feature: GYAE6OF01CT0MN.24.85.H08.1.454.CMB.1.raw
tcagactactatgtcacgaccggtgctcgatttagtatcactcagtcgcgggaggacgctgaccacacggtacgtgctgttgtactgcctcctcccgcggtctttgtcttggctattatgcacctccacgccgtccacgtaccagttgaacttgacctcgagggtcttcgtggctcacgtccaccaccacgcatgtcgacctcgacggggtccctgacgctcctccgtgtcgcacgtccctgtcgtacttccgtcctttacaaacttaccgttcgtaggacttcgacgtaccggtcgggtacccgaccgaacggtccgtaccggaaggggacgggtcgttacgtaggtttcgggtccttacgtacgtttaacttaacgtcggtttaggaggttgggtaacttacgaccttacgaacgtactaggtccggaccggttaccggtaccgggtacggaaaccgggtccctttaaacttcccgaaccttaacgtcccgtaaccgaaacgggttaaccaaacccgaaccgaaccgaaacgtaaacccgacttaccgttaagtccgttaccagtaaaccaaggtcgacgaccgttaaccgaccgtaaacgggaccgtacccgacgtaaccggtcgttaccgttagtttacggtaccgtttaacgggtcggaacggtaacggggtaccggggtacccgggtaacctaagtacccgtttttaaaccccgttaaccgttcccccgttaaacgttttaccccggtcgttaacccgggttaacgggttcccggggtaaacccggggttccccgggtaacccgggggtaaaccccggtaaccggggttaaccccgggttaacccggg

SEQ ID NO: 203798 - DNA, 654 bp, Homo sapiens
  misc_feature: GYAE6OF01A29QS.24.85.H08.1.454.CMB.1.raw
  modified_base (542)..(542): a, c, t, g, unknown or other
  misc_feature (542)..(542): n is a, c, g, or t
  modified_base (558)..(558): a, c, t, g, unknown or other
  misc_feature (558)..(558): n is a, c, g, or t
  modified_base (578)..(578): a, c, t, g, unknown or other
  misc_feature (578)..(578): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcgaggggtccctgagacctctcctgtgcacgcctactggacttcgccttacaattactcgtggatcgcacgtcggtccgcagctaccgagggaacggggctggtaagtttcgggcctacgtaacgttacgttaaccgatttaggaacgttggggtaacgtaaggtcccttacctacctaaaccttagtcgggaccggtacgtcccgggttaagggaacgggtacccgtaagtttccaaccgtaactcccgtacgaaggacgactaaccgcctaagaaccactacgtgtaactctagaacctaagtacgaagtcgacgacgtacgaacgcccgtaagacgacggtntagtagtacgttacgngtacgacgaaggacgggacnggactacgttaccgtaccgtactaccgtccgacgtacgtacgggtacgtcggagggacccgaagggccgtaccggg

SEQ ID NO: 203799 - DNA, 754 bp, Homo sapiens
  misc_feature: GYAE6OF01AMNAC.24.85.H08.1.454.CMB.1.raw
  modified_base (282)..(282): a, c, t, g, unknown or other
  misc_feature (282)..(282): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtcgacctcgacggggtccctgagactctcctgtgcagcctctggacttccgccttcaaattaacttcgtggattgcctacgtcgggtcccnccaagcctccgaggggaacggggtctaggacgttttcggggtcctacgtaaccggttaatttaaccgagttttaggaacggttggggtaacgtacggcccttaccaacgtacttagtccggaccggtaccgtccgggtagggaaccgggtcctaacgtttcccgaaccgtacgtccccgtaaccggtaaggaaccaaccgaacccgaacctaaacggaacccacgtacgttacgtactacgtagaactaaacgtcggactacgaaccgtcgtaaggaaacccgccgaacgtaccgtaccgggtcttacggttacttaacgttcggtaggtaccggaacggtaacggggccgggtacctaggtaaccttacccgtttaccctaccgttacctcggtaccccgttacgttagggtacccgggtcggttacccggggaccggtaacccggggtaccggtacccgggttacccggg

SEQ ID NO: 203800 - DNA, 628 bp, Homo sapiens
  misc_feature: GYAE6OF01D6YWK.24.85.H08.1.454.CMB.1.raw
  modified_base (328)..(328): a, c, t, g, unknown or other
  misc_feature (328)..(328): n is a, c, g, or t
  modified_base (352)..(352): a, c, t, g, unknown or other
  misc_feature (352)..(352): n is a, c, g, or t
  modified_base (386)..(386): a, c, t, g, unknown or other
  misc_feature (386)..(386): n is a, c, g, or t
  modified_base (418)..(418): a, c, t, g, unknown or other
  misc_feature (418)..(418): n is a, c, g, or t
tcagactactatgtcacgaccggtgctcgatttagtatcactcagtcgcgggaggacgctgaccacacggtacgtgctgttgtactgctcctccccgcggctttgtcttggcatttatgcacctccacgccgtccacgtaccagttgacttgacctcaggtcttcgtggctcacgtccacccaccacgcatgtcgacctcacggggtccctgagactctcctgtgcagcctctggacttcgccttcaataacttcgtggatgctacgtggtccgccaagccgtccgaggggaagggctggtacgttttgggtctcgacgttattaacngttgagtgggatgctcacactagngacggactccggaggaacggcctattaccgaccntcctaccgaagacaacaccgaccaagaaaccncaactgttaactcgtagaactaagtcggacacgtacgacctaggaaccgcccgacgaccgtacgtgttggttattacgtttcgaggtcggaaccgagggggacggacctagtaccgtaacttaccgtaccctaccgtaccgttcccacttacggtacgggtaccggtaccgggttaggggaccccgttaaacggggcccgttaaccgggg

SEQ ID NO: 203801 - DNA, 780 bp, Homo sapiens
  misc_feature: GYAE6OF01C4RI7.24.85.H08.1.454.CMB.1.raw
  modified_base (666)..(666): a, c, t, g, unknown or other
  misc_feature (666)..(666): n is a, c, g, or t
  modified_base (685)..(685): a, c, t, g, unknown or other
  misc_feature (685)..(685): n is a, c, g, or t
  modified_base (762)..(762): a, c, t, g, unknown or other
  misc_feature (762)..(762): n is a, c, g, or t
tcagactactatgtcacgaccggtgctcgatttagtatcactcagtcgcgggggagcccagcctggattccagctgttctgcttgctgatcaggactgcacacagagaactcaccagtggtgtttgggctggagtcgttcgggttttcctttggttgtactttaagttttaaaacggtgtaccgtaggttggtgagggtgcaggcgttagggtgggagggttccggggggaagtcgtttaggttccgagggccggttcggggggtccctgacgtaccttccgttccgtggtccgacgacggtccgtgttaggtactttccgaccttaacgttaaataaccgttgtacggtatggacctacggttcggtaccgaccgtaacgccgtacggaacggggaacggggtctaacggttacggtttcgggtacctaacgtaaccgtttaagttaccgagttttaggaggttagggacggttacgtaccgtacgttacacggttaacgtggaacggtccgtttacggacgacgggtcttaactacctacgtacttacgacgacgaaccgaaccgaacacggtaaacacgtaactagtgtaacccgtaacggaacttagacgactacgggaacttaccgaacgtaaccgggccctaaggtaaccgacgggtttntacggttacttaacggttntaccgggtaacgaaggtaagggccgtaacgtcgttaaacccgttaacttccggtaacccttttacgaaccggttccnccggtttacggtacgggg

SEQ ID NO: 203802 - DNA, 786 bp, Homo sapiens
  misc_feature: GYAE6OF01BLO1S.24.85.H08.1.454.CMB.1.raw
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcgagggtcttcgtggctcaccgtccaccaccacgcatgtcgacctcgacggggtccctgacgactcctcctgtgcacgtccctgtggacttccgcccttataaacttaacttcgtaggattcgacctacggttcggggtcccaccgaacgtccgtaccggaagggggacggggtctaggttacggttttcgggtcctaccgttaaggttaacttaacgtgtttaggaggtaggggtaacgttagacctacgtaacgtacttacggcggtaccggaaccgttccgggaaggaaccggggtacctacttaccaaccgttacgtaccaccggaagtaccgaaaccgaacccgaacgaaacgaacctaccgtaacgtacgttactacgtacgaacgtaaacgtacgaacgaccgtacggaaccgtaacgggaaacccggaccggaccgaaccggtacggtacgttacgttacgtttaacgttacgttacggtacgggtaaccgggaacgggtaccgggggacctacgggtaccttaacctttaacccgtacccttaaccgtaccgtacccgtacgttacggtaccggttaccggtacggtaccggggaaccggtaacgggtacccggtaaccggg

SEQ ID NO: 203803 - DNA, 767 bp, Homo sapiens
  misc_feature: GYAE6OF01AXCJV.24.85.H08.1.454.CMB.1.raw
  modified_base (253)..(253): a, c, t, g, unknown or other
  misc_feature (253)..(253): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggattcgccttacaataacttcnggatgcacgtgggtcccgccaagcctccgaaggggaacggggctaggtagtttcggggtcctcgtaacggttaattaaaccagttttaggagtaggggagtagccttacactacgttagtcggaccggaccgttcccgggtaggaaaccggggtcccgtaactttacccgaaccctacgttacccgtacccgaaggtaaccgaaacccgaaacccggacccctaaaggaaaacccaaccgtaaccgttagttaacttcccgttacggaacctaaaagtacggaaccgacaacggtacccgtaagggaaacccggaccccggtaaccggaacccgtaccgggtacgttaggttacgttaacgtttaccgtaggttacggacggaacggggaccgggggtaccaacggtacctaactttacccgtacccttaaccgttacccgttcccgtacgttacggttcgggtacccggttacgggtaccggggaacccgaacggggtccccggtaaccgggg

SEQ ID NO: 203804 - DNA, 758 bp, Homo sapiens
  misc_feature: GYAE6OF01CKEN8.24.85.H08.1.454.CMB.1.raw
tcagactactatgtcacgaccggtgctcgatttagtatcactcagtcgcgggaggacgctgaccacacggtacgtgctgttgtactgcctcctcccgcggtctttgtcttggctattatcgcctacctcccaccgccgtccacgtaccgagttagaaccttgacctacgtagggttccttcggtcggtctaccaccgtccacccaccacgcagtgtccgacctcgacgggtccctagcgtacctctcctgtcgcacgtcctcgtgtaccttccgtaccttacgtaaacttacgttcggtaggattcgccgtaccggtccgggtacccgaccgaacgccgttaccggggaaggggtaacgggcttcggtacggtttaccgggtaccttaacctaacgtttaaacttaacgtgttaggaggtagggtacgtacgtacctacctactaacgttggaccgggttaccgtaccggttacggacggtaaccggtctactaccgtacttacaccgtacaacgacgtaccacgaccgtaaacaccgtacacgttacgtacgtacgaacgaactaaacggcggtaacgaccgtacgtacgtaaccgggaacctacccggaacggtaacccgtagtccgttagttaacgtcgttacggtgacgacgggtaacggcggactactagtacctaccgttaacgtcctaccgttccgtaaagtcggtaccgttacggtacggaccgggaaccgggaacgtccccggtaacgg

SEQ ID NO: 203805 - DNA, 787 bp, Homo sapiens
  misc_feature: GYAE6OF01A0TE2.24.85.H08.1.454.CMB.1.raw
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgacttgacctgagggtcttcggtggctcacgtccaccaccacgcatgtgaccctcgacgggtcctgacgacctctcctgtgcacgtccttcgtgtacttccgtccttacaattaaccttcgtggattcgacctacggttcgggccgtaccgaacggtccgtaccgggaagggggaacgggggtcctaggttacggttttcggggtacctaccgttaacggtttaacttaacgtagtttggtaacggtagggtaagtacgtacgtacctaaacgtcgttaacgtcggaccgggttaactacccggggtaggtaaccgggcttacttaaccgtacctattacccgtacgaggaaaccgtaccgaaccgaccgaaacgaacctaccgtaacgtacgttaacttaccgtagaaccgtagtaccggacgacgtaacgggacctaaaccgggaccgacccggaccggaccgtacgggtcttagggttaacttacggtttacgtacggtaacggacgggaacgggtaccgggaccgtacgtaccttaaccgttaaccctacccgttaactacccggtttccggacgttacgggtaccggttaccgggtccgggaaccgggtaacccggaaccggggtacccgtaccgggg

SEQ ID NO: 203806 - DNA, 806 bp, Homo sapiens
  misc_feature: GYAE6OF01ATO30.24.85.H08.1.454.CMB.1.raw
  modified_base (157)..(157): a, c, t, g, unknown or other
  misc_feature (157)..(157): n is a, c, g, or t
  modified_base (170)..(170): a, c, t, g, unknown or other
  misc_feature (170)..(170): n is a, c, g, or t
  modified_base (215)..(215): a, c, t, g, unknown or other
  misc_feature (215)..(215): n is a, c, g, or t
  modified_base (607)..(607): a, c, t, g, unknown or other
  misc_feature (607)..(607): n is a, c, g, or t
tcagactactatgtcacgaccggtgctcgatttagtatcactcagtcgcgggaggacgctgaccacacggtacgtgctgttgtactgctcctccgcggtctttgtcttggctattatgcacctccacgccgtccacgtaccagttgaacttgacctnagggttcttcggngctacaccgtccaccaccacgcatcgtcgacctcgacggggtccngacgcttctccgtgtgcagtcctgtacggacttccgtccttacacttaacttcgtggtactcgcgtacggttccgggtacccaacgacggtccgtaccgggtaaggggagggtcctaggtttacggttcgggtacttacgtagttaaacgttacaggtttagacggttaggtatacgactacgactacgtacgtggaaccgtcgttaccgggagaaccgggccttaacgttaccgaaccgtacgtaccgtacgaaaggaccgaaaccgtaccgaacggaacgtaaacccacgttacggtacttacgtaacgtacgaaccggttaaatcccggggaactaccgaacgggtaaccgtaacggaaacccggtcgggtaaccacggttaacccggngttttaacggttaacccgtaaggttttacgaccggggtagaaacccggggagggtttacccggggactaaccgttacgtttaacccgtacccgttaaccgttccggttaacccgtaccggttagttaaccggggttaccggttacccgggggttacgggaacccggggaaacccgaggggttaccccggggtaacccgg

SEQ ID NO: 203807 - DNA, 699 bp, Homo sapiens
  misc_feature: GYAE6OF01E0TNA.24.85.H08.1.454.CMB.1.raw
  modified_base (554)..(554): a, c, t, g, unknown or other
  misc_feature (554)..(554): n is a, c, g, or t
tcagactactatgtcacgaccggtgctcgatttagtatcactcagtcgcgggggagccccagccctgggattcccagctgtttctgcttgctgatcaggactgcacacagagaactcaccatggagtttgggctgagtcgttgggtttttccttgttgtctaattttaaaaggtgtccagtgtgaggtgcagctgggtggacggtccgggggagtcgttagttccgaggccgtggggggtccctggacgtactccttccgtgtgcacgccttcgtggactttccgacctttacaaacttaaccgttcgtagggtatcggactaccggttcggggtacccgaccgaaacgtccgtacccgggtaaggggtacgggggtccttaggttacggttttcgggtaccttacgtaacgttatttaacgtagtttggagtagggtatacgctaccgacgtactagtcgacgtaccgtccggtaggaccgggtctacttaccacgtactctaccgaagagaaccacgaccaaacgaaccactactgtactcgacaagtaagngaacgcaacgtaccgaaggaaccgccgaacgacctaacgtgtacgttagtacttacggtgtacggaacgggaacggggtacgggccaacggttacctaactttacccgtacccttaaccgtaccgtccccgtgtccgggtaccgg

SEQ ID NO: 203808 - DNA, 838 bp, Homo sapiens
  misc_feature: GYAE6OF01B6PX7.24.85.H08.1.454.CMB.1.raw
tcagactactatgtcacgaccggtgctcgatttagtatcactcagtcgcgggggagccccagccctgggattcccagctgtttctgcttgctgatcaggactgcacacagagaactcaccatggagtttgggctgagtcgttgggttttccttgttgtacttaagtttttaaaaggtcgttaccgagttggtaggaggtgcgaggtccggtgggtagggtacgggtaccggggggaggtacgtttacggttccgacgggtcccgggttcgggggggttcccctaggtacgtaccttcccttccgttggtcggaccgacgtcccgttcgtcggtactttccgtacccttacgtaaactttaaccttcgtaggtatcgtaccgtaccggttccgggtaccccgaccgaacggtcccgtaaccgggaagggggtaacgggtcgttagggtacggttttcgggtacctacgtaacgtttaactaacgttagttaggtacggtagggtaacgtacgtacctactaaccgtattaacggtcggaccggtaccgtaccggtacgggacggtacctacttaccgaccgtacttacccgtaccgaacgtaaccgtaaacccaaccggaaccaaaacgaaacaccctaagttacgtactcgaacgtaccgtaaagtcggaacgacctaacggtacccgtaacggaaacccggtaccggaacgtaaccggtcgtacggttagttacgttacgttaaccggtggtaaacgaccgggtaacggggaccggtccgaagttacccttaacgttacccgtacccgttactacccgtcctaggtccgtacccggg

SEQ ID NO: 203809 - DNA, 859 bp, Homo sapiens
  misc_feature: GYAE6OF01C21V7.24.85.H08.1.454.CMB.1.raw
  modified_base (487)..(487): a, c, t, g, unknown or other
  misc_feature (487)..(487): n is a, c, g, or t
tcagactactatgtcacgaccggtgctcgatttagtatcactcagtcggcgggggagccccagccctgggattcccagctgtttctgcttgctgatcaggactgcacacagagaactcaccatggtagtttgggctgagtcgttggttttccttgttgtacttaagttttaaaaggtcgtcctagttgtggaggtgcaggtcgttgggtacgggacgggtccgggggtagttcgttacgttcgacggtccggttcggggggtccctggacgtaccgttcgtccgtcgtcgtcgtcgtccgtcggtacggtacttccgttacccttaacgtaaacttaaccgtttcgtagggtaacttcgaccgttaccgggttacgggtaccccgtaaccgtaacggtccgtaacccggggaagggggtaccgggtacgtcggttaacggttttcgggtactacgtaaccgtttaaagttaacgtaggtaggtaggnggtaacgtcgactacgtaacgtacgttacgtcgtaccgtacgtcggaggtaacggcctagtaccgacctacgtctaacgacgtaacgtaaccaacgggtacaaacggtaaacctacgactttaggtaactacgtaacgaacgtaacggtacgtaacgacgttaacccgggtaacgtaaaccggaaacccgggaccgtaaccgggttaccgtaaccggggttacttccgggtttaaagtttacggttaaaccgtacggggtaccgaaaccgggggttaaaggggtaccccggggtactaaccggttaaccgtttaacccttaaccgttaccctaaccgtttccccggaacgttacggtaaggttaacccgggg

SEQ ID NO: 203810 - DNA, 790 bp, Homo sapiens
  misc_feature: GYAE6OF01E2AQ4.24.85.H08.1.454.CMB.1.raw
tcagactactatgtcacgaccggtgctcgatttagtatcactcagtcgcgggaggacgctgaccacacggtacgtgctgttgtactgctcctcccgcggctttgtcttggcattatgcaccctccaccgccgtccacgtaccagttgaacttgacctcgagggttcttcgtggctcaccgtccaccaccacgcatgtcgacctgacggggtccctgacgtacctctcctgtcgccacgtccttcgtggtacttcccgtccctttactaaatttaaccgtttcgtagggacttgacccgtaccggttcggggtccccaccggaacgccgtacccggaagggggacgggtctaggttacggtttcggggtccttaccgtacgttaacgttaaacgtggttacggaggttaggggtaggtacgtcgtacctagtactagtcggacggtaccgtccggtaagacgggtcctactaccactagttaccctaccgaggtacaaccgtaaccgacccaagaacccacgacttgtacctacggtacaacgtaagtagacacgtaaccgactaacgggaaccgaccgaacccgaagggacccggttcgttagggttaacccgtttaattcggtacgggttacgaacccggggttaacggggacgggtaaccctgtaaacccgttaatttacccccgtacccgtttaacggttaccccggtccttaaccggttagggtaaccccggttcgggtacccgggtaccgggggaaacccgtaaccgggtaccggggtaccccgg

SEQ ID NO: 203811 - DNA, 804 bp, Homo sapiens
  misc_feature: GYAE6OF01DB1Y6.24.85.H08.1.454.CMB.1.raw
  modified_base (455)..(455): a, c, t, g, unknown or other
  misc_feature (455)..(455): n is a, c, g, or t
  modified_base (482)..(482): a, c, t, g, unknown or other
  misc_feature (482)..(482): n is a, c, g, or t
tcagactactatgtcacgaccggtgctcgatttagtatcactcagtcgcgggggagccccagccctgggattcccagctgtttctgcttgctgatcaggactgcacacagagaactcaccagtgggtaggtttgggctggagtcgtttcgggttttcctttgttgtacgtttaaagttttaaacgggtcgtaccgtaggttggtggtagggtgcgaggtcggttggggtaggggtacggggtaccgggggggtaggttacgtttacggttcgacgggtcccggggttcggggggtcccttaggaacgtccttccgtcgtgcgcacgtccgtgtcggtacttccgtaccttactaacttacgttcgtaggtactcggacgtacgggtcggacccaacggtacgccggacgggaaggggtacggtctggttagttcggtactacgtagttaatagtntaggaggtggtatactctacgaacgtntaggtcgaccggtacgtcgggtaacggaccggtactaccgtacctaccgtacgtaccgtaaccgaaacggaccgaaccgtaaccgaaccaaacgaacccgtacttacgtaacgttactacgaacgtaataacgtcggaacgtaccgaacgtacgaaccgaacccggaccgaacgtaacccgggtgttaccggtagtttaacggttccttaacgggtcgaacggggaacgggtaaccggggtaccggactaccggttacccttaaacggttacccccgtcgtttaaccccgaaccgggttccctaggttaaccgggttaccgg

SEQ ID NO: 203812 - DNA, 892 bp, Homo sapiens
  misc_feature: GYAE6OF01AR4U8.24.85.H08.1.454.CMB.1.raw
  modified_base (291)..(291): a, c, t, g, unknown or other
  misc_feature (291)..(291): n is a, c, g, or t
tcagactactatgtcacgaccggtgctcgatttagtatcactcagtcgcgggggagccccagccctgggattcccagctgttctgcttgctgatcaggactgcacacagagactcaccagtggagttggctgagtcgttgggttttccttgttgtacgttaagttttaaaaggtcgttcctaggttggtaggaggttgcgtagtcgtgggtgggacgggtccgggggtagtccgtttacggtcgacggtccggttcggggggtccctaggtacgtaccttctccgtagtcnccgacgtcctgtacggtacttccggtaccttactaacttaccttcgtaggtactcgtacgtaccgggtcgggtaccgacctaacggtccggtaccgggacggggacggggtaccttgggtacggttttacggtcctaccgtaacgtttaacttagtacgttaggtagtacggtaagttcgtacgtacctaactacgttacggtcggtaccggtaccgtccggtaacgggtaccgggtaccgttactaccgtaccgtacgtcccgaacggtaacgtaccgaaaccgacccgtaagaaaacccgtaacctacgtacgttcgttaacgttaccggaaccgtaaacgttaacggacggtacacccgggttaaacacccgggtaaacggaacccggacccggaaccgttaacccggtcgggttacccggtttaagtaccgggttttaaaaccgttcgggaccgttaaccgggggaaacggtccgggggttaaacccgggggaccttttaaacgggtacccgtttaaacccggtttaccccgttaaaccgtaaccccggttttaccccggttaaccggttccgggtaaacgggttaacccccggggg

SEQ ID NO: 203813 - DNA, 848 bp, Homo sapiens
  misc_feature: GYAE6OF01EGHC8.24.85.H08.1.454.CMB.1.raw
tcagactactatgtcacgaccggtgctcgatttagtatcactcagtcgcgggaggacgctgaccacacggtacgtgctgttgtactgcctcctcccgcggtctttgtcttggcattatgcacctccaccgccgtccacgtaccagttagaacttcgaccttcgacgggttcttcggtcggcctcaccgtccaccaccacgcatcgtcgtacctcggacggggtccctgaacgtccttcctccgtgtcgcactcctcgtggtacttccgtaccttactaaattacctttcgtaggtatcggacgtaccggttccggggtacccgaccgtaacggtccggtacgggaacggggggtaacgggtcgttacggtttacggttttcggttaccgttaaccggttaacgtttaactttaaacgttggttaggtaacgggttaggggtaacgtttacggacctacctaacgttaacgttacggtaccggggttacggtaacccgttccggggttaaacgggtacccgggtaccgttacttacccgaacgttacgtaccctaaaccggaacgaaacccgaaaccggaaacccaccggtaaaacgtaaaccgtaaccgtaaacgtttcgtaaaccgttacgtaaacgtaaacgtaaacgtaacggaacgtaacccgaacggaaccgtaacgggaaccccggaacgaaccggacgtaccggtacgtttacggttacggtttactacggttaggtacgaccgggaagggtaccgggactaccgtacttaccggttacctaccgttactaccggtcgacgtcggacggtcgtacgggacggacgtaacgggtcgtaccgg

SEQ ID NO: 203814 - DNA, 796 bp, Homo sapiens
  misc_feature: GYAE6OF01C8O8T.24.85.H08.1.454.CMB.1.raw
  modified_base (480)..(480): a, c, t, g, unknown or other
  misc_feature (480)..(480): n is a, c, g, or t
tcagactactatgtcacgaccggtgctcgatttagtatcactcagtcgcgggaggacgctgaccacacggtacgtgctgttgtactgctcctcccgcggtctttgtcttggctattatgcacctccacgccgtccacgtaccagttgaacttgacctcgagggttcttcggtcggctcaccgtcccaaccaccacgcatgtacgaccgtcggacggggtccctaggacgtaccttccgttccgtggtcggacctacggtcccttcgtcggtactttccgccctttaacgaaacttaaccttcgaggactcgactacggtccgggtccgaaccgaacgccgtaccgggaaggggtacgggtacttggtacggtttcgggcttaccgtaacgttaattaacgtgtaggtagtagggtactacgcttacgactacgtagtcggaccgtacgtacggtaacggaacggtccgtactaccgactntaccgtacgaacgaacgtaccaacccgaactaaaccggaacctaccgtaagttacgtaacgtacgtaacgaactaacgtaggacctaacggacgtaacccggaacggtaaaccggacccggtaacgtaccgtacgggtacgtttacggttaacgttaaccgttacggttacggacggtaaccggggtaacgggaccggggtaacctacgggtaacccttaacgtttaccccgtaaccttaccctccgtaccgtacgttcgggttacccggtacgggtacggtacccggggaacgggaaccggtccgggtacccggg

SEQ ID NO: 203815 - DNA, 690 bp, Homo sapiens
  misc_feature: GYAE6OF01B4OIQ.24.85.H08.1.454.CMB.1.raw
  modified_base (172)..(172): a, c, t, g, unknown or other
  misc_feature (172)..(172): n is a, c, g, or t
  modified_base (243)..(243): a, c, t, g, unknown or other
  misc_feature (243)..(243): n is a, c, g, or t
  modified_base (275)..(275): a, c, t, g, unknown or other
  misc_feature (275)..(275): n is a, c, g, or t
  modified_base (530)..(530): a, c, t, g, unknown or other
  misc_feature (530)..(530): n is a, c, g, or t
  modified_base (588)..(588): a, c, t, g, unknown or other
  misc_feature (588)..(588): n is a, c, g, or t
  modified_base (613)..(613): a, c, t, g, unknown or other
  misc_feature (613)..(613): n is a, c, g, or t
tcagactactatgtcacgaccggtgctcgatttagtatcactcagtcgcggggaggacgctgaccacacggtacgtgctgttgtactgctcctcccgcggtctttgtcttggcatttatgcacctccacgcccgtccacgtaccagttgaacttgacctcgagggtcttcgngctcacgtcccaccaccacgcatgtcgacctcgacgggtccctggaatcctctcctggtgcacgcctttgnggtactttccgaccttacaaattacgtttcgnggattcgaccgtacggtccgggcccgaccgtaacgccgtaccggaaggggtaacggggtcttggtaagtttcgggtacttacgtaacgttaattaactagtcgaggtggatacgctacataccgttagccggtacggtactccggaagggtaaccggtccgattacccgaactccgtacaccgtaacgacgaccgtaaccgaccgtaaacgaaaccgacaacgttgtaacctactaaacggaactaaagcggaanaaccgacgtaccgaacggaacccgtacgaaccgaaccgtacgtcctttagaacgtttntacggtacgtgaacggtaacggggngaccgtataccgtaacttaccgtcgtacctcgcgtacgtcgtacggacgcgggtacggaaccggacggtcggtaccg

SEQ ID NO: 203816 - DNA, 828 bp, Homo sapiens
  misc_feature: GYAE6OF01EHIRC.24.85.H08.1.454.CMB.1.raw
  modified_base (192)..(192): a, c, t, g, unknown or other
  misc_feature (192)..(192): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcaggtcttcgtggctcacgtccaccaccacgcatgtnacctcgaggggtccctgagactctcctgtgccagcctcgtggacttccgtcttacaaattaactttcgtggatcgcacgtcggggtcccaccaagcctaccgaaggggaggggcttggtagtttgggtcctacgtacgttaattaacagtttcggaggtaggggtaagtagtcctacaactacgttagtcggacggtacccgtccggtaggggaaaccgggtccgttaactttaccgaccctaagttccctacccgaagggtaaaccgaacccgaaacccgggaccgaaaacgaaaccctaaaccacgtttaacggttacttaacgtacggtaaacgtaaacgtacgggtaaacgacccgtaacgtacccccggttaaaggaaaacccgggtcccgaaacccgggtaccggacccggggttacgtttaacggtttacggttaactttaacgggttacggtaaggaacccgggaaaggggtacccgggggacctaaccggtaacttaccggtttaaacccctacccgtttaaccccgtttaccgtacccccggttacgtttaacgggttacccgggtacggtttaccggggaacccgggggtaaccccggtaaacgggggcccccgtaaacccgggg

SEQ ID NO: 203817 - DNA, 895 bp, Homo sapiens
  misc_feature: GYAE6OF01EV70V.24.85.H08.1.454.CMB.1.raw
  modified_base (174)..(174): a, c, t, g, unknown or other
  misc_feature (174)..(174): n is a, c, g, or t
  modified_base (185)..(185): a, c, t, g, unknown or other
  misc_feature (185)..(185): n is a, c, g, or t
  modified_base (362)..(362): a, c, t, g, unknown or other
  misc_feature (362)..(362): n is a, c, g, or t
tcagactactatgtcacgaccggtgctcgatttagtatcactcagtcgcggaggacgctgaccacacggtacgtgctgttgtactgctcctccgcggtctttgtcttggcattatgcacctcacgcgtcacgtacagttgacttgacctgaggtctgtgctcacgtcacaccancatgtcgaccnggtacgggtcctgaacgtcctcgtaccgtgttacgcctacgtccttacgtaggtactttccgacttacgaatttactagtcggatcggtaccttacgtcggggacctaccgaagtcgtacggaagggggtacgcttagggttacttcgggtactaacgttaacgttaacttaaacgnggtttacggacgggtttacggtaacgtacgtaccgtttaccgaagttaccttaacgggttcggaacccggttaacgtttacccgggggtaaaaggtaccccgggggttacttttaaccggtaaccctaacgtttaaccgtacccggttaaacgggaaaccgtaaccgtaacccaaaccgggaaccgtaaacgtaaaccctaccggttaccgtaagtttaccgttaccggtaaacgtaaccgtaaaggttacgaaccgggtcgttaaaacccggttacttaaaaccggggaaccccggacccgggttaaacgtaaaccccggtcgggttttaaccgtaagggttttaaacccggtaagttttacccggacgggttaacggtaacccgggtaacggggaaaccggttaccggtaactttaaaccgtaacccggtttaacgttaacccccgttaaattccccgggtaactaaacggttacgggttaccgaaccggggttttccgaagggaaaccccggtggttaacccgtaccggg

SEQ ID NO: 203818 - DNA, 965 bp, Homo sapiens
  misc_feature: GYAE6OF01CLK8J.24.85.H08.1.454.CMB.1.raw
  modified_base (884)..(884): a, c, t, g, unknown or other
  misc_feature (884)..(884): n is a, c, g, or t
tcagactactatgtcacgaccggtgctcgatttagtatcactcagtcgcgggaggacgctgaccacacggtacgtgctgttgtactgctcctcccgcggtctttgtcttggctattatgcacctccacgccgtccacgtaccagttgaacttgacctcgagggttcttcggtggctctaccgtccacccaccacgcatgtcgacctcggacggggtccctaggacgtaccttccgttccgtggtcgccgtacgtcccttcggttacggtacctttcccgtacccttttaacaaacgtttaaccttttcggtaggtacttcggcctaaccgggtttccgggtaccccgtaccctaaagtccccggtacggggaaacgggggtacggggtcttacgggttaaggttttccggggttccttaaaccggtaaacttttaaaccgtttaaacgtagtttaacgggtaggttacgggggttaaacttcgaccccttaacgaacctaacgttacgtaccgggtaccggtaaccgttaccggggttaacggggaaaccgggtacccctttaactaacccgtaaccgtaccgttaccccgaccggtaaacggaaaccacccgaaaacggtaacccgaaacgaacccgtaaaccgttacgttaacgtaccttacgtaacgtaaaccgtaagtaccggaacgtaccgtaacggaaccggtaaacgaacccgggaccgtaaccgggtaacccgtacggttttaccgttacggtttaacggttaacctttaagggtaccggttacgggtaaaccgggacgggggttaacggggaccccgtaataacccggtttacccgtaaccctttacccgttaaacccgtccggtaccccggttnttaaaccggggttcccgggttaacgggtacccggggtaacccggggaaccccgggtaaccggggttaacggtacccccggg

SEQ ID NO: 203819 - DNA, 809 bp, Homo sapiens
  misc_feature: GYAE6OF01DASDU.24.85.H08.1.454.CMB.1.raw
tcagactactatgtcacgaccggtgctcgatttagtatcactcagtcgcgggaggacgctgaccacacggtacgtgctgttgtactgctcctcccgcggtctttgtcttggcatttatgcacctccaacgccgtccacgtaccagttgaaccttgacctctagggttcttcgtgctcacgtccaaccgaccacgctagtcgtacgacccgtcgacggggtccctagaacgtaccttccgtcctacggtcgacgaccgtcctacgtggtacttccgtaaccttacaaacgttaccgttcgaggtactcgtaccgtaaccggttcgggaccccgaaccgtaaaggtcccgtaacggaacgggggtaaggtaccttaggtttaggttttaccgggtacctaacggtttaaaacgtttacttaaacgttagtttacggtacgggttacggtaacgttacgccttaacgaaccgttagttacggtccggtaccggtaccgtttaccggaaaggggtaacccgtacctttaagttacccccaaacttccgttaccgaaccgaacgttaaccggaaaccaacccgtaaccgaaaacgtaaacccgtgtaaacccgtttgaactttcgaacggtaaacaacgtgggcctacggaccgtaacggtaacgaaccgacggtacgacgttcgtacgtagtttacgtagtacggtgtaaccggaggttaaacgggcgacttaacgacctttcgttaaccctcgtacgtacccgtagcgttacgtccggtaccggtaggaacccgaccggaacgttccggacg

SEQ ID NO: 203820 - DNA, 781 bp, Homo sapiens
  misc_feature: GYAE6OF01DIESG.24.85.H08.1.454.CMB.1.raw
  modified_base (592)..(592): a, c, t, g, unknown or other
  misc_feature (592)..(592): n is a, c, g, or t
tcagactactatgtcacgaccggtgctcgatttagtatcactcagtcggcgggaggacgctgaccacacggtacgtgctgttgtactgcctcctcccgcggtctttgtcttggcattatgcacctccacgccgtccacgtaccagttgaacttgacctcgagggttcttcgtgctcaccgtccaccaccacgcatgtcgacctcggacggggtccctggaacgtccttccgtcctcggtcggccacgtcccgttacgtggtaccttccgtacccttaacaaacttacgttcgtggacgtcgaccgtaccggttccggggtacccctaccgtaaacggccgtaccggggaacgggggaacggggtccttggttaacgggttttcggggttccttaaccgttacggtttaaaatttaaccggtagtttcgggtaaggtaggggacgttaacgcctacgaccgtaacgtgtacggcccggtaacgtccgggtaagggaacccgggtcccgttaatttacccaaccgttacttcccgtaaacgaacgaacggaccaaccggacccaaacgaactaccgtaactacgtactcgtaanaactaaggtcgaacgtcaaccggtccaaaggaaccgaccggaacgacgtacggtcgtaagttacgtgttacgaggtacgaaggacgggacgggtactcggtaaccttaccgttacccttaccgttaccttacgtaccgtacgtacggcggtaccggttcgggaccgggaccggaccggtacgggtaccg

SEQ ID NO: 203821 - DNA, 765 bp, Homo sapiens
  misc_feature: GYAE6OF01AVT7N.24.85.H08.1.454.CMB.1.raw
  modified_base (506)..(506): a, c, t, g, unknown or other
  misc_feature (506)..(506): n is a, c, g, or t
  modified_base (548)..(548): a, c, t, g, unknown or other
  misc_feature (548)..(548): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcgacggggtccctgacgactctccgtgtcgcacgtcctcgtggtacttccgtccttacaacttaacctttcgtggatcgccgtacgttcgggtacccgaccgaacgtccgtaccggaacgggggaacggggtcgttggttaggttttcggggtaccttaccgtaacgttaatttaactagtttaggagtaggggtagtacgtctacacgtacgtagtcggaccggtacgtaccggtagggaacggtccgtacttaccgacctactaccctacgaacggaacgaaccgaacccgaccgaaacgtaaaccnccgtaacgttcgtaacttccgaagaacgtaaacgtcggaacncccgtaaggtaacccgtaaacggaaccggacccggaacgtaccggacgggttcttagggttacttacgttacgtcgggtaacgacgggtaacggggccggtacaacgttccgtaacctttcccggtaaccctccgttaaccgtccggaacgttttacgggaccgggttaccgggtcgggtaaccggggaaacccggtaacgggtcccggtaacccgg

SEQ ID NO: 203822 - DNA, 953 bp, Homo sapiens
  misc_feature: GYAE6OF01BD1DO.24.85.H08.1.454.CMB.1.raw
tcagactactatgtcacgaccggtgctcgatttagtatcactcagtcgcgggaggacgctgaccacacggtacgtgctgttgtactgctcctcccgcgctttgtcttggcattatgcacctccacgccgtccacgtaccagttgaacttgacctcgagggtcttcgtggctcaccgtccaccaccacgcatgtcgacctcgacggggtccctgacgactcctctgtgcacgcctcgtggtacttccgtaccttactaaattaaccttcgtggatcgaccgtacgtcgggtcccaccgaacgtccgtccggaaggggaacggggtccgtaggttacggttttcgggtacctaccggtaacgttaacttaaaccgtagtttaggtaaggttaggggtaagttacgtcccgttactaaccgtaacgttagtcggaccggtacccgttcccgggtaaggggtaaccgggtacccgtaacttacccgaacctaaccgtcccgtaccgaacggaaaccggaacccgtaaacccggaaccaaaccgaaaacccttaaccgtaccgttaaggtttacctaaccggttaaaccggaacgtaaacgtacgggaaacctaccgggtaaaccgttacccccgtaaacgggaaaccccggtaccccggaacccggaaccccgggttaccgggtaccttttcggggttaacgttttaaccgggtttaacgttaccgggggaacgttaaaccgggggtaaccggggggaacccgggtaaccccgtaacggtttaacccctttaaaccggtttttacccccgtaaacccctttaacccgggttaccccccgtttacccgggaaggttttaacccggggttacccggggtaaacccgggtttacccggggggtaaaccccggggggaacccggtaaaacccccggggggggtacttaaccccccgggggg

SEQ ID NO: 203823 - DNA, 783 bp, Homo sapiens
  misc_feature: GYAE6OF01ANURL.24.85.H08.1.454.CMB.1.raw
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcgacggggtccctgagactctcctgtcgcacgtccttctggactttccgcctttactaaacttaaccttcgtcggattcgcgtacgtcggggtacccgccgaacgtccgtaccgaaggggacggggtcttgtacgtttcgggtctacgtacgttaattactattggagttgggagtagctacactacgtagtcggacggtacgtcggaggacgggtcctattaccgaacctactccgtacgaaggtaacgaccgtaaccggaccgaaacgaacccgtactacgttaacgttactaccgttagtaacctaaagtacggaaccgacgtaaccgtaccgtaacgggaaaccggtcccggaaaccggtaaccggaccgggttcgttaaccgggtttaaggtttaacccgtttacggtagggttacggaaaccgggaacgggggttaccgggggacctaagttaccctaaccgttttaaccccgttcccgtaaccctttaccgccccggttacggttaaccgtaccggggttacccggttaccggggaccggggttaacccggtaaacccggggggcccttaaccccgggg

SEQ ID NO: 203824 - DNA, 717 bp, Homo sapiens
  misc_feature: GYAE6OF01CT3AP.24.85.H08.1.454.CMB.1.raw
  modified_base (425)..(425): a, c, t, g, unknown or other
  misc_feature (425)..(425): n is a, c, g, or t
  modified_base (523)..(523): a, c, t, g, unknown or other
  misc_feature (523)..(523): n is a, c, g, or t
tcagactactatgtcacgaccggtgctcgatttagtatcactcagtcgcgggggagccccagccctgggattcccagctgtttctgcttgctgatcaggactgcacacagagaactcaccatggtaggtttgggctgagtcgttcgggtttttccttgttgtacttaatttttaaaagggtcgtccgtagttggtggaggtgcgagcgtgggtgggaggtccgggggaggtcgttaggttcgacggtccggtcggggggtccctggagtacctccgtcgtgtcgcgacgcctgtcggtattccgacctttagaaacttaacgttcgtggtatcgcgacggtcgggtacccgaccaaggccgtcggaaggggacgggtctggtagtttcggtctacgtacgttacttaacgagttaggaggtaggngtagctacgactactgtcggacgtacgtccggtacgggacggccgtataccactactccgacgacgacgaacgaaccgacaacgaacaactacgttanacttacgtaacgaactaaacgcgaacgacgtacgtaccgtaacggaaccgaccggaaccggacgaccggttacgtagttacggttaacgttcgtacggtagggaaccggtacggggaacgggtaccgaacggtaccgttaacctttacccgtaaccgttacccttaacccgttccggtaccgttcgggtacggg

SEQ ID NO: 203825 - DNA, 745 bp, Homo sapiens
  misc_feature: GYAE6OF01EV0H4.24.85.H08.1.454.CMB.1.raw
  modified_base (493)..(493): a, c, t, g, unknown or other
  misc_feature (493)..(493): n is a, c, g, or t
  modified_base (700)..(700): a, c, t, g, unknown or other
  misc_feature (700)..(700): n is a, c, g, or t
tcagactactatgtcacgaccggtgctcgatttagtatcactcagtcgcgggaggacgctgaccacacggtacgtgctgttgtactgcctcctcccgcggtctttgtcttggcattatgccacctccacgccgtccaccgtaccagttgaacttgacctcgagggttcttcggtggctacaccgtcccaccaccacgctatgtcgccctcgtacggggtccctaggacgtacctccttaccgtgtcgccacgtcccttcgtaggtactttccgaccttactaaacttaaccgttcgtacggtatcgtaccgtacgggtccgggtacccgaaccgacgccgtaaccggggaagggggtaacggggtcgttaggtttaggtttaccggggtccttaacggttaacgtttaaacttaattacggttaggtaggtagggtacgtacgtctaacggtaacctacggtcgtcggaaccggtcgtacggaggaccgggtntaccgttaccactacgtaccacgaagtaccaaccgaaccgaccaaacgaacctaacctagtaagtctacgagtaacctaagtacgacgaaccgacggtaccgtaagggaccaaccggtaccgacgcgttacgttgttacgtaacgttcgtaggaccggaggtaacgggcggtacacgtctaacctttccgtacctaccttcggaccncgtgtacccggcggtacggtacgggaaccggcggtacccgtacgg

SEQ ID NO: 203826 - DNA, 805 bp, Homo sapiens
  misc_feature: GYAE6OF01C7IAD.24.85.H08.1.454.CMB.1.raw
  modified_base (374)..(374): a, c, t, g, unknown or other
  misc_feature (374)..(374): n is a, c, g, or t
  modified_base (640)..(640): a, c, t, g, unknown or other
  misc_feature (640)..(640): n is a, c, g, or t
tcagactactatgtcacgaccggtgctcgatttagtatcactcagtcgcgggggagccccagccctgggattcccagctgtttctgcttgctgatcaggactgcacacagagaactcaccatggagttggctgagtcttgggttttccttgttacgcttaattttaaaaggtgtaccagtggtgaggtgcgaggtcgtggtggcgggtccggggaggtacttagtccgacggccggtcggggggtccctggaaccgtcttcctccgtgtcgcgacgtcctgtcgtctttccgcctttacaacttaacgttcgtaggtactcggacgtaccgttccgggccaacgaccgtaccgtaccggaagggggtacgggtntaggttacgtttgggttacctacgtaacgttaagttaactgttaaggaggtaggtaacgtacgtactccgtaacgtacgtacgtacgggtccgaaccggttaccggtagggaaaccggttacgtaacgttccaaccgtactacgacctaaggaacctaacgaaaccgtaccaaacgtaacctaaacgccgttataccgttaccgtacgaactaaacgtgggaacctacgaccggtaaccgaaacggtaaccccggacgtaaccggngtaaccggttctaggttacgttcgtaacggtcgtaaacgggaccggggtaaacgggtaccggggtaaccctaaggttacccgtttaaccccgtttaaccctttaaccccggttaacccgttaccccggtttaaccccgagggtttttaacccggggaaaccgggg

SEQ ID NO: 203827 - DNA, 748 bp, Homo sapiens
  misc_feature: GYAE6OF01D76SK.24.85.H08.1.454.CMB.1.raw
tcagactactatgtcacgaccggtgctcgatttagtatcactcagtcgcgggaggacgctgaccacacggtacgtgctgttgtactgctcctcccgcggctttgtcttggcatttatgcacctccacgccgtccacgtaccagttgaacttgacctcaggtcttcgtggctcacgtccaccaccacgcatgtcgacctcgacggggtccctgacgactctccgtgtgcacgccttcgtggactttccgcctttactaaattaacctttcgtggatcgccacgttcggggtcccaccgaagtcctaccggaaggggaacgggtcttggtacgttttcggggtaccttaccgtaacgttaatttaaacgtagtttacggagtggggtaagtacgtacctacaactactagtcggaccggtacgttaccgggtaggaaaccgggccttaacttaccgaaccgtacttacccgtaacccgaaagaaccgaaacccgtaaaccgaccaaacgaaacctacctaacgttagttaacgtacgttaacgaaacgtaaagtcgaacgaccgtacgtaaccgaacggtaaacgcccgaacggaccgtacggtcttaggttacgttacgttaagtgggtacgaacgacggggaccgggtactacgtacgttaaacctttcccgtaaccgttataaccccggttcgaccgtttaggaccgggttcgtacgggaacgggaccgtaaacgggcccgggtacg

SEQ ID NO: 203828 - DNA, 689 bp, Homo sapiens
  misc_feature: GYAE6OF01DYW1B.24.85.H08.1.454.CMB.1.raw
  modified_base (210)..(210): a, c, t, g, unknown or other
  misc_feature (210)..(210): n is a, c, g, or t
  modified_base (490)..(490): a, c, t, g, unknown or other
  misc_feature (490)..(490): n is a, c, g, or t
tcagactactatgtcacgaccggtgctcgatttagtatcactcagtcgcgggaggacgctgaccacacggtacgtgctgttgtactgctcctcccgcggtctttgtcttggcattatgcacctccacgccgtccacgtaccagttgaacttgacctcgagggttcttcgtggctcacgtccaccacacgcatgtcacctcgaggggtccnggagctctcctgtgcagctatggctttccgaccttacaaattacctttcgaggtactcgcctacgtccggggtacccaccgtaaaggtccgtaccggaagggggaagggtcgttacggttagttttcgggtacctacgttacgttaattaaactgttagaggtacgggtagtcgtactacgtaactactagtcggtacgaccgttacggtaaggaacgggcctaacgttaccaaccttcgtaccctacgaacgaacggtaaccaaaccggcccgtaaaanaaaccaacccgtaacgtacggtaacttactacgaaataaacgtgaccgacgtaacgaccgtaaacggaaccggtaacgacgtaccgaacgtcgttatagttaactgtgagacgaggggcgtacgatcgtaattccgtacctaactcgtcctacgtcggtaaggtaccgtcgggccgggaacggtaccgggcggtaccgg

SEQ ID NO: 203829 - DNA, 798 bp, Homo sapiens
  misc_feature: GYAE6OF01AV2I1.24.85.H08.1.454.CMB.1.raw
  modified_base (224)..(224): a, c, t, g, unknown or other
  misc_feature (224)..(224): n is a, c, g, or t
  modified_base (663)..(663): a, c, t, g, unknown or other
  misc_feature (663)..(663): n is a, c, g, or t
tcagactactatgtcacgaccggtgctcgatttagtatcactcagtcgcgggaggacgctgaccacacggtacgtgctgttgtactgctcctcccgcggtctttgtcttggctatttatgcacctccaccgccgtcccacgtaccagttgaacttcgacctcgagggttcttcgtggccttcaccgtccacccaccacgcatcgtcgacctcgacggggtcccngacgacctctccgtgtcgcacgtccttagtggtactttccgaccctttaataaacgtttaaccttcgtacgggtactcggtaccgtacggttccgggtacccgacctaacggacccgttaccgggaaaggggggtaacgggttccgttaggttacgggttttcgggtacctaccgttaacgtttaaacttactagtttggaacggttagggtacaacgttcctaccgaagttacgtagttcggaaccgttcggtaccggtacgggaaccggtctaaacgttcccgaacttactaccggtacgaacggaacaaacccggtacccaaccgtaaagaacccctaagtcttacggtactcgtaaacgaactaaagtcgaaccgtacaccgttaacggaacgaacccggaccgtaacggtaaccgtcgggtattaacggggttntaaaccgttccgggtagaccgtaggggaaccgggtccgaattacgcttttaaaccgccgttaccctattacccggtcgtagtcgggttaacgcccgggttccgggaaacggggaccctaaccggggcggttaccg

SEQ ID NO: 203830 - DNA, 845 bp, Homo sapiens
  misc_feature: GYAE6OF01DVTLG.24.85.H08.1.454.CMB.1.raw
  modified_base (239)..(239): a, c, t, g, unknown or other
  misc_feature (239)..(239): n is a, c, g, or t
  modified_base (291)..(291): a, c, t, g, unknown or other
  misc_feature (291)..(291): n is a, c, g, or t
  modified_base (425)..(425): a, c, t, g, unknown or other
  misc_feature (425)..(425): n is a, c, g, or t
  modified_base (459)..(459): a, c, t, g, unknown or other
  misc_feature (459)..(459): n is a, c, g, or t
tcagactactatgtcacgaccggtgctcgatttagtatcactcagtcgcgggaggacgctgaccacacggtacgtgctgttgtactgcctcctcccgcggtcttttgtcttggcatttatcgccaccctccgaccgtccgtcccacgtacccaggttagaacttcgaccgtcgacgggttccttggtgctacaccgtacccaccacctacgcagttgtcgaccttcggacggggtcccngaacgccttcctccgtgtacgccacgtccttcgtacgtcttccgtaccttanaacgttctgtggacttcggcctacggtcggtaccaccgtacgacgtacggaggggtacggtctaggttacgttggtaccaattacgtaacttaagtcgttaggtaggtagggactacgtcgtactacgtagtcncggacgtccgtcggaggaccgtatactacacgtnactacgagaacgacctaaccggcgaaaataacccgacgtaacgttataccgttgtaaacgtaacgtaaacggccgaagacccgttaacgggacccgaaacgggaaacccggttccggaacgaaccgggtttaccgttagttaaccgggttacgttaaaacgtttcggggtaaccgttaacggggaaccggtaacccgggggggagtaacccccgttaacgggttaaccccttttaagttaacccccgtttacccgtaaacccgggtttttaccccgaacccggggttttaaccctacggggggtttaaccccggtacccgggggtaacccgggggttaccggggggttaaaacccccgggaaggggttacccccgggtaaacgggg

SEQ ID NO: 203831 - DNA, 972 bp, Homo sapiens
  misc_feature: GYAE6OF01B2A39.24.85.H08.1.454.CMB.1.raw
tcagactactatgtcacgaccggtgctcgatttagtatcactcagtcggcgggggacgccccagcccgtgggacttcccagtcttgtttttgcttgctgatcgagactgacacacagagactcaccagtggtaggtttggctgacgtcggtttcggttttccgttagttcgttaacttttaaaggtttaaaacggtcgttaccgtaggttggtaggtacggtcgaacgtcggtcggttggggtacgggggtaccgggggttaccggggggtagtttaccggtttaacggtcccgggtaccggggttcccgggggttaccgggggttacccgtacggtaacccgtcctttcccgtccgtacggtccggccgtaccggttcccgtacggttacggttacccttaccgttaaccttaacgttaaccgttttaaccgttcggttaacggtcgttaccgtaccggttaccgggtcccggtaacccgacccgaacgggttccggaaccgggggaaggggttcggttacggttcgggtttaggtttccggtacttaaccggtaaacgttttaacgtaacgttacgggtaggtaaacggttacgggaaccttaccgtactaaaccgtaccggttaacggttaccggtcgggaacccgttaccggtacgggacgggaccgttaaccgtactaccgtacgtaccctacggtaaacgacgaaccgtaaccaacgtaaacgtaacccgaactagttacgtaccgtacgtagtaacgaagtaaccgcggaaactccggaaacttaccgggaaacgtaccccgaaacgggtcccggtaacgttcggttaagttacggtttaaccgttacggtaccgggtacgtaaaagggccccgggaaaggttcccggtaaccctagttaccccttaacccggttccttaaacgtccccgtactaacggttacggtccggacccgttaacggggg

SEQ ID NO: 203832 - DNA, 870 bp, Homo sapiens
  misc_feature: GYAE6OF01BG0QS.24.85.H08.1.454.CMB.1.raw
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcgaggtcttcgtggctcacgtccaccaccacgcagtgtcgacctcgacggggtccctggacgacctctcctgtcgcacgcctcgtaggacttccgccttactaattaaccgttcgtaggtactcgaccgtacggttccgggtacccgaccgaacgtaccgtaccgggaagggggtaacgggtcttggttacgtttcgggtacctaccgtaacgttaagttaacgtagttacggaggtacgggaagtacgtccttacaacgtacgtacgtcggccgtacgtaccggtagggaccgggtacctacgttaccgaccctatcccgtaccaaggtaaccgaaccgaaccgtaacccaaacggtaaaccctacgttaccgtaagttacctacggtacggaaactaaacggtcggacgacggtaccgttaaccggtaaacgggaacccgggaacccctacggggtaaacccgttacggtcccggttttaagggttaccggtttaaccgtttaacggtccgggtaaaccgggaaccggggtaaacggggtccgggggtaaccctaacgggtttcccctaaaccggttttacccccgttaaccgtttaaccccgtcccggttaaccggtaccgggtttaaccgggtacccgggttacccgggggttacccgggtaacccgggggtaacccgggttaaaccggggtacccggttaacccccgggg

SEQ ID NO: 203833 - DNA, 683 bp, Homo sapiens
  misc_feature: GYAE6OF01A3K8C.24.85.H08.1.454.CMB.1.raw
  modified_base (106)..(106): a, c, t, g, unknown or other
  misc_feature (106)..(106): n is a, c, g, or t
  modified_base (272)..(272): a, c, t, g, unknown or other
  misc_feature (272)..(272): n is a, c, g, or t
  modified_base (423)..(423): a, c, t, g, unknown or other
  misc_feature (423)..(423): n is a, c, g, or t
tcagactactatgtcacgaccggtgctcgatttagtatcactcagtcgcgggggagccccagccctgggattcccagctgtttctgcttgctgatcaggactgcanacagagaactcaccatggagtttgggctggagcgtggtttcgtgtagctagtttaaaggtgtcagtgtgacggtgcgtagtcgtgggtgggacggtccggggggagtccgtttaggttccaggtccggtcggggggtccctggacggaccttcgtcctggtcgacnggtccttcgtggtacgtcgtccttacaagttaacttcttagggaatcggtactaacggttcgggccaccgagtcgtacgaaggggtaggctggtagtttcggtacctagtacgttattaacagttcgagtcggtagtcgctagactacgtntcggaccgtcgtcggtacggtacggtacgtaacttccgacccgtagtacctaccggaaagtaccgaaccggtaaccaacgtaaccggaaaactccaagtttcggaactctaccggaaatagtacgagtaccgtacgggcctaaaggcccgtaagtaccggaacgttgacgtagtttacccgtaagttccgaggtaacccgagggaaccgggcggtaacgtcgtaactacttacccgtcgacttcgtcctaattggacggg

SEQ ID NO: 203834 - DNA, 738 bp, Homo sapiens
  misc_feature: GYAE6OF01A3XTF.24.85.H08.1.454.CMB.1.raw
  modified_base (567)..(567): a, c, t, g, unknown or other
  misc_feature (567)..(567): n is a, c, g, or t
tcagactactatgtcacgaccggtgctcgatttagtatcactcagtcgcgggaggactctgaccacacggtacgtgctgttgtactgctcctcccgcggctttgtcttggcattatgcacctccacgccgtccacgtaccagttgaacttgacctcagggtcttcgtgctcacgtccaccacacgcatgtgacctcgaggggtccctggacgactctccgtgtcgcagcctcgtggacttccgccttacaattaaccttcgtcggattcgcctacgtcgggtcccgaccaacgcctaccggaaggggaacggggtcttaggtacgtttgggtcctaccgtacgttaattaacagttgagtagggacgtacgtctacaactacgttagtcggacggtaccgtccggtaggaacgggccgtacttccgaacctacgtcctaccgaagacgaaccgaacgccaaaggtaaaccactaacgtgtaactgtaacgactaaagtgacgtcgaccgacgtaagaaaccgcccgtaacggaccgtacggtcgttaggttaacgttactttaccgnggtaaccggacgtaaacgggggcggggacccctaagtaaccgttaacctttaaccccggccgttttaacccgacccgtttacccggtaccgtttaacgggtaccggggtaacccggttccggggtaaccccggggggaaccctaaacggggggcccctttaaaccgggggg

SEQ ID NO: 203835 - DNA, 761 bp, Homo sapiens
  misc_feature: GYAE6OF01BRZRR.24.85.H08.1.454.CMB.1.raw
tcagactactatgtcacgaccggtgctcgatttagtatcactcagtcgcgggaggacgctgaccacacggtacgtgctgttgtactgctcctcccgcggtctttgtcttggcattatgcacctccacgccgtccacgtaccagttgaacttgacctcagggtcttcgtggctcacgtccaccaccacgcatgtgacctcgaggggtccctgacgacctctcctgtcgcagcctcgtggacttccgccttacaattaacttcgtggtatcgctacgtcgggtcccgaccaagcctaccggagggggaacgggtctggtacgtttcgggtacctacgtaacgttattaacgagttgtaggtcgggtaagtcgtcctacgacgtacgttagtcgaccggtacctccggtacgggaacgggccttaacgttacccacctacgtcccgtaccgagacgaaaccgaacaccgtaacgaaacctactaccgttcgtaacttccgtaagaactaaagtcggaacgtacgtaccggtaacctaacgggaaacccgtcccggtaaccgaccgtaccgggtcttacggtttaacgtttacttaacgggttggtaacggaaccgggtacggggtaccgggggtacctaacggtcgtttaaaccctttaacccgacccgtttaaccaccccgttccggtacgttaacggtccggggttacccgtcggggtaaacccgggggcccgtaaaaccgggggtcccggtaaacccgggg

SEQ ID NO: 203836 - DNA, 543 bp, Homo sapiens
  misc_feature: GYAE6OF01A6JOX.24.85.H08.1.454.CMB.1.raw
  modified_base (243)..(243): a, c, t, g, unknown or other
  misc_feature (243)..(243): n is a, c, g, or t
  modified_base (270)..(270): a, c, t, g, unknown or other
  misc_feature (270)..(270): n is a, c, g, or t
  modified_base (349)..(349): a, c, t, g, unknown or other
  misc_feature (349)..(349): n is a, c, g, or t
  modified_base (412)..(412): a, c, t, g, unknown or other
  misc_feature (412)..(412): n is a, c, g, or t
  modified_base (422)..(422): a, c, t, g, unknown or other
  misc_feature (422)..(422): n is a, c, g, or t
  modified_base (430)..(430): a, c, t, g, unknown or other
  misc_feature (430)..(430): n is a, c, g, or t
  modified_base (435)..(435): a, c, t, g, unknown or other
  misc_feature (435)..(435): n is a, c, g, or t
  modified_base (445)..(445): a, c, t, g, unknown or other
  misc_feature (445)..(445): n is a, c, g, or t
  modified_base (454)..(454): a, c, t, g, unknown or other
  misc_feature (454)..(454): n is a, c, g, or t
  modified_base (458)..(458): a, c, t, g, unknown or other
  misc_feature (458)..(458): n is a, c, g, or t
  modified_base (463)..(463): a, c, t, g, unknown or other
  misc_feature (463)..(463): n is a, c, g, or t
  modified_base (468)..(468): a, c, t, g, unknown or other
  misc_feature (468)..(468): n is a, c, g, or t
  modified_base (494)..(494): a, c, t, g, unknown or other
  misc_feature (494)..(494): n is a, c, g, or t
  modified_base (503)..(503): a, c, t, g, unknown or other
  misc_feature (503)..(503): n is a, c, g, or t
  modified_base (512)..(512): a, c, t, g, unknown or other
  misc_feature (512)..(512): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcgaggggtccctgagactctcctgtgcagcctctggattcgccttnaatacttctggatgcacgttcgggccncaagcctccgaagggggaagggtctggtatttcgggtctcgacgttaattacattgagtggtagtgactcacgtactancggtacggacttccgggagaaacggcatttcaccgtatctccaagcaacgacgcaagaaccanactgtatcanactaaagnaagcngtacagaacncgtacacgngtcnttagntacgngtgacagggtacggccagcaatttcncctataccnctaacgttnacgggtccacggtcgggacaagggtccacgg

SEQ ID NO: 203837 - DNA, 816 bp, Homo sapiens
  misc_feature: GYAE6OF01BKX92.24.85.H08.1.454.CMB.1.raw
  modified_base (162)..(162): a, c, t, g, unknown or other
  misc_feature (162)..(162): n is a, c, g, or t
tcagactactatgtcacgaccggtgctcgatttagtatcactcagtcggcggaggacgctgaccacacggtacgtgctgttgtactgctccctcccgcggtctttcgtcttggcattatcgcaccctccaccgccgtccacgtaccagttgaacttgacctnagggtcttcgtggcctcacgtccaccaccacgcatgtcgaccctcgacggggtccctgacgtaccttctaccgtggtcgcacggtccctcgttaggtactttccgtcctttaccaaagttaaccgttccggtagggtaacttcggacctacggtttaccggggtacccctaccgtaacggtccgttaccgggaagggggaacggggtccttaaggtacggttttcgggtacctacgtaacgttaacttaaccgtgtttacgacgttacgggtagtacgtaccgtacctaaccgtactacggtacggtacccgggtaacctaccggggtacggggtaaacccggtccgttaatttaccccggaactaccttccgaacccggaggtaaccaaaccggtaaccgaccccgaaagtaaaccccacgttacttacgttaacctgtaaaccgaactaagtcggaactccgaacgtccgtaacggaaacccggccgtaacgaccgtcgggtaattcggttaaagttacgttaccgtgggttaacgaacggtacggggtacccgggacctaggtaccctaccgttttaacccgcgtaacttcccggactacggtaacgcgttacccgggagggtaccgggtaacaccgggtcggttaacccg

SEQ ID NO: 203838 - DNA, 723 bp, Homo sapiens
  misc_feature: GYAE6OF01BNME5.24.85.H08.1.454.CMB.1.raw
  modified_base (230)..(230): a, c, t, g, unknown or other
  misc_feature (230)..(230): n is a, c, g, or t
  modified_base (256)..(256): a, c, t, g, unknown or other
  misc_feature (256)..(256): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgacgactctcctgtgcagcctntggtattccgccttcaattacttcgngatcgctcgtcggtccgaccaaggcctaccggagggaacggggtctaggtagttttcggggtacctacgtaacggttaattaaaccgtagtttacggaggttacgggagtacgcttaacgactaaccgtgtccggacggtacccgttacgggtagggaacggggtccgtacgtttacccaacctacttaccgtcccgaaagaccgaacccgaaaccggtaaccgaaacgtaaacccgaaccgtacgttacggttaactccgttaacgaacgaagttacgaacggtaccgaacgtaccgtaaggaaccggaccgacgtacaccgggtacttcgttagttaatcggttaagcggaacggacgggacgggtcctaaggtacctagttacccgtaccttaccgtaccctcggtacttacggtacgggtacccgtacgggtaccgggtacgggaacgggtccggtacccggg

SEQ ID NO: 203839 - DNA, 750 bp, Homo sapiens
  misc_feature: GYAE6OF01E474G.24.85.H08.1.454.CMB.1.raw
tcagactactatgtcacgaccggtgctcgatttagtatcactcagtcgcgggggagccccagccctgggattcccagctgtttctgcttgctgatcaggactgcacacagagaactcaccatggagttgggctgagcttgggttttccttgttgtctaattttaaaaggtgtccagtgtgaggtgcagcgtggtgggaggtccgggggaggtcttagttcgacggccgtggggggtccctgagtaccttctccgtgtcgcgtacgtcctcgtacggtacttccgcctttacaaacttaaccttcgtggtatcgaccgtacgtccgggtaccccgaccaacggccgtaccggagggtaaggggtcctaggtacggtttcggtcctacgtaacgttattaacctagttggagttaggacgtacggtctacgactacgtacgtcggaccggtaccgtcggtacggaacgggtacccgtaattcccgaaccgtacgtccgtaccgaacggtaccgaaaccgaacccgaacccgtaaacgaaacctaccgtaaccgttacggtaactacggtaacgaactaaacgtacggtaaccgaccgtacggtaacccgtaagaaacccggcccgggtaaaccgaaccggtacggttacgttacgttaacgttacttacgtccgtaggaaccggaaggtaccggggactcgtaccgtaactttaccgtaccttaccctacgtacccgtcgtcggttaccggg

SEQ ID NO: 203840 - DNA, 838 bp, Homo sapiens
  misc_feature: GYAE6OF01AQW8H.24.85.H08.1.454.CMB.1.raw
tcagactactatgtcacgaccggtgctcgatttagtatcactcagtcgcgggaggacgctgaccacacggtacgtgctgttgtactgctcctcccgcggctttgtcttggcattatgcacctccaccgccgtccacgtaccagttgaacttgacctcgagggttcttcggtggctcaccgtccacccaccacgcatgtcgacctcgacggggtccctgacgtacttcctcctgtcgcacgtccttgtggtacttccgtcctttactaaactttaacctttcgttaggagttcgaccgtaccggtccggggtaccccgacccgaacgtcccgtacgggaaggggggaacgggtcgttaggttacggttttcggggtcctacgtaacgttaaatttaacgtagttaggagggttagggtagtacgtcctacaactacgtaggcggtacggtaccgtacgggtagggaaccggtctactccactactacctacgaacgaaccgaaccaaccggaaccaaacgaaaccacttacggttctaaccgtacgtaagaacgtaacgtaggaccaccggtacgtacccggaaaggaaccccgggaacgaacccggtaacgggtacgggttctttaacgggtttagttaaccgttcgggtaaggtcccgaaaggggtaacggggtcccgggaccttaaacctacccgttttaaaccttaacccccttccgttaaccccgttacccggttcggttaccggttaaaccgggtccggggttaaaccccggggttcgggggaaacccggggtaaccccgggggtaaaccggggtcccgggttaaccccgggg

SEQ ID NO: 203841 - DNA, 860 bp, Homo sapiens
  misc_feature: GYAE6OF01CIKRV.24.85.H08.1.454.CMB.1.raw
tcagactactatgtcacgaccggtgctcgatttagtatcactcagtcgcgggaggacgctgaccacacggtacgtgctgttgtactgctcctcccgcggctttgtcttgcattatgcacctccacgccgtccacgtaccagttgaacttgacctcgagggtcttcgtggctcacgtccaccacacgcatgtgacctcgacggggtccctgacgacctctcctgtcgcacgtcccttctcggtactttccggccctttacgaaaagttacctttcgtaggtacgtcgaccgtaacggttccggggtaccccgaccctaaaacggtcctacccgggaaggggggaaacggggtccgttacggttacggttttcgggggtaccttaccggttaaaccgttaaggtttaaaccgtagttttaggtaaaggttgggggtaaacgttaccggtaccttaccggtaaacctaaacgttaggtccggtaccggggttaacccttacccggggttaagggaaacccggggtccctaaacgttttacccggaacccttactacccgttaaccgaaaggtaaccgaacccggaaaccgtacccgaaacggaaaaccctaccgttaaccgtagttaaccgtacgtacgtaaactaaaggtacggaacgaccgtaaccgtacccggtaaaggaaacccggacggtaacccgtacgggaccgttgtacgttacgttaacgttcgttggacgtaacggtagggaacgggaccgtacggtacttaacggttaccctaccgttacccttaaccgtccgaccgttaggtccgggtaccgttcgggaaccggggtacccgaacggggtactacccgggg

SEQ ID NO: 203842 - DNA, 743 bp, Homo sapiens
  misc_feature: GYAE6OF01CYOGC.24.85.H08.1.454.CMB.1.raw
  modified_base (300)..(300): a, c, t, g, unknown or other
  misc_feature (300)..(300): n is a, c, g, or t
  modified_base (344)..(344): a, c, t, g, unknown or other
  misc_feature (344)..(344): n is a, c, g, or t
tcagactactatgtcacgaccggtgctcgatttagtatcactcagtcgcgggggagccccagccctgggattcccagcttgtttctgcttgctgatcaggactgccacacagagaacctcgaccagtgggtagtttgggctgagtcgttgggttttccttgttgtacttaagttttaaaggtcgtccgtagtggtggaggtcgcgtaggtcgttaggggtcgggtaccgggtcgggggtagttcgtttacggtcgaggtccggttccgggggtcctaggacgtacctcgtccgtgtcgcncgtccgtgtggcttccgtacttagtaaacttccgttgtaggtcncggtacgtccggtcggtaccccgactaaccggcggtaaccgggtacggggtaagggtcgttacggtagtttcggtctacgtaacgttatagattggagttaggagtactcgtacctaagtcgttaagtccggtcggtaccgttaccgggagggaaaccggtccgtacgttaacccaccgttacgtacccgtaacgtaacggaaccgaaacgaaccccgtaaccaaacgaaacctactacgttacgtactcgtaacgaacgtagccgtagtccgagtacgaacggaacgtccggaacgtcggtcgtacgttacgtacgttacgttcgcgaacgggtacgggacggtgggactacgtctaaactttccgtaccttacgtaccctacgtaggtcgtaccggg

SEQ ID NO: 203843 - DNA, 765 bp, Homo sapiens
  misc_feature: GYAE6OF01CJE35.24.85.H08.1.454.CMB.1.raw
  modified_base (257)..(257): a, c, t, g, unknown or other
  misc_feature (257)..(257): n is a, c, g, or t
tcagactactatgtcacgaccggtgctcgatttagtatcactcagtcgcgggaggacgctgaccacacggtacgtgctgttgtactgcctcctcccgcggtctttcgtccttggcattatgcacctccaccgccgtccacgtaccagttgaacttcgaccgtcgagggttcttcggtcggcctcgaccgtccacccaccacgctagtcgtcgaccgtcggtacggggtccctggacgacttcctccgtgtacggacncgtcctcgtgtacgttcctccttaacaatttactcgtggtactcgtcgtaccggttcgggaccctaccgacgtaccgtaccggaggggtacgggtcttaggtacgggttttcggtacctacggttacttaacgttaagttagtacgtaggtagggtacgttacgcctaacctacgtaaccggtagtaccggtaccggtaaccgtttcggaacggggtaaccgtctttacgactacgtccgtccaacggtagccgaaacacccgtaacgaacctaacgacttaacgtacggtaccttacgaccgtaacgtaaagcggaccgtacggtaccgaaccggtaacaacccggaccggtaacgaccgtacggtacgttacgttaacgtggttacccgaggttaccgaacggaggtacggacgtacggactttccgaaccgttaccgtaccttacttccggtacgtacggttacggaccggttcggacggtaacgggtaccgtaccggttacccg

SEQ ID NO: 203844 - DNA, 875 bp, Homo sapiens
  misc_feature: GYAE6OF01BL1TW.24.85.H08.1.454.CMB.1.raw
tcagactactatgtcacgaccggtgctcgatttagtatcactcagtcgcgggaggacgctgaccacacggtacgtgctgttgtactgctccctcccgcgctttgtcttggcattatgccacctccaccgccgtcccacgtaccagtttgaacttgacctcgagggttcttcgtggctcaccgtccaccaccacgcatgtcgacctcgacggggtccctgacgctcctccgtgtgccgacgtccctacgtggtacttccgtcctttagaacttaacgttcgtggtatcgacctacggtcggtcccgaccgaacggtcctaccgggaaggggaacgggtcttggggttacgtttcgggtcccttacgtaacgtttaactaacgtagttagtaggtcgggtagtacgccgttaccgaacttaccgtacgtccggaccggtaccgtaccgggtaggaacccggggttcctaaccgtttacctaacctccgtttacccgtaacccggaacggtaacccggaaaccgtacccggaaaccccgaaagaaaccccgtaacgtaccttttacggaaccttaaccggtaacggtaaacgtaaacgtgggtaaccctaaccggaacccgttacgaaaccgggaacccggttccccggaacggtacccgaaccggggtttataaccgggtttaaccgttacgttacccggttaggaacccgggtaaacggacgggggttaccccggacggtaaaccttcccggttaaacctttacccgccccgtaaacctttaccccggcgttaaaccgggtttcgtaaacccggggggtcctttcgggggtaaacccccggggtcggaaacccgggggttaccccggttaacccgg

SEQ ID NO: 203845 - DNA, 875 bp, Homo sapiens
  misc_feature: GYAE6OF01DULDA.24.85.H08.1.454.CMB.1.raw
tcagactactatgtcacgaccggtgctcgatttagtatcactcagtcgcgggagacgctgaccacacggtacgtgctgttgtactgctcctcccgcggctttgtcttggcattatgcacctccacgccgtccacgtaccagttgaacttgacctcgagggtcttcgtggctcaccgtccaccaccacgcatgtgacctcgacggggtccctgacgacctctcctgtaccgctacgtcctacgtcggtacttccgtacctttacgaaactttacctttcgtacggtactcgtaccgtacggtcgggtacccgaccgtaacggtcccgtaaccggaaggggggtaaccggggtcttacggtttacggttttacgggttaccgtacgttaacggttaacgtttaacctaggttacggaagttacggggaagtacgtcctacgtaacgtacgtagtccggaccggtacgtaccgggtaggaacgggtcctacgttccaacctcgtacctacgaacgaacgaacccgtaacgacccgaaaccgtaaacctccgaacgtttaggtaccctacggttaagaaccgtaaactgggaaccctttaccggaactacccccggtaaaagggaacccgtacccccgggtaactaaccgggaccgttttcgggttaaccgtttaggtaaccgtttttaaacgggcggttaaccgggaacgggtaaacccgggggggccggttaacacgtttcccgttaaacctttaccccgtaacccgggtttaactaccccgggtttcccaacgggtttacgggaacccgggttacccggttacgggggaacccggggtaaccccgggtaaaccccggggttccgttaacccggggg

SEQ ID NO: 203846 - DNA, 561 bp, Homo sapiens
  misc_feature: GYAE6OF01A37NJ.24.85.H08.1.454.CMB.1.raw
  modified_base (182)..(182): a, c, t, g, unknown or other
  misc_feature (182)..(182): n is a, c, g, or t
  modified_base (270)..(270): a, c, t, g, unknown or other
  misc_feature (270)..(270): n is a, c, g, or t
  modified_base (292)..(292): a, c, t, g, unknown or other
  misc_feature (292)..(292): n is a, c, g, or t
  modified_base (303)..(303): a, c, t, g, unknown or other
  misc_feature (303)..(303): n is a, c, g, or t
  modified_base (311)..(311): a, c, t, g, unknown or other
  misc_feature (311)..(311): n is a, c, g, or t
  modified_base (320)..(320): a, c, t, g, unknown or other
  misc_feature (320)..(320): n is a, c, g, or t
  modified_base (343)..(343): a, c, t, g, unknown or other
  misc_feature (343)..(343): n is a, c, g, or t
  modified_base (478)..(478): a, c, t, g, unknown or other
  misc_feature (478)..(478): n is a, c, g, or t
  modified_base (517)..(517): a, c, t, g, unknown or other
  misc_feature (517)..(517): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccnccacgcatgtgacctcaggggtccctgagactctccctgtgcagcctctggattccgcttcaatacttctggatgctacgtgggtccnccaagctccgagggagggctgngtttggtctcngtattacnttgatgggntagctacgacactatcgacgtcncgtagacggtccgattcaccgatcctccgaagtccgacaaccgccgaacgtaaacacatgttactcgtacgactaaatgaacgcagccctaggaaccgtcggaacgaaccgcgtaccgtgtacgttactacgtgngacgacgtggggccaggtccacttacgttccaacttacnccctagtactcggtacgttcgacggtccgaagggtcccgtacgg

SEQ ID NO: 203847 - DNA, 762 bp, Homo sapiens
  misc_feature: GYAE6OF01BFP35.24.85.H08.1.454.CMB.1.raw
  modified_base (389)..(389): a, c, t, g, unknown or other
  misc_feature (389)..(389): n is a, c, g, or t
  modified_base (525)..(525): a, c, t, g, unknown or other
  misc_feature (525)..(525): n is a, c, g, or t
  modified_base (533)..(533): a, c, t, g, unknown or other
  misc_feature (533)..(533): n is a, c, g, or t
tcagactactatgtcacgaccggtgctcgatttagtatcactcaggtcggcgggaggacgctgaccacacggtacgtgctgttgtactgctcctcccgcggtctttgtcttggcattatgcacctccacgcgtccacgtaccagttgaacttgacctcgagggtctcgtgctcacgtccaccaccacgcatgtcgaccgtcgacggggtccctgacgccttctcctgtcgctcgtcctgtgtacttccgtaccttactaacttacttcgtggtctcggactcggtcgggtacccacgaaggtccgtaccggaggggtaacgggtcttaggttcgtttcggccttaccgtaagttaacgttacgtaagttggaggttacgggaagttccncgtaccagtacgtagtccggaaccggttccgtacggtaaggggtaccggtacccttagtaccctaacgtacgttacccgaccggaagaaccgaacccgaacccgtacgaaagtaacccacgttacgtgttaaaccngtacgaanaacggtacgacgacgagtaccgaacgacccggacgtaacgtaccgcgttacgttaacgttcgttaaccgtaggtcggaacggtaaccggggtacgggtaccggaacccttacgaccgttttaacccgttaaccgttaccccgtaagttcccgggtaccgtttacggtacggtaccccgggttccggggttaccgaaacccggggtaccccgggacggtaacccggtcgg

SEQ ID NO: 203848 - DNA, 531 bp, Homo sapiens
  misc_feature: GYAE6OF02I2H0F.24.85.H08.1.454.CMB.1.raw
  modified_base (290)..(290): a, c, t, g, unknown or other
  misc_feature (290)..(290): n is a, c, g, or t
tcagactactatgtcacgaccggtgctcgatttagtatcactcagtcgcgggggagccccagccctgggattcccagctgtttctgcttgctgatcaggactgcacacagagaactcaccatggagtttgggctgagctgggttttccttgttgctattttaaaaggtgtccagtgtgaggtgcagctggtggagtccgggggaggcttagttcagcctggggggtccctgagactctcctgtgcagcctctggattcgccttcaataacttctggatgcactgggtccncaagctccgagggaagggctgatttgggtctcacgtattaacattgatgggatagctcacactatgcggatccgtgaaggccattcacatctcagagacaacgccagaaacacactgtatctgacaaatgagcagcctagaacgccgacgacgacggtctggttagtacttacgtgtgacgaacgggacgggggaccaggtcaacgttacctaccgttaacctaccgtccgactatacggg

SEQ ID NO: 203849 - DNA, 503 bp, Homo sapiens
  misc_feature: GYAE6OF02IF5OM.24.85.H08.1.454.CMB.1.raw
  modified_base (288)..(288): a, c, t, g, unknown or other
  misc_feature (288)..(288): n is a, c, g, or t
  modified_base (459)..(459): a, c, t, g, unknown or other
  misc_feature (459)..(459): n is a, c, g, or t
tcagactactatgtcacgaccggtgctcgatttagtatcactcagtcgcgggggagccccagccctgggattcccagctgttctgcttgctgatcaggactgcacacagagaactcaccatggagtttgggctgagctgggttttccttgttgctattttaaaaggtgtccagtgtgaggtgcagctggtggagtccgggggaggcttagttcagcctgggggtccctgagactctcctgtgcagcctctggattcgccttcaataacttctggatgcactgggtccnccaagctccagggaaggggctgatttgggtctcacgtattaacattgatgggatagctcacactatgcggactccgtgaaggccgattcaccatctccagagacaacgcagaaacacactgtatctgacaaatgagcagcctagaacgccgacgacacgctgtgtattacngtgcgaaggaggggccagcattactcctactactccgctatcgg

SEQ ID NO: 203850 - DNA, 511 bp, Homo sapiens
  misc_feature: GYAE6OF02GCTPV.24.85.H08.1.454.CMB.1.raw
tcagactactatgtcacgaccggtgctcgatttagtatcactcagtcgcgggaggacgctgaccacacggtacgtgctgttgtactgctcctcccgcggctttgtcttgacattatgcacctccacgccgtccacgtaccagttgaacttgacctcagggtcttcgtggctcacgtccaccaccacgcatgtgacctcaggggtccctgagactctcctgtgcagcctctggattcgccttcaataacttctggatgcactgggtccgccaagctccagggaaggggctgatttgggtctcacgtattaacattgatgggagtagctcacactatgcggactccgtgaagggccgattcaccatctcagagacaacgccagaaacacactgtatctgacaaatgagcagcctagaaagccgacgacacggctgtgtattactgtgcaaggaggggccagcattactcctactactccgctagtcggacgtcgtgggccagggacctacggg

SEQ ID NO: 203851 - DNA, 521 bp, Homo sapiens
  misc_feature: GYAE6OF02G05WD.24.85.H08.1.454.CMB.1.raw
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggattcgccttcaataacttctggatgcactgggtccgccaagctccgagggaaggggctgatttgggtctcacgtattaacattgatgggagtagctcacactatgcggactccggtgaagggccattcaccatctccagagacaacgccagaaacacactgtatctgacaaatgagcagcctagaaagccgaacgacacggctgtgtattactgtgacgaaggaggggccaggcattactcctactacctccgctagtcggacgtcgtggggaccaagggacctacggg

SEQ ID NO: 203852 - DNA, 542 bp, Homo sapiens
  misc_feature: GYAE6OF02JBOD6.24.85.H08.1.454.CMB.1.raw
  modified_base (268)..(268): a, c, t, g, unknown or other
  misc_feature (268)..(268): n is a, c, g, or t
  modified_base (371)..(371): a, c, t, g, unknown or other
  misc_feature (371)..(371): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggattcgccttcaataacttctggatgcactgggtccnccaagctccgagggaaggggctgatttgggtctcacgtattaacattgatgggagtagctcacactatgcggactccgtgaacggccgattcacatctcaganacaacgccagaaacacactgtatctgacaaatgagcagcctagaacgccgacgacacggctgtagtattactgtagacgaaggacgggggaccagactacttacctccctaaccttacctcccgacttagtcggtaccgtcggtcggggaccaacggggacccgtaacggg

SEQ ID NO: 203853 - DNA, 542 bp, Homo sapiens
  misc_feature: GYAE6OF02GXH9V.24.85.H08.1.454.CMB.1.raw
  modified_base (316)..(316): a, c, t, g, unknown or other
  misc_feature (316)..(316): n is a, c, g, or t
tcagactactatgtcacgaccggtgctcgatttagtatcactcagtcggcggggaggacgctgaccacacggtacgtgctgttgtactgctcctcccggccggctttgtcttggcagttatgcacctccacgccgtccacgtaccagttgaacttgacctcagggtcttcgtggctcacgtccaccaccacgcatgtgacctcaggggtccctgagactctcctgtgcagcctctgggattcgccttcaataacttctggatgcactgggtccgcaagctccagggaaggggctgatttgggctcacgtattaacnttgatggggatagctcacactatgcggactccggtgaacgggccattcacgatctccagacgacaacgccagaaaccacactgtatctgacaaatgagcacgacctagaaacgccgacgacacggctgtagtattactgtgacgaaggcggggaccaggcaagttactacctactaccgtccgtgtagtcggacgttcgtacgggggcctaaggggccctacgggg

SEQ ID NO: 203854 - DNA, 513 bp, Homo sapiens
  misc_feature: GYAE6OF02I81ML.24.85.H08.1.454.CMB.1.raw
  modified_base (405)..(405): a, c, t, g, unknown or other
  misc_feature (405)..(405): n is a, c, g, or t
  modified_base (410)..(410): a, c, t, g, unknown or other
  misc_feature (410)..(410): n is a, c, g, or t
  modified_base (466)..(466): a, c, t, g, unknown or other
  misc_feature (466)..(466): n is a, c, g, or t
tcagactactatgtcacgaccggtgctcgatttagtatcactcagtcgcgggggagccccagccctgggattcccagctgtttctgcttgctgatcaggactgcacacagagaactcaccatggagtttgggctgagctgggttttccttgttgctattttaaaaggtgtccagtgtgaggtgcagctggtggagtccgggggaggcttagttcagcctggggggtccctgagactctcctgtgcagcctctggattcgccttcaataacttctggatgcactgggtccgccaagctccgaggggaagggctggatttgggtctcgacgtattaacattgatgggatagctcacactatgcggactcgtgaaggcgattcacatctcagagacacgcaagaaacncactntatctgacaaatgagcagcctagaacgccgaacgacacggctgtagtattactgtnacgaagggcggggaccagctattactacctactactccgctagtcgg

SEQ ID NO: 203855 - DNA, 512 bp, Homo sapiens
  misc_feature: GYAE6OF02IB7KW.24.85.H08.1.454.CMB.1.raw
  modified_base (449)..(449): a, c, t, g, unknown or other
  misc_feature (449)..(449): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggattcgccttcaataacttctggatgcactgggtccgccaagctccagggaaggggctgatttgggtctcacgtattaacattgatgggagtagctcacactatgcggactccgtgaagggccattcaccatctcagagacaacgccagaaacacactgtatctgcaaatgagcagcctagaaacgcgacgacacggctgtgtattactgtgcaaggnggggcagcattactcctactactccgactagtcggacgtcgtcggggcaacgggaccgacggg

SEQ ID NO: 203856 - DNA, 512 bp, Homo sapiens
  misc_feature: GYAE6OF02FWK5Q.24.85.H08.1.454.CMB.1.raw
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggattcgccttcaataacttctggatgcactgggtccgccaagctccagggaaggggctgatttgggtctcacgtattaacattgatgggagtagctcacactatgcggactccgtgaagggccgattcaccatctccagagacaacgccagaaacacactgtatctgcaaatgagcagcctagaagccgacgacacggctgtgtattactgtgcaaggaggggctagcattactcctactactccgactatcggacgtcgtgggccgagggaccgtacggg

SEQ ID NO: 203857 - DNA, 545 bp, Homo sapiens
  misc_feature: GYAE6OF02JC002.24.85.H08.1.454.CMB.1.raw
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggattcgccttcaataacttctggatgcactgggtccgccaagctccgaggggaaggggctgatttgggtctcacgtattaacattgatgggatagctcacactatgcgactccgtagaagggccattcaccatctccagagacaacgccagaaacacactgtatctagacaaatcgagcagcctagaaacgcccgaacgacgacggctgtgtattactgtgacgaaggacggggccagctaacgttacctaccttactacctccgacttagtcgggtaccgttccggtacggggaccgacgggaccgtaacggg

SEQ ID NO: 203858 - DNA, 519 bp, Homo sapiens
  misc_feature: GYAE6OF02IZ6ZV.24.85.H08.1.454.CMB.1.raw
  modified_base (454)..(454): a, c, t, g, unknown or other
  misc_feature (454)..(454): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggattcgccttcaataacttctggatgcactgggtccgccaagctccagggaaggggctgatttgggtctcacgtattaacattgatgggagtagctcacactatgcggactccgtgaagggccgattcaccatctccagagacaacgccagaaacacactgtatctgacaaatgagcagcctagaaacgccgacgacacggctgtgtattactgtgcaaaggnggggccagcattacctcctactactccgactagtcggacgtcgtcggggaccaagggcctacggg

SEQ ID NO: 203859 - DNA, 523 bp, Homo sapiens
  misc_feature: GYAE6OF02FVYG7.24.85.H08.1.454.CMB.1.raw
  modified_base (284)..(284): a, c, t, g, unknown or other
  misc_feature (284)..(284): n is a, c, g, or t
  modified_base (470)..(470): a, c, t, g, unknown or other
  misc_feature (470)..(470): n is a, c, g, or t
tcagactactatgtcacgaccggtgctcgatttagtatcactcagtcgcgggggagccccagccctgggattcccagctgtttctgcttgctgatcaggactgcacacagagaactcaccatggagtttgggctgagcgtggtttcgtgtagctatttaaagtgtcagtgtgaggtgcagctggtggagtccgggggaggcttagttcagcctggggggtccctgagactctcctgtgcagcctctggattcgccttcaataacttctggatgcactgggtccnccaagctccgaggggaaggggctggatttgggtctcacgtattaacattgatgggagtagctcacactatgcggactccgtgaaggccgattcacatctccagagacaacgccaagaaacacactgtaactctagacaaagtcgagcagcctagaaacgccgaacgcacggctgtagtattcgtgngacgaaggacggggaccagcgtacttacctccgtaactactccgactagtcgg

SEQ ID NO: 203860 - DNA, 598 bp, Homo sapiens
  misc_feature: GYAE6OF02GQDZ1.24.85.H08.1.454.CMB.1.raw
tcagactactatgtcacgaccggtgctcgatttagtatcactcagtccgggggaggcttagttcagcctggggggtccctgagactctcctgtgcagcctctggattcgccttcaataacttctggatgcactgggtccgccaagctccagggaaggggctgatttgggtctcacgtattaacattgatgggagtagctcacactatgcggactccgtgaagggccattcaccatctccagagacaacgccaagaaacacactgtatctgcaaaatgagcagcctgaaagccgacgacacggctgtgtattactgtgcaagaggggccagcattactcctactactccgctatggacgtcgtggggccaagggaccagggtcaccgtctcctcacgcctccaccaagggcccaactccggtccttcccccgtggcccaccctccctcccaacgtacgccaccgtcgtcgggggccaccgacgccggcccgtcgggcctcggcccgtcgggtaccaaacgggtaccttaaccgtttacccgaacctaacgttaacggttacggttacgttcggaacggtccggggtccgtgggaacccg

SEQ ID NO: 203861 - DNA, 540 bp, Homo sapiens
  misc_feature: GYAE6OF02HVAOR.24.85.H08.1.454.CMB.1.raw
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggattcgccttcaataacttctggatgcactgggtccgccaagctccgagggaaggggctgatttgggctcacgtattaacattgatggggatagctcacactatgcggactccggtgaagggccgattcaccatctccagagacaacgccaagaaaccacactgtaatctagacaaatgagcaagcctagaaacgccgaacgaccacggctgtagtattacgtgtgacgaaggacggggccagctattaccgtccttaactacctccgctagtcggtacgtcgtacggggaccaagggaccctacgggg

SEQ ID NO: 203862 - DNA, 525 bp, Homo sapiens
  misc_feature: GYAE6OF02IWO5H.24.85.H08.1.454.CMB.1.raw
  modified_base (366)..(366): a, c, t, g, unknown or other
  misc_feature (366)..(366): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggattcgccttcaataacttctggatgcactgggtccgccaagctccgagggaaggggctggatttgggctcacgtattaacattgatgggagtagctcacactatgcggactccgtgacgggccattcaccatcnccagagacaacgccaagaaaccacactgtatctgacaaatgagcagcctagaagccgacgacacggctgtagtattactgtgcgaaggaggggccagctattacctcctaactacctccgctagtcggacgtcgtcggggaccgaacgggccgtacggg

SEQ ID NO: 203863 - DNA, 539 bp, Homo sapiens
  misc_feature: GYAE6OF02IHLI8.24.85.H08.1.454.CMB.1.raw
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggattcgccttcaataacttctggatgcactgggtccgccaagctccgagggaaggggctggatttcggggtctcgacgtattaacatttgatgggagtagctcacactatgcggactccgtaggaacgggccattcaccatctaccagacgacaaccgccaagaaacacactgtatctgacaaatgagcagccagaaacgcgacgacacggctgtagtattactgtagcgaaggcggggccagctacttacctcctactcctccgcttaagtcggaccgtcgtacggggaccacggggacctacgggg

SEQ ID NO: 203864 - DNA, 597 bp, Homo sapiens
  misc_feature: GYAE6OF02G6XZ3.24.85.H08.1.454.CMB.1.raw
  modified_base (254)..(254): a, c, t, g, unknown or other
  misc_feature (254)..(254): n is a, c, g, or t
  modified_base (258)..(258): a, c, t, g, unknown or other
  misc_feature (258)..(258): n is a, c, g, or t
  modified_base (277)..(277): a, c, t, g, unknown or other
  misc_feature (277)..(277): n is a, c, g, or t
  modified_base (567)..(567): a, c, t, g, unknown or other
  misc_feature (567)..(567): n is a, c, g, or t
tcagactactatgtcacgaccggtgctcgatttagtatcactcagtccgccggggacgccccagccctgggattcccagctggtttctgcttgctgatcaggactgcacacagagaactcaccatggagtttgggctgagcgtggttttcctgttgctattttaaaggtgtccagtgtgaggtgcagctggtggagtccgggggaggcttagttcagccgtggggggtccctggagactctcctgtgcagcctntggnttccgccttcaataccttntggatgcacgtgggtcccgccaagcctccggaggggaaggggctaggagtttgggtctcgaacgttattaacatttgagtgggatagctcacactatgacggtactccggtaggaacgggtccgattccaacctatccgtacccaggaacgaaccaaccgaccaaagaaacctacacttgtaactctagacaaagtgacgcaacgccgtaagaaacgcccgaacgaccgacggtctagtacgttacttacgtgtagacggtaagggaccgggcacggcctaagtttaccnccgttaacctacctccgtactaggtaccgg

SEQ ID NO: 203865 - DNA, 521 bp, Homo sapiens
  misc_feature: GYAE6OF02G7MXS.24.85.H08.1.454.CMB.1.raw
  modified_base (268)..(268): a, c, t, g, unknown or other
  misc_feature (268)..(268): n is a, c, g, or t
  modified_base (404)..(404): a, c, t, g, unknown or other
  misc_feature (404)..(404): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggattcgccttcaataacttctggatgcactgggtccncaagctccgagggaagggctgatttgggctcacgtattaacattgatgggatagctcacactatgcgactccgtagaacggccattcaccatctccagacacaacgccagaaacacactagtatctgacaaatgancagcctagaacgccgacgacgacggctgtagtattactgtgacgaagaggggccagctataccgtcctactactccgtactacgtcggacgtcgtacgggaccgacggacgtacggg

SEQ ID NO: 203866 - DNA, 519 bp, Homo sapiens
  misc_feature: GYAE6OF02GYK42.24.85.H08.1.454.CMB.1.raw
  modified_base (394)..(394): a, c, t, g, unknown or other
  misc_feature (394)..(394): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggattcgccttcaatacttctggatgcactgggtccgccaagctccgagggaaggggctgatttgggtctcacgtattaacattgatgggatagctcacactatgcgactccgtgaaggccgattcacatctccagagacaacgccagaaacacactgtatctnacaaatgagcagcctagaacgccgacgacacggctagtgtattcgtgtgcgaaggacggggccagctattacctcctactacctccgactagtcggacgtcgtcggggaccaggggacctacggg

SEQ ID NO: 203867 - DNA, 511 bp, Homo sapiens
  misc_feature: GYAE6OF02F9272.24.85.H08.1.454.CMB.1.raw
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggattcgccttcaataacttctggatgcactgggtccgcaagctccagggaagggctgatttgggtctcacgtattacattgatgggagtagctcacactatgcggactccgtgaaggccgattcaccatctccagagacaacgccagaaacacactgtatctgcaaatgagcagcctagaaagccgacgacacggctagtgtattactgtagcaaggaggggcagcattaccgtctactactccgatagtcggtacgtcgtgggccaacgggcctacggg

SEQ ID NO: 203868 - DNA, 510 bp, Homo sapiens
  misc_feature: GYAE6OF02H70VE.24.85.H08.1.454.CMB.1.raw
  modified_base (359)..(359): a, c, t, g, unknown or other
  misc_feature (359)..(359): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggattcgccttcaataacttctggatgcactgggtccgcaagctccagggagggctgatttgggtctcacgtattaacatttgatgggatagctcacactatgcggactcgtgaaggccattcacatcncagagacaacgccagaaacacactgtatctgacaaatgagcagcctagaacgccgacgacacggctgtgtattactgtgcgaaggaggggccagcattacctctactctccgctagtggtacgtcgtcggggaccgacgggaccgtacggg

SEQ ID NO: 203869 - DNA, 552 bp, Homo sapiens
  misc_feature: GYAE6OF02GV95N.24.85.H08.1.454.CMB.1.raw
  modified_base (332)..(332): a, c, t, g, unknown or other
  misc_feature (332)..(332): n is a, c, g, or t
  modified_base (464)..(464): a, c, t, g, unknown or other
  misc_feature (464)..(464): n is a, c, g, or t
tcagactactatgtcacgaccggtgctcgatttagtatcactcagtcgcgggggagccccagccctgggattcccagctgtttctgcttgctgatcaggactgcacacagagaactcaccatggagtttgggctgagcggtggtttcgtgtaggcgtatttaaaggtgtcagtgtgaggtgcagctggtggagtccgggagaggcttagttcagccgtggggggtccctgagactctcctgtgcagcctctggattcgccttacaattaacttctggatgcactgggtccgcaagctccgagggaagggctgatttgggctcacgtataacnttgatgggagtagctcacactagtcgacggtactccggtgaacggggcctacgttcacccgtatcctccagagacaacgcaagaaaccacactgtactctagacaatgagcagcctagaacgtccgacgacncggctgtgtacttacgtgtcgacggtaaggacgggggcctaagcgtaacttttaccgtacccgttaactaccgtacccgacgttacgg

SEQ ID NO: 203870 - DNA, 562 bp, Homo sapiens
  misc_feature: GYAE6OF02HBZRL.24.85.H08.1.454.CMB.1.raw
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggattcgccttcaataacttctggatgcactgggtccgcaagctccgaggggaaggggctgatttgggtctcacgtattaacattgatgggatagctcacactatgcggactccgtgaaggccgattcacatctaccagacgacaacgccaagaaaccacactgtatctagacaaatgacgcagcctagaaacgcccgaacgacacggctgtagtatttacgtgtcgacaaagggacggggcccagctaagtttaccgtacccttaaccttaccgtcccgattacgtcggggtaccgttcggtcgggggacccgtaaggggtccctacgggg

SEQ ID NO: 203871 - DNA, 513 bp, Homo sapiens
  misc_feature: GYAE6OF02IVSL5.24.85.H08.1.454.CMB.1.raw
  modified_base (252)..(252): a, c, t, g, unknown or other
  misc_feature (252)..(252): n is a, c, g, or t
  modified_base (363)..(363): a, c, t, g, unknown or other
  misc_feature (363)..(363): n is a, c, g, or t
  modified_base (368)..(368): a, c, t, g, unknown or other
  misc_feature (368)..(368): n is a, c, g, or t
  modified_base (381)..(381): a, c, t, g, unknown or other
  misc_feature (381)..(381): n is a, c, g, or t
  modified_base (386)..(386): a, c, t, g, unknown or other
  misc_feature (386)..(386): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggattcgccttcaataacttcnggatgcactgggtccgccaagcctccgaggggaaggggctgatttgggtctcacgtattaacattgatgggagtagctcacactatgcggactcgtgacggcatcacatcncagancaacgcagaaacncactntatctgacaaatgagcagacctagaaacgccgacgacgacggctagtgtattcgtgtgacgaaggaggggccagcattacctctactactccgtctacgtcggacgtcgagggccgacgggcacggg

SEQ ID NO: 203872 - DNA, 513 bp, Homo sapiens
  misc_feature: GYAE6OF02H8Y0Z.24.85.H08.1.454.CMB.1.raw
  modified_base (326)..(326): a, c, t, g, unknown or other
  misc_feature (326)..(326): n is a, c, g, or t
  modified_base (383)..(383): a, c, t, g, unknown or other
  misc_feature (383)..(383): n is a, c, g, or t
  modified_base (425)..(425): a, c, t, g, unknown or other
  misc_feature (425)..(425): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggattcgcttcaatacttctggatgcactgggtccgccaagctccgaggggaagggctgatttgggctcacgtataacattgatgggatagctcanactatgcggactccgtgaggcattcacatctcagagacacgcagaacacactgatcngacaaatgagcacgacctagaaacgccgacgacacggctgtntattctgtgacgaaggaggggcagctattacctctacctactccgtactagtcggacgtcggtacggggaccaacggggcctaacggg

SEQ ID NO: 203873 - DNA, 539 bp, Homo sapiens
  misc_feature: GYAE6OF02HIJDF.24.85.H08.1.454.CMB.1.raw
  modified_base (268)..(268): a, c, t, g, unknown or other
  misc_feature (268)..(268): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggattcgccttcaataacttctggatgcactgggtccncaagctccagggaagggctgatttgggctcacgtattaacattgatgggatagctcacactatgcgactccgtgaacgggccgattcaccatcctaccagacgaccaacgccaagaaaccacactgtatctgacaaatgagcagcctagaaacgccgacgacacggctagtgtattacgtgtagcgaaggacggggcaggctattacctcctaactaccgtccgacgttagtcggtaccgtcggtggggaccgaacggggaccctacgggg

SEQ ID NO: 203874 - DNA, 578 bp, Homo sapiens
  misc_feature: GYAE6OF02I2OGC.24.85.H08.1.454.CMB.1.raw
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggacttcgcccttcaataacttctggatgcactgggtccgccaagctccgaggggaacgggctgattttgggtctcacgtattaacattgatggggagtgctcacactatggcggactccggtaggaacgggccgtattcacatcctccagagaccaacgccaagaaacacactgtactctgacaaatgagcacgctagaacgccgacgacacggctggtagtattacgtgtagacgaagggcggggaccaggctaacttaccgtcccttaacttaccgtcccgtacgttacgtacgggtaaccggttccggttacgggggacccgaacggggtacccgtaaccgggg

SEQ ID NO: 203875 - DNA, 521 bp, Homo sapiens
  misc_feature: GYAE6OF02GT9JL.24.85.H08.1.454.CMB.1.raw
tcagactactatgtcacgaccggtgctcgatttagtatcactcagtcgcgggggagccccagccctgggattcccagctgtttctgcttgctgatcaggactgcacacagagaactcaccatggagtttgggctgagctgggttttccttgttgctattttaaaaggtgtccagtgtgaggtgcagctggtggagtccgggggaggcttagttcagcctggggggtccctgagactctcctgtgcagcctctggattcgccttcaataacttctggatgcactgggtccgccaagctccaggggaagggctgatttgggtctcacgtattaacattgatgggatagctcacactatgcggactccgtgaacgggccgattccaccatctccagagacaacgccaagaaacacactgtactctgacaaatgagcagcctagaaacgccgacgacacggctgtagtattactgtagcgaaggacggggccagctattactcctactacctccgtactagtcgg

SEQ ID NO: 203876 - DNA, 529 bp, Homo sapiens
  misc_feature: GYAE6OF02I26UL.24.85.H08.1.454.CMB.1.raw
  modified_base (268)..(268): a, c, t, g, unknown or other
  misc_feature (268)..(268): n is a, c, g, or t
  modified_base (361)..(361): a, c, t, g, unknown or other
  misc_feature (361)..(361): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggattcgccttcaataacttctggatgcactgggtccncaagctccagggaagggctgatttgggtctcacgtattaacattgatgggagtagctcacactatcggactccgtgaagggccattcacatcnccagacacacgccagaacacactgtatctgacaaatgagcacgcctagaaacgccgacgacgacggctgtagtattactgtgacgaaggcggggccagctattacctcctacttacctccgtactagtggaccgttcgtacggggccaacgggaccgtagggtacccg

SEQ ID NO: 203877 - DNA, 572 bp, Homo sapiens
  misc_feature: GYAE6OF02I6VTX.24.85.H08.1.454.CMB.1.raw
  modified_base (269)..(269): a, c, t, g, unknown or other
  misc_feature (269)..(269): n is a, c, g, or t
  modified_base (316)..(316): a, c, t, g, unknown or other
  misc_feature (316)..(316): n is a, c, g, or t
  modified_base (362)..(362): a, c, t, g, unknown or other
  misc_feature (362)..(362): n is a, c, g, or t
tcagactactatgtcacgaccggtgctcgatttagtatcactcagtcggcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggattccgccttcaatacttctggatgcactgggtccncaagctccgagggaagggctgatttgggctcgacgtattaacattgntgggatagctcacactatgcggactcgtggacggccattcacatcncagagacaacgcagaaaccacactgtactctagacaaatcgagcacgcctaggaaaccgcccgaacgaccgacggtcttaggttacgtaactttacgtgtacgactaaacggggacggggtccagtcctaacgtttacccgtccttaaccgttacctccggtattacggtacggaccgttcggtacgggaccgtaacgggccgtaccggg

SEQ ID NO: 203878 - DNA, 527 bp, Homo sapiens
  misc_feature: GYAE6OF02IVDVD.24.85.H08.1.454.CMB.1.raw
  modified_base (242)..(242): a, c, t, g, unknown or other
  misc_feature (242)..(242): n is a, c, g, or t
  modified_base (252)..(252): a, c, t, g, unknown or other
  misc_feature (252)..(252): n is a, c, g, or t
  modified_base (270)..(270): a, c, t, g, unknown or other
  misc_feature (270)..(270): n is a, c, g, or t
  modified_base (314)..(314): a, c, t, g, unknown or other
  misc_feature (314)..(314): n is a, c, g, or t
  modified_base (336)..(336): a, c, t, g, unknown or other
  misc_feature (336)..(336): n is a, c, g, or t
  modified_base (360)..(360): a, c, t, g, unknown or other
  misc_feature (360)..(360): n is a, c, g, or t
  modified_base (386)..(386): a, c, t, g, unknown or other
  misc_feature (386)..(386): n is a, c, g, or t
  modified_base (391)..(391): a, c, t, g, unknown or other
  misc_feature (391)..(391): n is a, c, g, or t
  modified_base (441)..(441): a, c, t, g, unknown or other
  misc_feature (441)..(441): n is a, c, g, or t
  modified_base (485)..(485): a, c, t, g, unknown or other
  misc_feature (485)..(485): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggattcgccttnaataacttcnggatgcacgtgggtcccnccaagcctccgaggggaagggctgatttgggctcacgtataacnttgatgggatagctcacactancgcgactccatgaaggcattcacntctcagacacacgcagaaacacactntatcngacaaatgagcacgcctagaacgccgaacgacacggctagtgtaattcgngtacgacgaagggacggggccagctaacttcctacctactaccnccgtatacgtggtaccgtcggtacgggaccgaagggacccgg

SEQ ID NO: 203879 - DNA, 529 bp, Homo sapiens
  misc_feature: GYAE6OF02JE36L.24.85.H08.1.454.CMB.1.raw
  modified_base (290)..(290): a, c, t, g, unknown or other
  misc_feature (290)..(290): n is a, c, g, or t
tcagactactatgtcacgaccggtgctcgatttagtatcactcagtcgcgggggagccccagccctgggattcccagctgtttctgcttgctgatcaggactgcacacagagaactcaccatggagtttgggctgagctgggttttccttgttgctattttaaaaggtgtccagtgtgaggtgcagctggtggagtccgggggaggcttagttcagcctggggggtccctgagactctcctgtgcagcctctggattcgccttcaataacttctggatgcactgggtccnccaagctccgagggaaggggctgatttgggtctcacgtattaacattgatgggagtagctcacactatgcggactccggtgaacgggccgattccacctatcctccagacgacaacgccaagaaacacactgtatctgacaaatgagcacgctagaacgccgacgacgacgctgtagtattacgtgtgacgaaggacggggaccagctattacctcctacctacctccgactagtacgg

SEQ ID NO: 203880 - DNA, 515 bp, Homo sapiens
  misc_feature: GYAE6OF02G9S0N.24.85.H08.1.454.CMB.1.raw
tcagactactatgtcacgaccggtgctcgatttagtatcactcagtcgcgggggagccccagccctgggattcccagctgtttctgcttgctgatcaggactgcacacagagaactcaccatggagtttgggctgagctgggttttccttgttgctattttaaaaggtgtccagtgtgaggtgcagctggtggagtccgggggaggcttagttcagcctggggggtccctgagactctcctgtgcagcctctggattcgccttcaataacttctggatgcactgggtccgccaagctccgaggggaagggctgatttgggctcacgtattaacattgatgggagtagctcacactatgcggactccggtgaacgggccgattccaccatctccagagacaacgccaagaaacacactgtatctgacaatgagcagcctagaacgccgacgacacggctgtgtattactgtgcgaaggaggggccagcattactcctacctactccgtctagtcgg

SEQ ID NO: 203881 - DNA, 544 bp, Homo sapiens
  misc_feature: GYAE6OF02FZXAW.24.85.H08.1.454.CMB.1.raw
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggattcgccttcaataacttctggatgcactgggtccgccaagctccgagggaggggctgatttgggtctcacgtattaacattgagtgggagtagctcacactatgcggactccgtgaacgggcctattcaccatcctccagagacaacgccaagaaaccacactagtactctagacaaatgagcagcctagaacgccgacgacgacggctgtgtattacgtgtgacgaaggacggggcagctacttaccgtcctacctacctccgtactacgtcggtaccgttcggtacggggaccgacgggaccgtacggg

SEQ ID NO: 203882 - DNA, 534 bp, Homo sapiens
  misc_feature: GYAE6OF02GAW8B.24.85.H08.1.454.CMB.1.raw
  modified_base (252)..(252): a, c, t, g, unknown or other
  misc_feature (252)..(252): n is a, c, g, or t
  modified_base (268)..(268): a, c, t, g, unknown or other
  misc_feature (268)..(268): n is a, c, g, or t
  modified_base (307)..(307): a, c, t, g, unknown or other
  misc_feature (307)..(307): n is a, c, g, or t
  modified_base (397)..(397): a, c, t, g, unknown or other
  misc_feature (397)..(397): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggattcgccttcaataacttcnggatgcactgggtccncaagctccagggagggctgatttgggctcacgtataacnttgatgggatagctcacactatgcgactccgtgaagggcattcacatctccagacgacaacgcagaaacacactgtatctgacaaatgancagcctagaacgccgacgacacggctagtgtattacgtgtcgacgaaggacggggaccagactacttaccgtccttactacctccgtacgtagtcggacgttccggtacggggaccgtaacggggacccgtaacggg

SEQ ID NO: 203883 - DNA, 719 bp, Homo sapiens
  misc_feature: GYAE6OF02H4AFD.24.85.H08.1.454.CMB.1.raw
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggattcgccttacaataacttctggatgcacgtggggtccgccgaagcctccgaaggggaaggggcttggtagttttgggtctcgaacgttaattaacatttgagttggggatagctacaactactagtggaccggacgttccggtaggaacggggtcccgtaagtttaccaacccgtacgttacctacccgaagggaaccgaaaccgaaacccggcccaaaagaaacccacgtaaccttagtaacttccgtagaaccaaaagtgaagaccagaccctaagaaaccgtccgaacgaaccgaccggtcttaggttacgttaacttacgtaggttacgacggtaaagggaccggggacctaaggaccttaacgttttaacccgtcccgttaaccctttaccggtccccggttacgttaacggttcgggtaaacccgggttccggtttaaccgggggggaaccctaacggggggtaccccgttaaccggggg

SEQ ID NO: 203884 - DNA, 558 bp, Homo sapiens
  misc_feature: GYAE6OF02I6ACV.24.85.H08.1.454.CMB.1.raw
  modified_base (396)..(396): a, c, t, g, unknown or other
  misc_feature (396)..(396): n is a, c, g, or t
  modified_base (416)..(416): a, c, t, g, unknown or other
  misc_feature (416)..(416): n is a, c, g, or t
  modified_base (455)..(455): a, c, t, g, unknown or other
  misc_feature (455)..(455): n is a, c, g, or t
  modified_base (468)..(468): a, c, t, g, unknown or other
  misc_feature (468)..(468): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggattcgccttcaataacttctggatgcactgggtccgccaagctccgagggaggggctgatttgggctcacgtattaacattgatgggatagctcactactatgcggtactccggtagaacgggcctaattccacctatcctccagacgacaacgccaagaaacncactgtatctgacaaatgancacgctagaaacgccgaacgacacggctgtagtattacngtgacgaaagggnggggaccagctaattacccgtccttaactacctccgacgttagtcgggtacccgttcggtacgggggacccaacggggtacccgtacggg

SEQ ID NO: 203885 - DNA, 539 bp, Homo sapiens
  misc_feature: GYAE6OF02I5SFK.24.85.H08.1.454.CMB.1.raw
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggattcgccttcaataacttctggatgcactgggtccgccaagctccgaggggaagggctgatttgggtctcacgtattaacattgatgggagtagctcacactatcgcggactccggtaggaacgggccgattcaccatctccagacgacaacgccaagaaacacactgtatctgacaaatgagcacgctagaacgaccgacgacacggctgttgtagttactgtcgacgaaggacggggccagctacttacctcctactcctccgtagtagtcggtaccggtcgacggggaccaacgggcctacggg

SEQ ID NO: 203886 - DNA, 683 bp, Homo sapiens
  misc_feature: GYAE6OF02HD4EM.24.85.H08.1.454.CMB.1.raw
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcgaggggtccctgagactctcctgtgcagcctctggacttccgccttcaataaccttcgtggatgcacgtcgggtccgcaagcctccgaggggaacgggcttggtagtttcgggctcgtacgtattaacatttgatgggatagctacaactactagtgccggtactccggtaggaacgggtccgtaactttccgaaccgtacttccgtaccgaaggaacgaaccaaaccggacccaaagaaaacctacctaaaccgttaggtaacttaccgtagtaaacgtaaaagttcggaagtaccgaacgtacccgttaagggaaaaccggacccggaaaccggaaccggaaccgggtcttacgggttacgttaacgtttaccgttaggtacggacgaaagggaccggggacctacggtactaacgttacctaccctacttaccgtccgtacgtagtcggtacgtcgtacggggaccaacgggaccgtacggg

SEQ ID NO: 203887 - DNA, 577 bp, Homo sapiens
  misc_feature: GYAE6OF02IMAE2.24.85.H08.1.454.CMB.1.raw
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggattcgccttcaataacttctggatgcacgtgggtccgcaagctccgagggagggctgatttgggtctcgacgtattaacattgagtgggagtagctcacactatgcggactccgtggaacggccgattcacctatcctaccagacgacaacgccaagaacacactagtactctagacaaatgagcacgcctagaaacgccgacgaccgacggcttgtagtattacgtagtagacgaaagggacggggaccaacgacgtaactttaccgtacccttaaccttaccgtcccgtacgtagttcgggtaccgttcggtacggggacccgaacggggacccgtaacgggg

SEQ ID NO: 203888 - DNA, 591 bp, Homo sapiens
  misc_feature: GYAE6OF02IRHCE.24.85.H08.1.454.CMB.1.raw
  modified_base (407)..(407): a, c, t, g, unknown or other
  misc_feature (407)..(407): n is a, c, g, or t
tcagactactatgtcacgaccggtgctcgatttagtatcactcagtcgcgggggagccccagccctgggattcccagctgtttctgcttgctgatcaggactgcacacagagaactcaccatggagtttgggctgagctgggttttccttgttgctatttaaaggtgtccagtgtgaggtgcagctggtggagtccgggggaggcttagttcagccgtggggggtccctgagactctcctgtgcagcctctggattcgccttcaataacttctggatgcacgtgggtcccgccaagcctaccgaggggaaggggctggtagtttggggtcctcgtaccgttaattaaccagttgagtgggagtagctacacactatggcggtactccgtagacggtccgattcaccntcctcagagacaacgacaacgaaacacactgtactctagacaaatgagcacgccgtagaaacgccgaacgaccgacggcgtagtagtacttacgtaggtcgacggaagggtaccgggggacctaaggaccgtaagtttaccctacccgttaacctacccgttacccgtaccgttagtaccgggg

SEQ ID NO: 203889 - DNA, 527 bp, Homo sapiens
  misc_feature: GYAE6OF02G4LXE.24.85.H08.1.454.CMB.1.raw
  modified_base (446)..(446): a, c, t, g, unknown or other
  misc_feature (446)..(446): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggattcgccttcaataacttctggatgcactgggtccgccaagcctccaggggaaggggctgatttgggctcacgtattaacattgatgggagtagctcacactatgcggactccgtgaacgggcattcaccatctcagagacaacgccagaaacacactgtatctgacaaatgagcagacctagaaacgccgacgacgacggctgtagtattacngtgcgaaggacggggcagctattaccgtcctactacctccgtctagtcggtacgtcgtcggggaccgagggaccgtacggg

SEQ ID NO: 203890 - DNA, 573 bp, Homo sapiens
  misc_feature: GYAE6OF02HD6TV.24.85.H08.1.454.CMB.1.raw
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggattcgccttcaataacttctggatgcactgggtccgccaagcctccgaggggagggctgatttgggctcacgtattaacattgatgggagtagctcactactatgcggactccggtgaacgggccattccaccatcctccagacgaccaacgccaagaaaccacactgtactctagactaaatgacgcacgcccgtagaaacgcccgaagaccgacggtcgtgttacgtacttacgtgtacgacgaagggacggggacctagggccttaacgttaccgtcctaccttaccgtccgtactggtacgacggttcggacgggaccggtacgggaccggtaccgg

SEQ ID NO: 203891 - DNA, 519 bp, Homo sapiens
  misc_feature: GYAE6OF02IPUDE.24.85.H08.1.454.CMB.1.raw
tcagactactatgtcacgaccggtgctcgatttagtatcactcagtcgcgggaggacgctgaccacacggtacgtgctgttgtactgctcctccccgcggctttgtcttggcattatgcacctccacgccgtccacgtaccagttgaacttgacctcagggtcttcgtggctcacgtccaccaccacgcatgtgacctcaggggtcccctgagactctcctgtgcagcctctggattcgccttcaataacttctggatgcactgggtcccgccaagctccgaggggaaggggctgatttgggctcgacgtattaacattgatgggatagctcacactatgcgactccgtgacgggccattcaccatctccagagacaacgccagaaaccacactgtatctgacaaatgagcagcctagaaacgccgacgacacggctgtgtattacgtgtgacaaggaggggccagcattactcctactctccgactatcggacgtcgacggggaccagggaccacggg

SEQ ID NO: 203892 - DNA, 670 bp, Homo sapiens
  misc_feature: GYAE6OF02HLSWT.24.85.H08.1.454.CMB.1.raw
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggattcgccttcaataacttctggatgcactgggtccgccaagctccgaggggaagggctgatttggggtcctacgtacgttaactaacgttagtagaggtagggtagtacgcgtacaactatgtcggaccgtaccgtcggtaacgggaccggtaccgttactaccgaacctactcccgtaacgaaggaccgaaaccgaaccgacgaaaaccgaaacccactaacgttagtacctacgtacgaaactaagtacggacgaaccgaccgtacgaaagaaccggaccgaacgaaccggcgttcgtagttacgtttaactggtacgtacgaaacggtaggggaccgggtacacgtaccgttaactttcccgtaacctaaccttcccgccgttattacggtacggtaccgtcggggaccggaaccgggaccggtacggtaccggg

SEQ ID NO: 203893 - DNA, 529 bp, Homo sapiens
  misc_feature: GYAE6OF02FJKXT.24.85.H08.1.454.CMB.1.raw
  modified_base (268)..(268): a, c, t, g, unknown or other
  misc_feature (268)..(268): n is a, c, g, or t
  modified_base (310)..(310): a, c, t, g, unknown or other
  misc_feature (310)..(310): n is a, c, g, or t
  modified_base (411)..(411): a, c, t, g, unknown or other
  misc_feature (411)..(411): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggattcgccttcaataacttctggatgcactgggtccnccaagctccaggggagggctgatttgggctcacgtattaacnttgatgggatagctcacactatgcggactccggtagaacgggccattcaccatcctccaagacgaccaacgccaagaaacacactgtatctgacaaatgancagcctagaaacgccgacgacacggctgtgtattactgtgacaaggacggggcagctactactcctactacctccgtactagtcggacgtcgtacggggaccgtacgggacctacggg

SEQ ID NO: 203894 - DNA, 600 bp, Homo sapiens
  misc_feature: GYAE6OF02IQAMR.24.85.H08.1.454.CMB.1.raw
  modified_base (270)..(270): a, c, t, g, unknown or other
  misc_feature (270)..(270): n is a, c, g, or t
  modified_base (314)..(314): a, c, t, g, unknown or other
  misc_feature (314)..(314): n is a, c, g, or t
  modified_base (363)..(363): a, c, t, g, unknown or other
  misc_feature (363)..(363): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtcccctgagactctcctgtgcagcctctggattcgcccttcaataacttctggatgcactgggtccnccaagcctccgagggaagggctgatttgggctcacgtattaacnttgatgggatgctcacactatgcgactccgtgaaggccattcaccatcnccagacgacaacgccaagaaaccacactgtactctgacaaatcgagcagccctagaaacgcccgacgaccacggctaggtgttacttacgtggtacgcgaaagggacgggggacccaggaccttaagttttaacccctacccgttaaaccttacccggtaccccgcgtttaacggtcggggtaaccggtttcccgggtacggggggacccctaaaacgggggtcccctaacgggggg

SEQ ID NO: 203895 - DNA, 540 bp, Homo sapiens
  misc_feature: GYAE6OF02G77M9.24.85.H08.1.454.CMB.1.raw
  modified_base (290)..(290): a, c, t, g, unknown or other
  misc_feature (290)..(290): n is a, c, g, or t
  modified_base (464)..(464): a, c, t, g, unknown or other
  misc_feature (464)..(464): n is a, c, g, or t
tcagactactatgtcacgaccggtgctcgatttagtatcactcagtcgcgggggagccccagccctgggattcccagctgtttctgcttgctgatcaggactgcacacagagaactcaccatggagtttgggctgagctgggttttccttgttgctattttaaaaggtgtccagtgtgaggtgcagctggtggagtccgggggaggcttagttcagcctggggggtccctgagactctcctgtgcagcctctggattcgccttcaataacttctggatgcactgggtccncaagcctccgaggggaagggctggagtttgggtctcgacgtattaacagttgagtgggatagctcacactatcgcggactccgtgaacgggccgtattccaccactctccagacgacacgaccaagaaacacactgtatctgacaatgagcagctagaacgccgacgacgacgntacgtgtacttacgtgtagacgtaaggacggggacagctaacttacctaccgttactacctccgtactagtaccgg

SEQ ID NO: 203896 - DNA, 633 bp, Homo sapiens
  misc_feature: GYAE6OF02JA1YU.24.85.H08.1.454.CMB.1.raw
  modified_base (435)..(435): a, c, t, g, unknown or other
  misc_feature (435)..(435): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggattcgccttcaataacttctggatgcacgtcgggtccgccaagctccgaggggaaggggctggtatttgggtcctcgaacgtattaacattgagtgggagtagctcacgatatcggacggtactcggtaggaacgggcctattccacctactcctaccagacgacaacgaccaagaaacacactgtactcagacaaagtgacncaacgcctaaggaacggacccgaacggaacgaccgggtcttacggttagttaactttacgtgttacgaaccggaaacggggtacgggggaccacggtactaaccgtttaccgtacccgttaacctacccggtaccgtacgttacgttcgggtacggttaccggtacgggggacccgtaacggggacccgtaaccgggg

SEQ ID NO: 203897 - DNA, 558 bp, Homo sapiens
  misc_feature: GYAE6OF02JNXSR.24.85.H08.1.454.CMB.1.raw
  modified_base (418)..(418): a, c, t, g, unknown or other
  misc_feature (418)..(418): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggattcgccttcaattaacttctggatgcacgtgggtccacaagctccgagggaagggctgagtttgggtctcgacgtattaacattgatgggagtagctcacatagtgcggactccgtagaacgggcctattcaccatctaccagacgacaacgccaagaaaccacactagtatcgtgacaaatgancacgcctagaaacgccgagacgacggtctagtagtattacgtgtagacgaaggacggggaccagctacttaccgtccttaactaccgtcccgacgttacgtcggtaccgtcggtacgggaccgtaacgggaccgtacggg

SEQ ID NO: 203898 - DNA, 538 bp, Homo sapiens
  misc_feature: GYAE6OF02GANYF.24.85.H08.1.454.CMB.1.raw
  modified_base (268)..(268): a, c, t, g, unknown or other
  misc_feature (268)..(268): n is a, c, g, or t
  modified_base (447)..(447): a, c, t, g, unknown or other
  misc_feature (447)..(447): n is a, c, g, or t
  modified_base (455)..(455): a, c, t, g, unknown or other
  misc_feature (455)..(455): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggattcgccttcaataacttctggatgcactgggtccnccaagcctccgaggggaaggggctggatttgggtctcacgtattaacattgatgggatagctcacactagtgcggactccggtgaacgggccattccaccatctccagagaccaacgccaagaaaccacactgtatctagacaaatgagcagcctagaacgccgacgacgacggctgtntacttagngtgacaaggacggggccagctaacttcctcctactacctccgctagtcggacggtccgtaggggaccctaagggccctacggg

SEQ ID NO: 203899 - DNA, 808 bp, Homo sapiens
  misc_feature: GYAE6OF02IWGB3.24.85.H08.1.454.CMB.1.raw
  modified_base (316)..(316): a, c, t, g, unknown or other
  misc_feature (316)..(316): n is a, c, g, or t
tcagactactatgtcacgaccggtgctcgatttagtatcactcagtcgcgggggagccccagccctgggattcccagctgtttctgcttgctgatcaggactgcacacagagaactcaccatggagtttgggctgagcttgggttttccttgttgctaatttaaaaggtgtccagtgtgaggtgcagcgtggtggacggtccggggaggtcgttagttcaggccgttcggggggtcctgacgactctcgtgtcgcacgcctcgtggtacttcgtccttacaattaacttcgtgaactgtcctacgtcgggttaccnccgtaaacgcccgttccggaagggggtaaacggggtccttaggggttaacgttttcggggtaccttaccgtaaaccggtttaaattttaaacgtaccgttaggtaaggttacggggtaagtaacggtcctaccgaacgtaacgttaacgtgggtaccggtaacttcccgggtaaggtaaccggggtaccgttaaacttccgaaaccgtacgttaccgtaacccgaaaggaaccgtaaacccgaaaccgtacccgaaaacgtaaaaccgtaaacctacgttaagttaacgtaccgtacggtaactaaaacgtgaaccgacgacgttaacgaacggaaacggtaccccggaaccggtaccgaaacgggtccttaggtaaccgttaagtttaccgtcggtaactaccggggaaaggggaccggggccaaacgttacgtaaccgtttaccgtaccgtttaacccgtaacccgttacggtaccttaaggttcccggg

SEQ ID NO: 203900 - DNA, 619 bp, Homo sapiens
  misc_feature: GYAE6OF02JRAFS.24.85.H08.1.454.CMB.1.raw
  modified_base (168)..(168): a, c, t, g, unknown or other
  misc_feature (168)..(168): n is a, c, g, or t
  modified_base (306)..(306): a, c, t, g, unknown or other
  misc_feature (306)..(306): n is a, c, g, or t
  modified_base (495)..(495): a, c, t, g, unknown or other
  misc_feature (495)..(495): n is a, c, g, or t
  modified_base (508)..(508): a, c, t, g, unknown or other
  misc_feature (508)..(508): n is a, c, g, or t
  modified_base (524)..(524): a, c, t, g, unknown or other
  misc_feature (524)..(524): n is a, c, g, or t
  modified_base (531)..(531): a, c, t, g, unknown or other
  misc_feature (531)..(531): n is a, c, g, or t
tcagactactatgtcacgaccggtgctcgatttagtatcactcagtcgcgggggaggccccagccctgggattcccagctgtttctgcttgctgatcaggactgcacacagagaactcaccatggagtttgggctgagctgggttttccttgttgctatttaaaggtntccagtgtgaggtgcagctggtggaggtccgggggaggtcgttaggttcaggtccgtgggggggtccctggagtactcgtccgtggtcgcaggccctcgtggacttcgccttcaatacttctggatgcactgggtccncgaagcctccgaggggaacggggcctaggacgttttggggtcctcgtaacggttatttaacagtttacggattggggaagtagtcctacgtaacacttagtcggccggtactccggtaggaacggggccgtattcgaacctgtacctccgaaggtaagacctaacggccaagaaaccacacgtagtacnctgacaagtcgancagcagaaacgccganacacgtnttcgagtaactcgtgtcgacggtaaacgggcggggacctaagaccgtacgttacctccgtaaccttaccgtccgtactaggttaccgg

SEQ ID NO: 203901 - DNA, 523 bp, Homo sapiens
  misc_feature: GYAE6OF02F5TAE.24.85.H08.1.454.CMB.1.raw
  modified_base (268)..(268): a, c, t, g, unknown or other
  misc_feature (268)..(268): n is a, c, g, or t
  modified_base (368)..(368): a, c, t, g, unknown or other
  misc_feature (368)..(368): n is a, c, g, or t
  modified_base (394)..(394): a, c, t, g, unknown or other
  misc_feature (394)..(394): n is a, c, g, or t
  modified_base (435)..(435): a, c, t, g, unknown or other
  misc_feature (435)..(435): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggattcgccttcaataacttctggatgcactgggtccnccaagctccagggaaggggctgatttgggctcacgtattaacattgatggggatagctcacactatgcgactccgtgaagggccattcaccatctcaganacaacgccagaaacacactgtatctnacaaatgagcagcctagaaacgccgacgacacggctaggtntagttactgtgcaaggaggggccagcattacgtcctactacctccgtactagtaggtaccgtcgtcggggcctacgggaccgtacggg

SEQ ID NO: 203902 - DNA, 591 bp, Homo sapiens
  misc_feature: GYAE6OF02ISP7B.24.85.H08.1.454.CMB.1.raw
  modified_base (462)..(462): a, c, t, g, unknown or other
  misc_feature (462)..(462): n is a, c, g, or t
  modified_base (477)..(477): a, c, t, g, unknown or other
  misc_feature (477)..(477): n is a, c, g, or t
  modified_base (482)..(482): a, c, t, g, unknown or other
  misc_feature (482)..(482): n is a, c, g, or t
  modified_base (515)..(515): a, c, t, g, unknown or other
  misc_feature (515)..(515): n is a, c, g, or t
tcagactactatgtcacgaccggtgctcgatttagtatcactcagtcgcgggggagccccagccctgggagttcccagctgtttctgcttgctgatcaggactgcacacagagaactcaccatggagtttgggctgaggcgtggttttctgttgcgtatttaaaggtgtcagtgtgaggtgcagctggtggaggtccggggagggcttagttcaggcgtgggggtcctgagctctcctgtgcagtcctctggtattccgccttcaattaaccttgtggatggcacgtcgggtccgccaagccgtaccgaaggggaggggctaggtgtttgggtcctactacggttattaaacagtttgaagttgggatagtctacacacgtatgcggtactccgtaggacggccgtagtttccgaactactcctacgaacgacgaacaacgaccaaacgaaacacactagtntctagactaatgaancgtanccgtagaaccacgaacgacgacgtctgtaactnttagtgactacggaaggggccggacacggtactaagtttaccgccttacctaccggccgttacgtacgttacgggg

SEQ ID NO: 203903 - DNA, 543 bp, Homo sapiens
  misc_feature: GYAE6OF02IG658.24.85.H08.1.454.CMB.1.raw
  modified_base (267)..(267): a, c, t, g, unknown or other
  misc_feature (267)..(267): n is a, c, g, or t
  modified_base (395)..(395): a, c, t, g, unknown or other
  misc_feature (395)..(395): n is a, c, g, or t
  modified_base (436)..(436): a, c, t, g, unknown or other
  misc_feature (436)..(436): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggattcgccttcaatacttctggatgcactgggtccnccaagctccgaggggaaggggctgtatttgggctcacgtataacattgatgggatagctcacactatgcggactccgtgaacgggcctattcaccatctcagacacaacgccaagaacacactagtanctgacaaatgagcagacctagaaacgccgacgacgaccggntggtgtattactgtgacgaaaggcggggaccagtactacttacctccttaacctccgtcccgtagtacgtcggacgtccggtcggggaccacggggacctaccgggg

SEQ ID NO: 203904 - DNA, 534 bp, Homo sapiens
  misc_feature: GYAE6OF02HGMSC.24.85.H08.1.454.CMB.1.raw
  modified_base (268)..(268): a, c, t, g, unknown or other
  misc_feature (268)..(268): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggattcgccttcaataacttctggatgcactgggtccnccaagcctccgaggggaaggggctgatttgggtctcacgtataacattgatgggatagctcacactatgcggactccggtgaacgggccattccgaaccatcctaccagacgacaacgccaagaaacacactgtactctgacaatgagcacgcctagaacgccgacgacacggctgtagtattacgtgtgacgaaggaggggccagctattacctcctacctactccgctagtcggacgtcgtacgggaccgacggaccgtacggg

SEQ ID NO: 203905 - DNA, 543 bp, Homo sapiens
  misc_feature: GYAE6OF02GGF0T.24.85.H08.1.454.CMB.1.raw
  modified_base (292)..(292): a, c, t, g, unknown or other
  misc_feature (292)..(292): n is a, c, g, or t
  modified_base (434)..(434): a, c, t, g, unknown or other
  misc_feature (434)..(434): n is a, c, g, or t
tcagactactatgtcacgaccggtgctcgatttagtatcactcagtcgcgggggagccccagccctgggattcccagctgtttctgcttgctgatcaggactgcacacagagaactcaccatggagtttgggctgagctgggttttccttgttgctattttaaaaggtgtccagtgtgaggtgcagctggtggagtccgggggaggcttagttcagccgtggggggtccctgagactctcctgtgcagcctctggattcgccttcaataaccttctggatgcactgggtccnccaagctccgaggggagggctgatttgggtctcacgtattaacattgatgggagtagctcacactatcgcggtactcgtgaacgggccattccaccatctaccagacgacaacgccaagaaacacactgtatcagacaaatnagcagcctagaacgccgacgaccgacggctagtagttatcgtgtcgacgaagggcggggaccaggtctaacgttacctaccgttacctaccgtaccgtactagtacggg

SEQ ID NO: 203906 - DNA, 527 bp, Homo sapiens
  misc_feature: GYAE6OF02HGAAP.24.85.H08.1.454.CMB.1.raw
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggattcgccttcaatacttctggatgcactgggtccgcaagcctccgagggaagggctgatttgggtctcacgttataacatttgatgggatagctcacactatgcggactccgtagacggccgattcacatctacgaagacgacaacgcaagaaacacaactgtatctagacaaatgagcagcctagaacgccgacgacacggctgtgtacttacgtgtgcgaaggagggccagctattaccgtcctactacctccgatagtcggacggtcgtcggggaccacgggaccgtacggg

SEQ ID NO: 203907 - DNA, 621 bp, Homo sapiens
  misc_feature: GYAE6OF02GBMDS.24.85.H08.1.454.CMB.1.raw
  modified_base (346)..(346): a, c, t, g, unknown or other
  misc_feature (346)..(346): n is a, c, g, or t
tcagactactatgtcacgaccggtgctcgatttagtatcactcagtcgcgggggagccccagccctgggattcccagctgtttctgcttgctgatcaggactgcacacagagaactcaccatggagtttgggctgagctgggttttccttgttgctattttaaaaggtgtccagtgtgaggtgcagctggtggagtccgggggaggcttagttcagccgtggggggtccctgagactctcctgtgcagcctctggattcgccttacaattaacttctggatgcacgtgggtcccgccaagcctccggaggggaagggctggtagtttgggtctcgacgtattaacnttgatgggatagctcacactatggacggactcgaggaacgggcctattccaccatcctaccaagacgaaccaacgccaaagaaaccacacgtagtactctagaacaaagtcgaagcaacgacctaaggaaaccgcccggaacggaaccgtacgggtccttagggttacgttaacgttccgtggtacggaacggtaaagggggaccggggaccctaaggaccttaacctttaccgtacccttaaccgttacccgcccggttacgttagtaccgggg

SEQ ID NO: 203908 - DNA, 542 bp, Homo sapiens
  misc_feature: GYAE6OF02GA5UM.24.85.H08.1.454.CMB.1.raw
  modified_base (389)..(389): a, c, t, g, unknown or other
  misc_feature (389)..(389): n is a, c, g, or t
  modified_base (435)..(435): a, c, t, g, unknown or other
  misc_feature (435)..(435): n is a, c, g, or t
tcagactactatgtcacgaccggtgctcgatttagtatcactcagtcgcgggggagccccagccctgggattcccagctgtttctgcttgctgatcaggactgcacacagagaactcaccatggagtttgggctgagctgggttttccttattgctattttaaaaggtgtccagtgtgaggtgcagctggtggagtccgggggaggcttagttcagccgtggggggtccctgagactctcctgtgcagcctctggattcgccttcaataacttctggatgcactgggtccgccaagctccgagggaagggctgagtttgggtctcacgtattaacattgatgggagtagctacacactatgcggtactccgtgaacgggccatcaaccntctccagagacaacaccagaaacacactgtactctagacaaatganacagcctagaaacgccgaacgacgacgctagtgtattactgtgacgaagggacggggaccagtactaacttacctacccttacctacctcccgtactacgtaccggg

SEQ ID NO: 203909 - DNA, 516 bp, Homo sapiens
  misc_feature: GYAE6OF02GZZ6A.24.85.H08.1.454.CMB.1.raw
  modified_base (268)..(268): a, c, t, g, unknown or other
  misc_feature (268)..(268): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggattcgccttcaataacttctggatgcactgggtccncaagctccgagggaagggctgatttgggtctcacgtattaacattgatgggatagctcacactatgcgactcgtgaacggcattcacatctcagagacaacgccagaaacacactgtatctgacaaatgagcacgctagaaacgccgacgacgacgctgtgtattacgtgtgcgaaggacggggcagcagttacctcctactactccgcgtatacggacgtcggtcgggaccgacgggacgtaacggg

SEQ ID NO: 203910 - DNA, 534 bp, Homo sapiens
  misc_feature: GYAE6OF02IE358.24.85.H08.1.454.CMB.1.raw
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggattcgccttcaataacttctggatgcactgggtcagccaagctccagggagggctgatttgggtctcacgtattaacattgatgggatagctcacactatgcggactccgtgaaggccgattcaccatctccagagacaacgccaagaaacacactgtatctgacaaatgagcagcctagaaacgccgaacgacgacggctgtacgtattactgtgacgaagggacggggccagctaattcctacctaactaccgtccgattacgtcgggtaccgttcggtacggggacccaaggggacccg

SEQ ID NO: 203911 - DNA, 535 bp, Homo sapiens
  misc_feature: GYAE6OF02G74V0.24.85.H08.1.454.CMB.1.raw
  modified_base (494)..(494): a, c, t, g, unknown or other
  misc_feature (494)..(494): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggattcgccttcaataacttctggatgcactgggtccgccaagctccgagggaaggggctgatttgggtctcacgtattaacattgatgggagtagctcacactatgcggactccgtggaagggccgattcaccatctccagacgacaacgccagaaacacactgtatctgacaaatgagcagcctagaaacgccgaacgaccacggtctggtagtattacgtgtagcgaaggacggggccagcctattacctcctacttaccnccgtctagtcggacgtcgtcggggaccaagggacccacggg

SEQ ID NO: 203912 - DNA, 519 bp, Homo sapiens
  misc_feature: GYAE6OF02HJZJJ.24.85.H08.1.454.CMB.1.raw
  modified_base (268)..(268): a, c, t, g, unknown or other
  misc_feature (268)..(268): n is a, c, g, or t
  modified_base (330)..(330): a, c, t, g, unknown or other
  misc_feature (330)..(330): n is a, c, g, or t
  modified_base (356)..(356): a, c, t, g, unknown or other
  misc_feature (356)..(356): n is a, c, g, or t
  modified_base (361)..(361): a, c, t, g, unknown or other
  misc_feature (361)..(361): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggattcgccttcaataacttctggatgcactgggtccnccaagctccgagggagggctgatttgggctcacgtataacattgatgggatagctcacactngcgactccgtgaaggcattcacatcncaganacacgccagaacacactgtactctgacaaatgacgacacgcctagaacgccgacgacgacggctgtagtacttacgtgtgacgaaggacggggccagctacttacctcctactcctcgtctagtcggacgtcggtacgggccgacgggaccgtacggg

SEQ ID NO: 203913 - DNA, 543 bp, Homo sapiens
  misc_feature: GYAE6OF02HGICY.24.85.H08.1.454.CMB.1.raw
  modified_base (394)..(394): a, c, t, g, unknown or other
  misc_feature (394)..(394): n is a, c, g, or t
  modified_base (497)..(497): a, c, t, g, unknown or other
  misc_feature (497)..(497): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggattcgccttcaataacttctggatgcactgggtccgccaagctccgagggagggctgatttgggtctcacgtattaacattgatgggagtagctcacactatgcgactccgtgacggccgattcaccatctccagagacaacgcaagaaacacactgtatcngacaaatgagcacgcctagaaacgcccgaacgacgacggcttacgttgtaactttacgtagtgaaccgaagggacggggcacgctattacctcctaacgtccnccgtatagtcggacgttccgcgggggacctaagggaccctacgggg

SEQ ID NO: 203914 - DNA, 572 bp, Homo sapiens
  misc_feature: GYAE6OF02GOH1T.24.85.H08.1.454.CMB.1.raw
  modified_base (394)..(394): a, c, t, g, unknown or other
  misc_feature (394)..(394): n is a, c, g, or t
tcagactactatgtcacgaccggtgctcgatttagtatcactcagtcgcggggagccccagccctgggattcccagctgtttctgcttgctgatcaggactgcacacagagaactcaccatggagtttgggctgagctgggttttccttgttgctattttaaaggtgtccagtgtgaggtgcagctggtggagtccggggaggcttagttcagccgtgggggtccctgagactctcctgtgcagcctctggattcgcctccaataacttctggatgcactgggtccgccaagcctccgagggaagggctgatttgggtctcacgtattaacattgagtgggagtagctcacactatgacggtactccggtagaacgggcgtacttcaacatccncagagaccaacgaccaagaaacaccactagtactcgtagcaaagtgaagcacgaccgtagaaacgacccgaacgaccgacggcttacggtagttattactggttacgaccggtaaagggacggggaccctaggaccttagtttacccgtcctaacttacccgtcccgacttagtcggg

SEQ ID NO: 203915 - DNA, 529 bp, Homo sapiens
  misc_feature: GYAE6OF02G7K77.24.85.H08.1.454.CMB.1.raw
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggattcgccttcaataacttctggatgcacgtgggtccgccaagctccaggggagggctgatttgggctcacgtattaacattgagtgggagtagctcacactatgcgactccgtgaagggccattcaccatcctcagacgacaacgccagaaacacactgtatctagacaaatgagcacgcctagaacgccgacgacacggctgtgtattactgtgacgaaggacggggccagactacttacgtcctactaccgtccgtactagtcggacgtcgtcggggaccgacgggacctacggg

SEQ ID NO: 203916 - DNA, 621 bp, Homo sapiens
  misc_feature: GYAE6OF02HVF67.24.85.H08.1.454.CMB.1.raw
  modified_base (268)..(268): a, c, t, g, unknown or other
  misc_feature (268)..(268): n is a, c, g, or t
  modified_base (337)..(337): a, c, t, g, unknown or other
  misc_feature (337)..(337): n is a, c, g, or t
  modified_base (386)..(386): a, c, t, g, unknown or other
  misc_feature (386)..(386): n is a, c, g, or t
  modified_base (392)..(392): a, c, t, g, unknown or other
  misc_feature (392)..(392): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggattcgccttcaataacttctggatgcactgggtccncaagcctccgaggggaagggctgtagtttgggtctcgacgtattaacatttgagtagggatagctcacnctatgcgctcgtggaggcattcatcaatcacgagacgacaacgaccaanaaaccncaacttgtacttcgtacgactaaagtgaacgcacgacctaaggaaaacgcccggaacgaacgacggtacttggtacttagtttacgtcgttacgaacgaaaggggaccggggacctaggtaaccttaacgtttaccctaacccgttaaccttacccgtacccggtaacttacggttacggggtaccgttacccgggtaccgggggtaccccggtaaagggtaccccggg

SEQ ID NO: 203917 - DNA, 528 bp, Homo sapiens
  misc_feature: GYAE6OF02IUK8V.24.85.H08.1.454.CMB.1.raw
  modified_base (252)..(252): a, c, t, g, unknown or other
  misc_feature (252)..(252): n is a, c, g, or t
  modified_base (268)..(268): a, c, t, g, unknown or other
  misc_feature (268)..(268): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggattcgccttcaataacttcnggatgcactgggtccnccaagctccagggagggctgatttgggctcacgtattaacattgatgggatagctcacactagtgcgactccgtgaacgggccattcaccatctccagacgacaacgccaagaaacacactgtatctagacaaatgagcacgctagaacgccgacgacacggctagtgtactacgtgtagacgaggacggggaccagctattaccgtctacctctccgacgtagtcggtaccgtcggtacgggaccgagggccgtacggg

SEQ ID NO: 203918 - DNA, 538 bp, Homo sapiens
  misc_feature: GYAE6OF02G8ZHY.24.85.H08.1.454.CMB.1.raw
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggattcgccttcaataacttctggatgcactgggtccgccaagctccaggggaaggggctgatttgggtctcacgtattaacatttgatgggatagctcacactatgcggactccgtgaacgggcctattcaccatctccagacgacaacgcagaaacacactgtatctgacaaatgacgcacgacctagaaacgccgacgacgacggctgtagtattactgtgcgaaggacggggcaggctaagttacctcctaactactccgacttagtacggtacgtcgtcggggaccgaacgggaccgtacggg

SEQ ID NO: 203919 - DNA, 545 bp, Homo sapiens
  misc_feature: GYAE6OF02GBC73.24.85.H08.1.454.CMB.1.raw
  modified_base (410)..(410): a, c, t, g, unknown or other
  misc_feature (410)..(410): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggattcgccttcaataacttctggatgcactgggtccgcaagctccgaggggaaggggctgatttgggtctcacgtattaacattgatggggatagctcacactagtgcggactccgtgaagggccgattcacatcctccagagacaacgccaagaaacacactgtatctgacaaatgancaagcctagaaacgccgacgacgacggctagtgtattacgtgtgacgaaaggcggggccagctacttacctccttaactaccgtccgacttagtcggtacgtccggtacggggaccaacggggaccgtaacgggg

SEQ ID NO: 203920 - DNA, 833 bp, Homo sapiens
  misc_feature: GYAE6OF02HGEQY.24.85.H08.1.454.CMB.1.raw
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggattcgcctttcaataacttcgtggatgcacgtcgggtccaccaagcctaccgaggggaacggggtctggtaagttttcggggtcctcgtaaccgttaattaaccattttaggaacgttaggggaagttaacggtcctaccgtaactaaccgttattcggacccggtaacctccggtaggaaacggggccgtaactttccgaaccctattcccgtacccaaggtaacgaaccgaacccgtaacccgaaacgaaaacctaccgtaacgttacggttaacttccgttacgaactaaaaacgttcggaaacggtacccaaaccgggtcccgttaaacggaaaaccggtaccccggtaaacccggtaaccggaacccggggttaccttacgggtttaacgtaaacttttaacccggtggttaaccggaaccggtaaaaggggaacccggggggtaccctaaggtaccgttaaccgttttaacccggttaccccttaaccgtttaaacccgtccccggttaaccgtttaaccgggttaccgggttaaccccggtttacgggtacccgggggaaccccgtaaccggggggtaaccccccttaaggggg

SEQ ID NO: 203921 - DNA, 541 bp, Homo sapiens
  misc_feature: GYAE6OF02GBDGK.24.85.H08.1.454.CMB.1.raw
  modified_base (340)..(340): a, c, t, g, unknown or other
  misc_feature (340)..(340): n is a, c, g, or t
  modified_base (441)..(441): a, c, t, g, unknown or other
  misc_feature (441)..(441): n is a, c, g, or t
  modified_base (471)..(471): a, c, t, g, unknown or other
  misc_feature (471)..(471): n is a, c, g, or t
tcagactactatgtcacgaccggtgctcgatttagtatcactcagtcgcgggggagccccagccctgggattcccagctgtttctgcttgctgatcaggactgcacacagagaactcaccatggagtttgggctgagctgggttttccttgttgctattttaaaggtgtccagtgtgaggtgcagctggtggaggtccgggggaggcttagttcagcctggggggtccctgagactctcctgtgcagcctctggattcgccttcaataacttctggatgcactgggtccgccaagcctccgaggggaaggggctggatttggggctcgacgttattaacnttgatgggatagctcacactatgcggactccgtgaacgggccgattccaacatctaccagagacaacgccaagaaaccacactgtactcgtgacaaatgancagccagaacgccgaacgacgacgctggtntattctgtcgacgaagggacggggccaggctaagttaccgtacctaccgtaccgtccgtactagtccggg

SEQ ID NO: 203922 - DNA, 581 bp, Homo sapiens
  misc_feature: GYAE6OF02I7C5Q.24.85.H08.1.454.CMB.1.raw
  modified_base (270)..(270): a, c, t, g, unknown or other
  misc_feature (270)..(270): n is a, c, g, or t
  modified_base (369)..(369): a, c, t, g, unknown or other
  misc_feature (369)..(369): n is a, c, g, or t
  modified_base (372)..(372): a, c, t, g, unknown or other
  misc_feature (372)..(372): n is a, c, g, or t
  modified_base (377)..(377): a, c, t, g, unknown or other
  misc_feature (377)..(377): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggattcgccttcaataacttctggatgcacgtcgggtccnccaagcctccgaaggggagggctggtatttgggctcgacgttattaacattgagtgggatagctcacactagtgcggactcggtagacggcgtatcacntcncaganacacgccaagaacacactgtatcagaacaagtgagcacgtcctaaggaacgcccgaagaccgacggtcttaggtacgttacttacgtagtacgaacgtaaagggcgggaccagtctaacctttaccgtaccttaacctacgtacccgtagttacgtacgggtaccgtccgggtaccggggaacccgacggggtacccgtacggg

SEQ ID NO: 203923 - DNA, 530 bp, Homo sapiens
  misc_feature: GYAE6OF02FJPSY.24.85.H08.1.454.CMB.1.raw
  modified_base (252)..(252): a, c, t, g, unknown or other
  misc_feature (252)..(252): n is a, c, g, or t
  modified_base (268)..(268): a, c, t, g, unknown or other
  misc_feature (268)..(268): n is a, c, g, or t
  modified_base (342)..(342): a, c, t, g, unknown or other
  misc_feature (342)..(342): n is a, c, g, or t
  modified_base (393)..(393): a, c, t, g, unknown or other
  misc_feature (393)..(393): n is a, c, g, or t
  modified_base (435)..(435): a, c, t, g, unknown or other
  misc_feature (435)..(435): n is a, c, g, or t
  modified_base (455)..(455): a, c, t, g, unknown or other
  misc_feature (455)..(455): n is a, c, g, or t
  modified_base (486)..(486): a, c, t, g, unknown or other
  misc_feature (486)..(486): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggattcgccttcaataacttcnggatgcactgggtccnccaagctccagggaagggctgatttgggtctcacgtattaacattgatgggatagctcacatatgcggatccgngagggccattcacatctccagagaccaacgcaacgaaacacactgtaatcngacaaagtgagcgagcctagaaacgccgacgacacggctgtntattacgtgtcgacgaaggnggggaccaggcattaccgtaccctactaccnccgtactacgtcggacgttcgacggggccaagggccctaacggg

SEQ ID NO: 203924 - DNA, 610 bp, Homo sapiens
  misc_feature: GYAE6OF02JIM8W.24.85.H08.1.454.CMB.1.raw
  modified_base (229)..(229): a, c, t, g, unknown or other
  misc_feature (229)..(229): n is a, c, g, or t
  modified_base (268)..(268): a, c, t, g, unknown or other
  misc_feature (268)..(268): n is a, c, g, or t
  modified_base (545)..(545): a, c, t, g, unknown or other
  misc_feature (545)..(545): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctntggattcgccttcaataacttctggatgcactgggtccnccaagctccgaggggaagggctgtagtttgggtctcgacgtaattaacgattgagtggggagtagctcaactactagtgcggtacctccggtagaacggggcctattccaactatcctccagacgacacgaccaagaaacacactgtactcgtgactaaatgagacacgaccgtagaaacgaccgacgaccgacggcttacggttagttaagttacgtgttcgaacgaaacgggacggggtaccaggtacctaacttaccgttaccgtaaccttacncccggttacgtacgtacgggtaaccggtcggtaccggggaccggaacggggtacccgtaccgggg

SEQ ID NO: 203925 - DNA, 538 bp, Homo sapiens
  misc_feature: GYAE6OF02G8W7Y.24.85.H08.1.454.CMB.1.raw
  modified_base (289)..(289): a, c, t, g, unknown or other
  misc_feature (289)..(289): n is a, c, g, or t
  modified_base (466)..(466): a, c, t, g, unknown or other
  misc_feature (466)..(466): n is a, c, g, or t
  modified_base (472)..(472): a, c, t, g, unknown or other
  misc_feature (472)..(472): n is a, c, g, or t
  modified_base (486)..(486): a, c, t, g, unknown or other
  misc_feature (486)..(486): n is a, c, g, or t
tcagactactatgtcacgaccggtgctcgatttagtatcactcagtcgcgggggagccccagccctgggattcccagctgtttctgcttgctgatcaggactgcacacagagaactcaccatggagtttgggctgagctgggttttccttgttgctattttaaaaggtgtccagtgtgaggtgcagctggtggagtccgggggagcttagttcagccgtgggggtccctgagactctcctgtgcagcctctggattcgccttcaataacttctggatgcactgggtccncaagctccgagggagggctgagtttgggctcacgtattaacattgagtgggagtagctacacactatgcggacttccgtagaagggccgattaccacctatcctcaggacgaccaacgccaagaaaccacaacgtgtatctagacaaatgaagcagccgtagaaacgccgaacgacnccggtntgtgtattacgtgngacgaaggacggggccagacacgttaccacctactacctccgtctagtcggg

SEQ ID NO: 203926 - DNA, 878 bp, Homo sapiens
  misc_feature: GYAE6OF02I0UIW.24.85.H08.1.454.CMB.1.raw
tcagactactatgtcacgaccggtgctcgatttagtatcactcagtcgcgggggagccccagccctgggattcccagctgtttctgcttgctgatcaggactgcacacagagaactcaccatggagtttgggctgagcttgggttttccttgttgcttaattttaaaaggtgtccagtgtgaggtgcagcgtggtggaggtccgggggagtctttagttcgaggccgtggggggtccctggagtcctctccgtgtgcgtacgccttcgtggtactttccgtccttactaaacttaacgtttccgtggattcgaccgtaccggttcgggtcccgacccgaaaggtcctaccggaagggggaacgggtccttaggtaagttttcggggtaccttaccgtaacgttaagttaaccgtagtttaggaaggttaggggtaacgtacggtaccttacaacgtaccgttaaggttcggaccggttaccgttacccggtaaggggaaacggggtacccgttaacgtttaccaacccttaacggttacccttaaccggaaagggaaaaccgaacccgaaaacccgggtaacccaaaacggtaaaaaccaacccgtaaacgttacggttaattaccgttaaacggaaacctaaaacggttcggaaacggacccgtaaaccggtacccgttaaagggaaaaccccggtacccgggaaacccggtaacccgtaccggggttaacccgtagttttaaccgggttaactttaccgggtaggtaacggaccgggttaaaacggggcccgggggtaacctaacggtacgtttaaccgttaacccgtttacccgtaacccgtacccggttacccgttacgttaaccggttcgggg

SEQ ID NO: 203927 - DNA, 561 bp, Homo sapiens
  misc_feature: GYAE6OF02FP0RM.24.85.H08.1.454.CMB.1.raw
  modified_base (455)..(455): a, c, t, g, unknown or other
  misc_feature (455)..(455): n is a, c, g, or t
tcagactactatgtcacgaccggtgctcgatttagtatcactcagtcgcgggggagccccagccctgggattcccagctgtttctgcttgctgatcaggactgcacacagagaactcaccatggagtttgggctgagctgggttttccttgttgctattttaaaaggtgtccagtgtgaggtgcagctggtggagtccgggggagcttagttcagccgtggggggtccctgagactctcctgtgcagcctctggattccgccttcaattaacttctggatgcacgtcgggtccgccaagcctccgaggggaggggctggtagtttcgggtctcgacgttattaacagttgagtgggatagctcactactagtgcggtactccggtagaacgggccgatttccacactcctaccagagaccaacgaccaagaaacacatgtatcagacaagtcgancagcctaaggaaccgccgaacgacgacggtctgttacgtagttactgtagacgaagggaggggcccagactacgttacctcctaacgttacctcgtactagtcggg

SEQ ID NO: 203928 - DNA, 544 bp, Homo sapiens
  misc_feature: GYAE6OF02GXHLC.24.85.H08.1.454.CMB.1.raw
  modified_base (268)..(268): a, c, t, g, unknown or other
  misc_feature (268)..(268): n is a, c, g, or t
  modified_base (309)..(309): a, c, t, g, unknown or other
  misc_feature (309)..(309): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggattcgccttcaataacttctggatgcactgggtccncaagctccaggggagggctgatttgggctcacgtattaacnttgatggggatacgctcacactatcgcggactccggtagaacgggcctaattccacctagtcctaccgaagacgaccaacgccaagaaacacactgtactctagacaaatgagcacgcctagaacgccgacgaccacggctgtagtattcgtgtagcgaaggacggggcagctattacctcctaactacgtccgactagtacggccgtcggacgggaccgacgggaccgtacggg

SEQ ID NO: 203929 - DNA, 658 bp, Homo sapiens
  misc_feature: GYAE6OF02ILEVF.24.85.H08.1.454.CMB.1.raw
tcagactactatgtcacgaccggtgctcgatttagtatcactcagtcgcgggggagccccagccctgggattcccagctgtttctgcttgctgatcaggactgcacacagagaactcaccatggagtttgggctgagcttgggttttccttgttgctattttaaaaggtgtccagtgtgaggtgcagctgggtggaggtccgggggaggtcttagttcagccgtggggggtccctgagtactctcctgtgcacgcctcgtggtacttccgccttacaaattaacttcgtggatcgctacgtcgggtccgaccaagcctaccggaggggaacggggtctaggtagtttgggtcctacgtacgttaattaactagttagagtggagtagctacactactagtcggaccggtactcggtagaacgggcctacttaccactactcctaccaagacgaaccgaacgacaaacgaaaccactaacgtagtactactacgaactaaagtcgacgaccacgtacctaaaggaaaccggaccgaacgaccgacggtccgttagtacgttaattacgtggtaacggacggaagggtaccggggaccaacggtaccttaaccgttaccttacccgtaaccttacccgtcccgtacgttacggtaccggg

SEQ ID NO: 203930 - DNA, 538 bp, Homo sapiens
  misc_feature: GYAE6OF02GTWQF.24.85.H08.1.454.CMB.1.raw
tcagactactatgtcacgaccggtgctcgatttagtatcactcagtcgcgggggagccccagccctgggattcccagctgtttctgcttgctgatcaggactgcacacagagaactcaccatggagtttgggctgagctgggttttccttgttactattttaaaaggtgtccagtgtgaggtgcagctggtggagtccgggggaggcttagttcagcctgggggtccctgagactctcctgtgcagcctctggattcgccttcaataacttctggatgcactgggtccgccaagctccgaggggaaggggctggatttgggtctcacgtattaacattgatgggatagctcacactatgcggactccgtgaagggccattcaccatctcagagacaacgccaagaaaccacactgtatctgacaaatgagcagcctagaaacgccgacgacacggctgtgtattactgtgacgaagggacgggggaccaggcctaacttacctacccttacctacctccgtacttacgtcggtaccgg

SEQ ID NO: 203931 - DNA, 576 bp, Homo sapiens
  misc_feature: GYAE6OF02JHKFH.24.85.H08.1.454.CMB.1.raw
  modified_base (350)..(350): a, c, t, g, unknown or other
  misc_feature (350)..(350): n is a, c, g, or t
  modified_base (443)..(443): a, c, t, g, unknown or other
  misc_feature (443)..(443): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggattcgccttcaataacttctggatgccacgtcgggtccgaccaagcctcccgaggggaacggggctggagtttgggtcctcgacgttattaacagtttgatggggatagctcacactntcggacggactccgtaggaacgggtccgattccaccattccaccgagtacgacaaccgaccaagaaaccacacgtagtactctgacaaatgancagccgtagaacgccgagaccacggctagtacgtattacgtgtcgacgaaggcggggaccagtctaacgttaccgtcctaactaccgtccgattacgtacggtcgttccgacggggccaacgggtctaacggg

SEQ ID NO: 203932 - DNA, 748 bp, Homo sapiens
  misc_feature: GYAE6OF02JGB3H.24.85.H08.1.454.CMB.1.raw
  modified_base (497)..(497): a, c, t, g, unknown or other
  misc_feature (497)..(497): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggtacttccgtcccttcaaattaacctttctagggatgccacgtggggtcccaccaaggcctacccgagggggaacggggctaggtagtttcggggtcctaccgaacgttaattaaccatttggaacgttagggggaagttacggcttaccactaaccgttagttcggaccgggtaaccttccgggtacgggaacggggtcccgtaatttacccgaccgtaacttcctacccgaagtaacgaccgaaccgacccgaaagaaaacccncgtaacttggttaacttctaggaacctaaaagtcggaacgtccgaacggtcccttaaagggaaacccggcccgaaacggacccgtaacgggtccttaggtacgtttaacgttaacttggtacgaacggaaagggacggggtacccaaggtaccctaatttacccgtcccttaacctacccgttccgactttaaggtccgggtaaccggttccggtaccggggaaccccggtaacgggtacccggtacgggg

SEQ ID NO: 203933 - DNA, 579 bp, Homo sapiens
  misc_feature: GYAE6OF02FTOPZ.24.85.H08.1.454.CMB.1.raw
  modified_base (320)..(320): a, c, t, g, unknown or other
  misc_feature (320)..(320): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggattcgccttcaattaacttctggatgcacgtgggtcccgccaagcctccgaggggaaggggctgtatttgggtctcacgttattaacntttgatggggatagctcacactatggcggactccgtaggacggccgtattcaccatcctaccgagacgaccaacgccaagaaaccacactgtatctgacaaagtgagcagcctagaaacgccgaacgacgacggtctagttagtacttacgtgtcgacgaacgggacggggccagtctagttaccgtaccttacctaccgtccgtacgttacgtacgggtaccgtacggtacggggaccggtaacgggaccgtaccggg

SEQ ID NO: 203934 - DNA, 592 bp, Homo sapiens
  misc_feature: GYAE6OF02I2A80.24.85.H08.1.454.CMB.1.raw
  modified_base (268)..(268): a, c, t, g, unknown or other
  misc_feature (268)..(268): n is a, c, g, or t
  modified_base (330)..(330): a, c, t, g, unknown or other
  misc_feature (330)..(330): n is a, c, g, or t
  modified_base (340)..(340): a, c, t, g, unknown or other
  misc_feature (340)..(340): n is a, c, g, or t
  modified_base (450)..(450): a, c, t, g, unknown or other
  misc_feature (450)..(450): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggattcgccttcaataacttctggatgcactgggtccncaagctccgagggaagggctgtagtttgggtcctcacgttattaacatttgagtgggagtanctcacactancgcgactcgtagacggcattcacatctcagacgacaacgcaacgaaacacacttagtactcgtagacaaatgaacgcaacgccgtagaaacgcccgaacgaccgacggtnttacgtgttattaggttgagaacgaagggacggggaccaggtacctatttacccgtacctaacctttaccggtacccgtacgttacgtaccgggttacggttccgggtaccggggaccgtaaacgggggcccgtaaccgggg

SEQ ID NO: 203935 - DNA, 753 bp, Homo sapiens
  misc_feature: GYAE6OF02I9U10.24.85.H08.1.454.CMB.1.raw
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcagggtccctgagactctcctgtgcagcctctggattcgccttcaatacttctggatgcactgggtcccgccaagcctaccgaggggaacggggctggtacttttggggtcctaccgacggttatttaaaccgagtttggaagttggggaacgttaacgccttaccgaactaaccgttagtcggtccggtacccttccgggtaggaacggggtacccgtatttcccgaaccattccaccgaaggaacgaaccaaaccgccgaaacgaaaccgaccaacgttagtaactccgtagaacctaaagtacgaacggtaccgaaggtaccccgtaaggaaaaccggccccggtaaaccggaaccgtaacccggggtccttaggtttaccgttaaacgttttacgtacggttacgaaccggtaaacggggccggggggtaccctacgggtaccttaacggtttacccttaacccgttaaccgttacccgtacccggtattaacccggtgggttaacccggtccggttacggggaacccgtaacgggggtacctaacccgggg

SEQ ID NO: 203936 - DNA, 536 bp, Homo sapiens
  misc_feature: GYAE6OF02FVZ9P.24.85.H08.1.454.CMB.1.raw
  modified_base (323)..(323): a, c, t, g, unknown or other
  misc_feature (323)..(323): n is a, c, g, or t
  modified_base (367)..(367): a, c, t, g, unknown or other
  misc_feature (367)..(367): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggattcgccttcaataacttctggatgcactgggtccgcaagctccagggaagggctgatttgggctcacgtattacattgatgggatagctnacactatgcggactccgtagaagggccgattcaccatctcaganacaacgcaagaaacacatgtatctgacaaatgagcagcctagaaacgcgacgacacggctagtgtattacgtgtgacgaaggtggggaccagaccattacctccctaactaccgtcccgattacgtacggtaccgttccggtgggaccccgtaaggggaccctacgggg

SEQ ID NO: 203937 - DNA, 685 bp, Homo sapiens
  misc_feature: GYAE6OF02IAU90.24.85.H08.1.454.CMB.1.raw
  modified_base (312)..(312): a, c, t, g, unknown or other
  misc_feature (312)..(312): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggacttcgccttacaataacttctggatgcacgtggtccgccaagctccgagggagggctgtagtttggctcacgtataacnttgagtgggagtagctacaactactagtggacggactccggtaggaacgggccgtaacttccgaccctagtacctaccgaagacgaaccgaaccgacccgtaacggaaaaccaacctaccgttacgtaactacgttacggaactaaacgtggaacgacctaacgtacccgtaagaaacccggaccgaacgaaccgacggtaccttaggtacgttaacgtttacgtaggttacgtaaccggaaagggtaccgggggaccaacggtaccttaacgtttacccgttacccttacccgttaaccgttcccgttacgtacggttacggaccggttccgggtaaccggggacccgtaacggggtacccggtaaccgggg

SEQ ID NO: 203938 - DNA, 670 bp, Homo sapiens
  misc_feature: GYAE6OF02GGN65.24.85.H08.1.454.CMB.1.raw
tcagactactatgtcacgaccggtgctcgatttagtatcactcagtcgcgggggagccccagccctgggattcccagctgtttctgcttgctgatcaggactgcacacagagaactcaccatggagtttgggctgagctgggttttccttgttgcttattttaaaaggtgtccagtgtgaggtgcagctgggtggaggtccgggggaggcttagttcagccgtggggggtccctgagactctcctgtgcagcctctggattccgccttcaattaaccttctggatggcacgtggggtcccgccaagccgtccggaggggaaggggctggtagtttgggtctcgtacgtattaacattgatgggatagctcacactatgcgactccgtggaacggccgtattccactatcctcagacgacaaccgacaagaaaccacactacgttactcgttagacaaatcgaacgtaccaacggtccctaagggaaaccgaccccggtaaaccggaaccgtaaccgggtcgttaggttaacgggttaactttacggttcggtacgggtaacggtaaaggggggaccgggggtaccccgaaggtaccgttaacgttttaaccccgttaccctttaaacccgtacccggtttaccccggtacccgttaaggttaacccgggg

SEQ ID NO: 203939 - DNA, 748 bp, Homo sapiens
  misc_feature: GYAE6OF02JGUEY.24.85.H08.1.454.CMB.1.raw
  modified_base (172)..(172): a, c, t, g, unknown or other
  misc_feature (172)..(172): n is a, c, g, or t
tcagactactatgtcacgaccggtgctcgatttagtatcactcagtcgcgggggagccccgacgcccgtgggacttcccagctgtttctgtcttgctgatcaggactgcacacagagaactcaccatggagttgggctgagctgggtttccttgttgcttattttaaaggtntctagtgtgaggtgcagtcgtggtgggagtccgggggagtcgttagttcgagtccgtggggggtccctgaggtactcgtcctgtcgcagtcctcgtggtacttccggcctttacaaacttaaccttcgtgggtaattcggacctacggttcggggtacccctccgaaacggtcccgtacccggaagggggtaaacggggcctttaaggtacggttttcgggggttacctccggttaacggttaaacttttaaaccgagttttaggaaacggttcgggggtaacgttaacgtccgtacctaacgtaccgttaagtccggacggttaccgtaccgtagggaaacggggtcctatttacccgactagtccctaacagtaacgacctacgaccaaagaaccacgtactacgtaactcgtaagacctaaagtcgacggtacacggtaccctaagggaacgacccggaaagacccgtacggtaccttaggtacgttacttaccgtgtacggaacgtaacgggacggggtacaacgtcttaacttacccgtaccgtaccttacgtacccgtgtacgtaccggg

SEQ ID NO: 203940 - DNA, 553 bp, Homo sapiens
  misc_feature: GYAE6OF02FXCT4.24.85.H08.1.454.CMB.1.raw
  modified_base (242)..(242): a, c, t, g, unknown or other
  misc_feature (242)..(242): n is a, c, g, or t
  modified_base (386)..(386): a, c, t, g, unknown or other
  misc_feature (386)..(386): n is a, c, g, or t
  modified_base (396)..(396): a, c, t, g, unknown or other
  misc_feature (396)..(396): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggattcgccttnaataacttctggatgcactgggtccgccaagcctccgaggggaaggggctggatttgggtctcacgtattaacattgatgggatagctcacactatgcgactccgtgaaggccattcacatctcagagacaacgccaagaaacncactgtatcngacaaatgagcagcctagaaacgccgaacgacgacggtctagtcgttattacgtggtagaccgaaagggacggggaccaggctatttacccgtctaaccgttactcccgtacttagtcggtaccgttcggtacggggacctaacggggacctacggg

SEQ ID NO: 203941 - DNA, 663 bp, Homo sapiens
  misc_feature: GYAE6OF02GWY8D.24.85.H08.1.454.CMB.1.raw
  modified_base (529)..(529): a, c, t, g, unknown or other
  misc_feature (529)..(529): n is a, c, g, or t
tcagactactatgtcacgaccggtgctcgatttagtatcactcagtcgcgggggagccccagccctgggattcccagctgtttctgcttgctgatcaggactgcacacagagaactcaccatggagtttgggctgagcgtggtttcgtgtagctatttaaaggtgtcagtgtgaggtgcagctggtggagtccggggagcttagtcagccgtgggggtccctgagtactctcctgtgccagcctgtggtatttccgcctttcaaattaaccgttcgtaggatgccgacgtcggggtcccgaccaagccgttaccggaagggggaacggggccttaggtaagttttcggggtaccttcgtaacggttaaactttaaccgagtttaggaaggttggggaacgttacggccttaacgactacgtagtcggacggtacgtccggtaggaacggtccgtacttccaacctactcctacgagaacgaccaacgaccaagaaaccactacgtagtactactagaacaaagtgaacncgaagcctaacggaaacgacccgaacgaccgtacggtcgttacgttagtaacttcgtacgttgaacggaacgggaccggggtcaacgactaacgttaccctacgttaccgtacccgtccgtacgtaagtccggg

SEQ ID NO: 203942 - DNA, 580 bp, Homo sapiens
  misc_feature: GYAE6OF02JKGTX.24.85.H08.1.454.CMB.1.raw
  modified_base (250)..(250): a, c, t, g, unknown or other
  misc_feature (250)..(250): n is a, c, g, or t
  modified_base (411)..(411): a, c, t, g, unknown or other
  misc_feature (411)..(411): n is a, c, g, or t
  modified_base (423)..(423): a, c, t, g, unknown or other
  misc_feature (423)..(423): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccacaccacgcatgtgacctcaggggtccccagactctcctgtgcagcctctggattcgccttcaataacttcnggatgcacgtgggtccgccaagctccgagggaaggggctggatttgggctcacgttattaacattgagtcgggtagtagcttacgactacgtatgcgacgtccggtggaagggccgtaattcacctatctaccagacgacaacgccagaaacacactgtanctgaccaatgancacgtctagaacgccgacgtaccgacggctagtcgttaatccgtaggtcgacgtaagggacgggaccagcgttataaccgttccgttaacctaacgtcccgtaagtacgttaccggcgtttccggcgggaacggtaaccggaccgtacgggtacccg

SEQ ID NO: 203943 - DNA, 553 bp, Homo sapiens
  misc_feature: GYAE6OF02I24OV.24.85.H08.1.454.CMB.1.raw
  modified_base (442)..(442): a, c, t, g, unknown or other
  misc_feature (442)..(442): n is a, c, g, or t
  modified_base (514)..(514): a, c, t, g, unknown or other
  misc_feature (514)..(514): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggattccgcctttcaaataacttctggatcgcacgtgggtccgccaagctacccgagggaacggggctgtagtttcgggctcgacgttattaacatttgatgggatagctcgactacgtatgacggactccgtgaacgggtcctattcaaccgtatcctcccgaagacgaaccaacgccaagaaaccacactcgtatctagacaaagtaganacagctagaaacgcgacgacgacgctgtagttactactcgtgacgtaaggacggggcagcattaccgctacnctccgctagtcgacgtcgtacgggacgaggccgtaacgg

SEQ ID NO: 203944 - DNA, 568 bp, Homo sapiens
  misc_feature: GYAE6OF02IIU60.24.85.H08.1.454.CMB.1.raw
  modified_base (426)..(426): a, c, t, g, unknown or other
  misc_feature (426)..(426): n is a, c, g, or t
  modified_base (465)..(465): a, c, t, g, unknown or other
  misc_feature (465)..(465): n is a, c, g, or t
  modified_base (484)..(484): a, c, t, g, unknown or other
  misc_feature (484)..(484): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggattccgccttcaataacttctggatgcacgtgggtcccgcaagctccgaggggaaggggctgtatttgggtctcacgtattaacattgagtgggagtagctacaactactatgcggtacctccggtagaacgggtcttagacttcaccctattccctaccgagacgaaccaaaccgccaaagaaaccactactntactctagacaaagtgagcagcctagaacgccgacgacncggatgtagtattacgtgngacgagggacgggccagactagttacctacctactacctccgtactcgtacggtaccgtcggtacgggacccgaagggtacccg

SEQ ID NO: 203945 - DNA, 602 bp, Homo sapiens
  misc_feature: GYAE6OF02HKCPT.24.85.H08.1.454.CMB.1.raw
tcagactactatgtcacgaccggtgctcgatttagtatcactcagtcgcgggggagccccagccctgggattcccagctgtttctgcttgctgatcaggactgcacacagagaactcaccatggagtttgggctgagctgggttttccttgttgctattttaaaggtgtccagtgtgaggtgcagctggtggagtccgggggaggtcttagttcagccgtgggggtccctgagactctcctgtgcacgcctcgtggattccgccttcaaattaactttcgtaggatggctacgtcgggtcccgaccgaagcctaccggaaggggaaggggtctagtagttttgggtctcgtacgttaattaactattgagtgggatacgctacacactagtcgcggtactcgtaggaacgggccgtatcaccatcctaccgagaacgacaacgaccaagaaacacactgtactctagacaaagtgacgcaacgaccgtaggaaaccgccgaacacgacgtactaggtagtacttacgtgtacgacgaaacgggtcggggacctaaggacttacgttactcccgttaacttaccgtccgtacttagtaccggg

SEQ ID NO: 203946 - DNA, 561 bp, Homo sapiens
  misc_feature: GYAE6OF02GX35V.24.85.H08.1.454.CMB.1.raw
  modified_base (269)..(269): a, c, t, g, unknown or other
  misc_feature (269)..(269): n is a, c, g, or t
  modified_base (342)..(342): a, c, t, g, unknown or other
  misc_feature (342)..(342): n is a, c, g, or t
  modified_base (351)..(351): a, c, t, g, unknown or other
  misc_feature (351)..(351): n is a, c, g, or t
  modified_base (371)..(371): a, c, t, g, unknown or other
  misc_feature (371)..(371): n is a, c, g, or t
  modified_base (455)..(455): a, c, t, g, unknown or other
  misc_feature (455)..(455): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggattcgccttcaataacttctggatgcacgtgggtccnccaagcctccgaggggagggctgtagtttgggctcacgttaattaacattgagtgggagtagctacacactangcgactcgngaggccatcacatctcaganacaacgccaagaacacatgtatcagacaaatgacgcacgtccaaggaaacgcccgacgaacgacggcttaggtagtatttacgngtacgacgaaagggaggggccaggtcctaactttaccgtaccttaacctaccgtcccgacttagtcggaccgttcggtacgggggacctaacggggaccctacggg

SEQ ID NO: 203947 - DNA, 684 bp, Homo sapiens
  misc_feature: GYAE6OF02F3TJF.24.85.H08.1.454.CMB.1.raw
tcagactactatgtcacgaccggtgctcgatttagtatcactcagtcgcgggggagccccagccctgggattcccagctgtttctgcttgctgatcaggactgcacacagagaactcaccatggagtttgggctgagctgggttttccttgttgctattttaaaaggtgtccagtgtgaggtgcagctggtggaggtccgggggaggcttagttcagccgtggggggtccctgagactctcctgtgcagcctctggattccgccttcaattaacttctggatgcacgtgggtcccgaccaagctccggaggggaggggtctggtagtttgggtctcgacgttattaactattgagtgggagtagctcaactactatcggacggtacctccggtaggaacgggtccgtacgtttaccaacccgtatccctaccgaaggtaacgaaccgaaaccgcccaaaaggaaaacctaccgacgttacgtacttacgtagaactaaaacgtggacgaccgacgtaccctaaggaaaccgcccggaaaccggacgaccgggtcttaggttagttaacttaaccggtgtacggaaccggaagggggtaccgggggaccctaaggtacctaacgttttaccccgtacccttttaacccggaacccgtttccccggacgtttaaccgtaccggggg

SEQ ID NO: 203948 - DNA, 723 bp, Homo sapiens
  misc_feature: GYAE6OF02IA1GG.24.85.H08.1.454.CMB.1.raw
  modified_base (157)..(157): a, c, t, g, unknown or other
  misc_feature (157)..(157): n is a, c, g, or t
  modified_base (224)..(224): a, c, t, g, unknown or other
  misc_feature (224)..(224): n is a, c, g, or t
  modified_base (256)..(256): a, c, t, g, unknown or other
  misc_feature (256)..(256): n is a, c, g, or t
  modified_base (294)..(294): a, c, t, g, unknown or other
  misc_feature (294)..(294): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcnggtcttcgtggctcacgtccaccaccacgcatgtcgacctcgacggggtccctgacgactctcctgngcacgctctggattcgcttacaattaacttcngatgcacgtgggtccacaagcgtccgaaggggtacggntggtagtttggtctcacgttaataactgtttcgagtcggggtattaggcctacgtaacacgttagtggaccggtacgttccgggaggtaaacggccgtaattaccgaacccgtgtcttacccggaaaggaccgaacgaacccggaccgaacggaaaaccacctaaccgtaagtcttacgtaacgaacgtaaagtggaaacgtacgaacggttacccgtaaaggaaaccggttaacccggaaacgaaccggaacgggtacccttaggtaacgttacgttaccgttacggtacggtaacggaaacggggtacgggaccggtaacggacgttaacgtttaccgtaaccgttaacctaacccgtccggtaccgttacggttacggacgttacccgggttacgggggaaccctacggggtaacccgtaccgggg

SEQ ID NO: 203949 - DNA, 605 bp, Homo sapiens
  misc_feature: GYAE6OF02FWTUR.24.85.H08.1.454.CMB.1.raw
  modified_base (269)..(269): a, c, t, g, unknown or other
  misc_feature (269)..(269): n is a, c, g, or t
  modified_base (338)..(338): a, c, t, g, unknown or other
  misc_feature (338)..(338): n is a, c, g, or t
  modified_base (386)..(386): a, c, t, g, unknown or other
  misc_feature (386)..(386): n is a, c, g, or t
  modified_base (407)..(407): a, c, t, g, unknown or other
  misc_feature (407)..(407): n is a, c, g, or t
  modified_base (421)..(421): a, c, t, g, unknown or other
  misc_feature (421)..(421): n is a, c, g, or t
  modified_base (454)..(454): a, c, t, g, unknown or other
  misc_feature (454)..(454): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggattcgccttcaactaacttctggatgcacgtggtccnccaagctccgagggagggctgattgggtctcacgttattaacagttgagtgggagtagctacacactangcggactcgtgaacggcatcacatcctcagagaccaacgcaagaaacncactgtatcagacaaatgacnacgcctagaaaccnccgacgacgacggctagttagtaagtttaccgnggttacgacggtaaacggacgggggacccaggtaccttaacgtttacccgtccccttaaccgtacccgtttaccccggagtttaaccggttacgggtacccggttccgggtaaccggggggaccccgtaaacgggggtccccgtaacgggg

SEQ ID NO: 203950 - DNA, 601 bp, Homo sapiens
  misc_feature: GYAE6OF02IA88N.24.85.H08.1.454.CMB.1.raw
  modified_base (277)..(277): a, c, t, g, unknown or other
  misc_feature (277)..(277): n is a, c, g, or t
  modified_base (454)..(454): a, c, t, g, unknown or other
  misc_feature (454)..(454): n is a, c, g, or t
tcagactactatgtcacgaccggtgctcgatttagtatcactcagtcgcgggggagccccagccctgggattcccagctgtttctgcttgctgatcaggactgcacacagagaactcaccatggagttttgggctgagctgggttttccttgttgcttattttaaaaggtgtccagtgtgaggtgcagctggtggagtccgggggaggcttagttcagccgtgggggtccctgagactctcctgtgcagacctatggattcgccttacaaatacttntggatgcacgtggtccgcaagccgtaccgaggggaggggctgtagttttcgggtctcacgtattaactagttgagtgggatagctcacatatgcgacgtccgtagaggccgtattccactactctaccagagaccaacgccaaagaaacacactagtaactcgtacacaaagtgaanccgaagtccctaaaggaacgcccgaaccgacgaccggtctaggtacgttattaccgtagtacggaccggtaaggggaaccgggggacccaggtacccgtaattttaccacccgttaaccttacccgtccgtaccgtaggttaccggg

SEQ ID NO: 203951 - DNA, 791 bp, Homo sapiens
  misc_feature: GYAE6OF02JF4CJ.24.85.H08.1.454.CMB.1.raw
tcagactactatgtcacgaccggtgctcgatttagtatcactcagtcgcgggggagccccagccctgggattcccagctgtttctgcttgctgatcaggactgcacacagagaactcaccatgggtagtttgggctgagcgttgggtttttccttgttgtcttaattttaaaaggtgtccagtgtgaggtgcgagcgtggtgggtaggtccgggggaggtcgttagttcgacggtccggtcggggggtccctggacgacctcgtccgtgtcgcacgtccgtcgtggtacgttccgtccttactaacttaacttcgtcggtatggctacctggggtcccgcccgtaaagccgttaccgagggtaaggggcttggactttggggtccttcgaccgttagtttaaccagtttgaattgggagttacggcttacgactacgtaagtcgacggtacgtcccggttagaaacggggtcccgaagtttccgaaccctacgtacccgttacccaacgtaacgaaccgaaaaccggacccaaacggaaaaccctaacgaaacccttgtaaacttaccgtaacgtaaccgtaaaacgttcggaaacgtaccgaacggtaccccgtaagggaaaacccgcccggaaaccgaaccgtaaccgggtacttacggttaacgttacgtttaacgtacggtaaggtacccggtaaaggggtaaccggggaaccgtaacggtacccgtaacgtttacccgttacccgttaacccgtaacctttccccggtaccgttaccgttaccggg

SEQ ID NO: 203952 - DNA, 667 bp, Homo sapiens
  misc_feature: GYAE6OF02IVCL2.24.85.H08.1.454.CMB.1.raw
  modified_base (245)..(245): a, c, t, g, unknown or other
  misc_feature (245)..(245): n is a, c, g, or t
  modified_base (292)..(292): a, c, t, g, unknown or other
  misc_feature (292)..(292): n is a, c, g, or t
tcagactactatgtcacgaccggtgctcgatttagtatcactcagtcgcgggggagccccagccctgggattccccagctgtttctgcttgctgatcaggactgcacacagagaactcaccatggagtttgggctgagctgggttttccttgttgctattttaaaggtgtccagtgtgaggtgcagctggtggagtccggggaggcttagttcagccgtggggggtccctgagctctcctgtgcngcctctggattcgccttcaattacttcgtggatgcacgtcgggtccncaagcgtaccggaggggaaggggtcgtggtagttttcgggtactacgacgttaattaacgattagagtggagtgactcactacgtgtacgcggacctcgtaggaacggccgtatccgaactatacctaccgagaacgtaacccaacggtaccaacggtaaaccaacctaccttaggtaacttccgtagaacctaaagtagtaacgccgacggtaaccttacggaaaaccggtcccggaaacggtacccggtaaccgggtcgttaacggttacgttaagtttacgtagtacgggacggtaaaggggaccggggtacaacgttaccgtaactttacccggtaccttaccgtacctacgtacccttagggtacccggg

SEQ ID NO: 203953 - DNA, 731 bp, Homo sapiens
  misc_feature: GYAE6OF02HL68U.24.85.H08.1.454.CMB.1.raw
  modified_base (257)..(257): a, c, t, g, unknown or other
  misc_feature (257)..(257): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcgaggggtccctgagactctcctgtgcagcctctgggattccgccttcaattaactttcnggtatggcacgtcgggtccgacaagctccgaaggggaacgggcttaggtacgttttcggggtccttacgaacggttaattaacctatttggagtcggggtagtacgcttcgaactacgttacgttcggacttccggtagaacggggtcctaatttccaccgtacttacctacaaggaacgtaaccaacggacccaaaggaaacctacaaccgttagtaactaccgttagaaacctaaagttcggaacgcctaagtaccggttaaaggaaaaccggtccccggaaacgtacccgtaaccgggtgttaacggtttacggtaactttaccgtggtaacgacgtaaaggggacggggtaccaggttacctaacgtttaccctacccgttaacgttacccgtccgtacgtttaacggaccgggttaccggtttccggaggggtaaccccggaaacgggtccccggttagggtacccccg

SEQ ID NO: 203954 - DNA, 539 bp, Homo sapiens
  misc_feature: GYAE6OF02FKRRC.24.85.H08.1.454.CMB.1.raw
  modified_base (338)..(338): a, c, t, g, unknown or other
  misc_feature (338)..(338): n is a, c, g, or t
  modified_base (363)..(363): a, c, t, g, unknown or other
  misc_feature (363)..(363): n is a, c, g, or t
  modified_base (370)..(370): a, c, t, g, unknown or other
  misc_feature (370)..(370): n is a, c, g, or t
  modified_base (388)..(388): a, c, t, g, unknown or other
  misc_feature (388)..(388): n is a, c, g, or t
  modified_base (394)..(394): a, c, t, g, unknown or other
  misc_feature (394)..(394): n is a, c, g, or t
  modified_base (451)..(451): a, c, t, g, unknown or other
  misc_feature (451)..(451): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcgaggggtccctgagactctcctgtgcagcctctggattcgccttcaattaacttctggatgcacgtgggtccgccaagcctaccgagggaacgggctgatttgggctcacgtattaacattgatgggatagctcacactntgcgactccgtgaaggccatcaccntctcagnacaacgcagaacactacngtatcngacaaatcgagcgagacctagaaacgccgaacgaccacggtctagtgtaacttacgngtagcaaagggcggggcagactacttacgtacctactacctccgacgttagacggacggttcgtacggggacctaagggacctacggg

SEQ ID NO: 203955 - DNA, 719 bp, Homo sapiens
  misc_feature: GYAE6OF02FGI7B.24.85.H08.1.454.CMB.1.raw
  modified_base (259)..(259): a, c, t, g, unknown or other
  misc_feature (259)..(259): n is a, c, g, or t
  modified_base (269)..(269): a, c, t, g, unknown or other
  misc_feature (269)..(269): n is a, c, g, or t
  modified_base (313)..(313): a, c, t, g, unknown or other
  misc_feature (313)..(313): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggattcgccttcaataacttctggatgcncgtgggtccnccaagcctcgaggggagggctgatttgggctcacgttattaacnttgagtggggatagcctcaacactagtggccggtaactcccggtagaacggggcccgtaatttccgaacccattccctccccgaaaggtaaccgaacccaaccgacccgaaacggtaaaaccacctaaccgttaggttaacttccgttacggacctaaaagttcggaagccgaacgtcccgttaacggaaaccggacccgaccgaaccggtaccgggtacgttaggttacgttaacgtttacgttacgtacggtaccgaaacggggaacggggggacccaacggtacctaacgtttaccgttacccttaacccgttaacccgttacccggttaccgttaacggttaccgggtacccggttaccggttacgggggaccccggtaacggggtaccccgtaacccgggg

SEQ ID NO: 203956 - DNA, 581 bp, Homo sapiens
  misc_feature: GYAE6OF02GEEOC.24.85.H08.1.454.CMB.1.raw
  modified_base (273)..(273): a, c, t, g, unknown or other
  misc_feature (273)..(273): n is a, c, g, or t
  modified_base (325)..(325): a, c, t, g, unknown or other
  misc_feature (325)..(325): n is a, c, g, or t
  modified_base (409)..(409): a, c, t, g, unknown or other
  misc_feature (409)..(409): n is a, c, g, or t
  modified_base (470)..(470): a, c, t, g, unknown or other
  misc_feature (470)..(470): n is a, c, g, or t
tcagactactatgtcacgaccggtgctcgatttagtatcactcagtcgcgggaggacgctgaccacacggtacgtgctgttgtactgcctcctcccgcggctttgtcttggcattatgcacctccacgccgtccacgtaccagttgaacttgacctcagggtcttcgtggctcacgtccaccaccacgcatgtgacctcaggggtccctgagacctctcctgtgccagcctctggattcgccttcaatacttctggactgcacttgggtcccnccaagcctcccgaaggggaacgggctggattttggggctcgacgtattaacnttgattggggatagctcactactatcgcggactccggtagaacgggcctattcacctatcctccagagaccaacgcaagaaacncactgtatctgactaagtgacgcagcctaggaacgccgtacgacgcgctgtgtacttacgngttacgacgaagggtacggggccaggccgtatttaccgtcccttactacccgttcccgacttacgtcggtaccggttccgacggggtacccctaaggggtcccctaacggg

SEQ ID NO: 203957 - DNA, 572 bp, Homo sapiens
  misc_feature: GYAE6OF02JBGF1.24.85.H08.1.454.CMB.1.raw
  modified_base (397)..(397): a, c, t, g, unknown or other
  misc_feature (397)..(397): n is a, c, g, or t
  modified_base (423)..(423): a, c, t, g, unknown or other
  misc_feature (423)..(423): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggattcgccttcaatacttctggatgcactcgggtccgccaagctccgagggaagggctgagtttgggtctcacgtattaacattgatgggagtagctcacactatcgcggactcgtagacggcctatcacatcctcagacgacaacgccaagaaaccacactgtanctagacaagtgagcagcctaggaacncgacacgacgactggtagtactgtacgtgacggaacggacggggacctacggactacgttaaccgtcccgttaactacccgtccgtacgttacgtcggggtaccgttcgggttacccggggaacccggtacggggtacccggtaacggg

SEQ ID NO: 203958 - DNA, 547 bp, Homo sapiens
  misc_feature: GYAE6OF02FQ783.24.85.H08.1.454.CMB.1.raw
  modified_base (268)..(268): a, c, t, g, unknown or other
  misc_feature (268)..(268): n is a, c, g, or t
  modified_base (310)..(310): a, c, t, g, unknown or other
  misc_feature (310)..(310): n is a, c, g, or t
  modified_base (330)..(330): a, c, t, g, unknown or other
  misc_feature (330)..(330): n is a, c, g, or t
  modified_base (342)..(342): a, c, t, g, unknown or other
  misc_feature (342)..(342): n is a, c, g, or t
  modified_base (377)..(377): a, c, t, g, unknown or other
  misc_feature (377)..(377): n is a, c, g, or t
  modified_base (385)..(385): a, c, t, g, unknown or other
  misc_feature (385)..(385): n is a, c, g, or t
  modified_base (398)..(398): a, c, t, g, unknown or other
  misc_feature (398)..(398): n is a, c, g, or t
  modified_base (401)..(401): a, c, t, g, unknown or other
  misc_feature (401)..(401): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggattcgccttcaataacttctggatgcactgggtccnccaagctccgagggagggctgatttgggctcacgtattaacnttgatgggatgctcacatangcggactccggngacggcctatcacatctcagagacacgcagaaacncactgtancagacaaatcgancanccagaacgccgaacacgacgtctagtagtacttacgtgtacgacgaaaggcggggaccagacctatttacccgtcctaacttacccgtaccgtacgtacggtcggtaccggttccgggtacgggaaccggtacggaccgtaccggg

SEQ ID NO: 203959 - DNA, 682 bp, Homo sapiens
  misc_feature: GYAE6OF02JTNHP.24.85.H08.1.454.CMB.1.raw
  modified_base (576)..(576): a, c, t, g, unknown or other
  misc_feature (576)..(576): n is a, c, g, or t
tcagactactatgtcacgaccggtgctcgatttagtatcactcagtcgcgggggagccccagccctgggattcccagctgtttctgcttgctgatcaggactgcacacagagaactcaccatggagtttgggctgagcttgggttttccttgttgcttaattttaaaaggtgtccagtgtgaggtgcagctggtgggaggtccgggggagtcgttagttcaggtccgtgggggtccctgacgactctcctgtgcagcctcgtggacttccgtccttacaattaacttcgtggtatggcacgtcgggtccaccaacgtccgtccggaaggggtaacgggctggtacgtttcggtcctcgaacgttaacttaacagtttggagtagggtaagtacgtcgtacactaacgttagtcggacgtacgtccggtaggaacggtaccgtattccgaacctagtcctacgaagacgtaaccaaccgaccgtaaacgaaaaccactacctacgttacgtactacgaacgtaaacgtgaacgaccgaacgtacccgtaagggaaaccgtaccggaaccgtaaccgngtaccttgtaacgttactacgttggaccgagaacggggtacggacctacggtacgttaacgttaccctcccgttaaccgtaccttacggtacgttacggtaccggg

SEQ ID NO: 203960 - DNA, 632 bp, Homo sapiens
  misc_feature: GYAE6OF02IRLLA.24.85.H08.1.454.CMB.1.raw
  modified_base (352)..(352): a, c, t, g, unknown or other
  misc_feature (352)..(352): n is a, c, g, or t
  modified_base (478)..(478): a, c, t, g, unknown or other
  misc_feature (478)..(478): n is a, c, g, or t
tcagactactatgtcacgaccggtgctcgatttagtatcactcagtcgcgggggagccccagccctgggattcccagctgtttctgcttgctgatcaggactgcacacagagaactcaccatggagtttgggctgagctgggttttccttgttgctattttaaaaggtgtccagtgtgaggtgcagctggtgggaggtccgggggaggtcgttagttcaggccgtggggggtccctgagacctctcctggtgcagcctctggattcgtccttacaaacttaacttctggatgcacgtgggtcccaccaacgctccggaaggggagggctgatttgggtctcgagtattaacnttgagtgggatagcctcacactagtgcggactccggtggaacggtccgattaccaactgtacctaccaaggacgaacgaaccgaccaaacgaaacactaactagtactactacgaccaaatcgaanaccgtacgacctaggaaaccgcccgaacgaccgacgtacgtaggttacgttactttacgtacgtacggacggaaggggtacggggacctaggtaaccttaacggtttaccctacctttaaccgtaccgtttacccgtaccgtacgtaaccgggg

SEQ ID NO: 203961 - DNA, 785 bp, Homo sapiens
  misc_feature: GYAE6OF02J2HDK.24.85.H08.1.454.CMB.1.raw
  modified_base (354)..(354): a, c, t, g, unknown or other
  misc_feature (354)..(354): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtctcgtggctcacgtccaccaccacgcatgtgacctcgaggggtccctggagtacctctcctggtgcacgcctcgtggacttccgcctttacaaacttacttcgtggatcgaccacgttcgggtcccaccgaagtcctaccggaaggggaacggggtctaggtagttttcgggctacgtaacgttaattaacgngtttaggaagtggggtactaggtccttacgaaccgtactacggttcggacccggtaccgttaccgggtacggaaaccggggtcctactttaccgaaccgtacgttcccgtaacccgaaggtaaccgaaccgtaaacccgaccgaaacggtaaaccaccgtaacgttacgttaacgtcgtaacgtaaccgtaaacggttcgaacgtccgtaacggtacccgttaaacggaaccgacccggaaccgtaaccggaccggttcgttacggttacgtttaacgttaacgtcggttaacgggacgtaaacggggtaccggggtaccacggtacttaacctttaccgtaacccttaccgtaccgtacccgtacgttacggtaccgggtaccggttccggtaaccggggtaccggtaaccggggtaccgtaacccgggg

SEQ ID NO: 203962 - DNA, 729 bp, Homo sapiens
  misc_feature: GYAE6OF02GT3S4.24.85.H08.1.454.CMB.1.raw
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctgtggacttcgccttacaaattaacttcgtggattgcctacgtcgggtcccaccaagcctaccggaaggggaaggggcttaggtagtttggggtccttcgtacgttaattaacgagtttgagtaggggaagttacgcttacaactactagtcggccggtactccggtagggaacgggcctagttccacctatcctacgaaggtacgaaccaaaccgccaaagtaaacccacgtaacgttacgtactcgtacgaacgtaaagtggaacgtacgacgtaccgtaacggaaaccggcccgtaaaccgaacggacggtaccgttaggttacgttaacgtttacgtacggtacgaacggtaaacggggccggggacctacgggtaccttaacggtttacccttacccgttaaccgttaacccgttcccggtaacgttacggtacccggggttaccgtaccgggggtaacccggggacggtaaacccgggggtaccggtaacccgggg

SEQ ID NO: 203963 - DNA, 597 bp, Homo sapiens
  misc_feature: GYAE6OF02FPOS4.24.85.H08.1.454.CMB.1.raw
  modified_base (255)..(255): a, c, t, g, unknown or other
  misc_feature (255)..(255): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggattccgccttacaataacttcgnggatgcacgtggggtccaccaagctaccgaggggaaggggctgtagttttgggctcgaacgttattaactagttgagtgggagtagctacacatagtgcggtactccggtaggacgggtcctattcacctatcctcgaagacgaccaacgccgaagaaacacactagtactctgtacaatgagacacgaccgtagaaacgccgacgaccgacgtctagttgtacttacgtgtagacgaagggacggggaccacggtactacttaccttacctaaccgttacctccgtacttacggtacggtaccggttcggtaccggggaccgaacgggtacccgtaacggg

SEQ ID NO: 203964 - DNA, 515 bp, Homo sapiens
  misc_feature: GYAE6OF02FPGTY.24.85.H08.1.454.CMB.1.raw
  modified_base (311)..(311): a, c, t, g, unknown or other
  misc_feature (311)..(311): n is a, c, g, or t
  modified_base (333)..(333): a, c, t, g, unknown or other
  misc_feature (333)..(333): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggattcgccttcaataacttctggatgcactgggtccgccaagctccagggaaggggctgatttgggctcacgtattaacnttgatgggatagctcacactangcggactccgtgaagggccattcaccatctcagagacaacgccagaaacacactgtatctgacaaatgagcagcctagaaagccgacgacacggctgtgtattactgtgcaggaggggccagcattacctcctactactcccgactagtcggtacgtcgcggggccgagggacccgtacggg

SEQ ID NO: 203965 - DNA, 565 bp, Homo sapiens
  misc_feature: GYAE6OF02G89S2.24.85.H08.1.454.CMB.1.raw
  modified_base (334)..(334): a, c, t, g, unknown or other
  misc_feature (334)..(334): n is a, c, g, or t
  modified_base (462)..(462): a, c, t, g, unknown or other
  misc_feature (462)..(462): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggattcgccttcaataacttctggatgcactgggtccgccaagctccgagggagggctgatttgggctcgacgtattaacattgatggggatagctcacactangcgactccgtagaacgggccattccactatcctccagacgacacgccaagaaacacactgtactctagacaaatgacgacacgacctagaaacgcccgaacgaccgacggtctgtacgttacttacgngtcgacgaaggacggggccagtccgtatttaccgtcccttaacctaccgtaccgtcgttacgtcggtacgtccggtcggggacccgtaggggacccgtacggg

SEQ ID NO: 203966 - DNA, 653 bp, Homo sapiens
  misc_feature: GYAE6OF02HHNJM.24.85.H08.1.454.CMB.1.raw
  modified_base (253)..(253): a, c, t, g, unknown or other
  misc_feature (253)..(253): n is a, c, g, or t
  modified_base (268)..(268): a, c, t, g, unknown or other
  misc_feature (268)..(268): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtcgacctcaggggtccctgagacctctcctgtgcagcctctggattcgccttcaatacttcnggatgcacgtggccncaagcctacgagggagggctgtattgggtctcgacgtataactgttgagtgggtagtagcctactacagtagtcgccggtaccgtcggtacggaacgggacctattcaacctactcctaccgagacgaccgaacgaccaacgaaaccactaacttacgtactcgtacaactaagtcgaacgtacacgacctaaggaaaccgccgaacggaccgtacgggtacttaggttacgtaactttcgtaggttagacccggaaagggaccggggtaaccaggtacttaaccggtttacccacccgtttaacctaccgttcccgtacgttacggttaccgggtaccgttaccgggtaccggggaaccggtaaccggggaccgtaacccgggg

SEQ ID NO: 203967 - DNA, 701 bp, Homo sapiens
  misc_feature: GYAE6OF02JX7NL.24.85.H08.1.454.CMB.1.raw
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggattcgccttacaattaaccttctggatgcctacgtcgggtcccgccaacggcctaccgaggggaacggggtctggtagttttggggtcctacgtaacgttaactttaacgtagtttggtagtggggtaagttacgccttacaaccgtacttagtcggaccggtaccgtcccggtagggaaacgggcccgtaattcccgaacctaacgttccctaccgaacggtaacgaacccgaacgacccgaaacgaaaaccacctaacgtcggtaactctacgaactaaagtcggaagaccgaagtccgtaaggaaaccgacccgaacgacccggtacggtaccttaggtagttacttacgtagtaccgacggaagggacggggtccaggtccttaagttacccgttcctaacgttccgtacccgtcgttacgtacgggtccgtacggtacggggaccgtaacgggacccgtacggg

SEQ ID NO: 203968 - DNA, 594 bp, Homo sapiens
  misc_feature: GYAE6OF02GEHYV.24.85.H08.1.454.CMB.1.raw
  modified_base (345)..(345): a, c, t, g, unknown or other
  misc_feature (345)..(345): n is a, c, g, or t
  modified_base (388)..(388): a, c, t, g, unknown or other
  misc_feature (388)..(388): n is a, c, g, or t
  modified_base (400)..(400): a, c, t, g, unknown or other
  misc_feature (400)..(400): n is a, c, g, or t
  modified_base (409)..(409): a, c, t, g, unknown or other
  misc_feature (409)..(409): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggattccgccttacaattaacttcgtggatgcacgtcgggtccgaccaagctccgaggggacggggctgtagtttgggctcgacgttattacattgagtgggatagctcacatanggcgactcgtgacggcatcacatcacagacacaacgcagaacncatgtactcgtnacaatgacncagcctaggaaccgccggacgaccgacggtctaggttatacgtttacgcgttaggaccgaaagggaccggggacctacggtactaactttacccgttccgttaaccttacccggtccgtacgtttacggacgggttacccggttcggtaccggggaacccgtaaccggggtacccggtaaccggg

SEQ ID NO: 203969 - DNA, 635 bp, Homo sapiens
  misc_feature: GYAE6OF02H9MNU.24.85.H08.1.454.CMB.1.raw
  modified_base (243)..(243): a, c, t, g, unknown or other
  misc_feature (243)..(243): n is a, c, g, or t
  modified_base (314)..(314): a, c, t, g, unknown or other
  misc_feature (314)..(314): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctcgtggattcgccttnaataacttctggatgcacgtggtccgcaagctccgaggggaagggctgagtttggctcacgttattaaacnttgagtgggagtagctacactactagtggaccgacgttcccgtaggaaacgggtccgaattccaacctatcctaccaaggacgaaccgaaccggaccaaagaaacaccaacttacgtaacttactacgaacaaaagtggaacgacaaccgccgtaaggaaaccggcccgaacgaaccgaccggtacgtacgttagtaacgtttacttgggttacgacgaaacgggaccgggggacctacgacttaacgttacctacctaaccttacgtaccctacgtaacgtcggtacgtcggtacgggaccgtacgggaccgtaaccggg

SEQ ID NO: 203970 - DNA, 590 bp, Homo sapiens
  misc_feature: GYAE6OF02IQCM9.24.85.H08.1.454.CMB.1.raw
  modified_base (467)..(467): a, c, t, g, unknown or other
  misc_feature (467)..(467): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggacttccgccttcaataacttctggatgcactgggtccgccaagctccgagggagggctggtatttgggtctcacgtattaacattgatgggagtagctacgacatatgcggactccggtaggaacgggcctagttccaacctatcctccaagagacaacgccaagaaacacactgtatctgacaaatgagcacgctagaaaccgccgaacgacacggctggttacgtagtttacngttacgacgaaagggacggggaccaggtactacgttacccgtacctttaacctaccgttcccgtacttaggtccgggtaccgttccggaccggggaaccggtacggggaccccgtaaccgggg

SEQ ID NO: 203971 - DNA, 526 bp, Homo sapiens
  misc_feature: GYAE6OF02G7BJ1.24.85.H08.1.454.CMB.1.raw
  modified_base (269)..(269): a, c, t, g, unknown or other
  misc_feature (269)..(269): n is a, c, g, or t
  modified_base (312)..(312): a, c, t, g, unknown or other
  misc_feature (312)..(312): n is a, c, g, or t
  modified_base (357)..(357): a, c, t, g, unknown or other
  misc_feature (357)..(357): n is a, c, g, or t
  modified_base (360)..(360): a, c, t, g, unknown or other
  misc_feature (360)..(360): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggattccgccttcaatacttctggatgcacgtgggtccnccaagctccgaggggagggctgatttgggctcacgtattaacnttgagtgggatagctcacactatgcgactccgtgaggccatcacntcncagagacaacgcagaacacactgtatctgacaaatgagcagcctagaaacgccgacgacgacggctagtagtacttactgtacgacgaaggacggggccagctattaccgtcctactaccgtccgtactagtcggtaccgtcgtacggggaccagggacctacggg

SEQ ID NO: 203972 - DNA, 854 bp, Homo sapiens
  misc_feature: GYAE6OF02GJQ8P.24.85.H08.1.454.CMB.1.raw
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcacggggtccctgagactctcctgtgcagcctctggattccgccttacaaattaacttctggatgcacgtgggtccgaccaagctaccggagggggaacggggctaggtagtttcggggtcttacgtacgttaactttaaaccgtagtttaggaagttacggggaagttaacggtctaccaactaacgttacgtacgggaccggtaaccgttccggggtaagggaacggggtacccgtaacgtttacccgaacccgtaactttcccgtaccgaaacgggaaccgaacccgaaaaccggacccgtaaaacggaaaaaaccctaccgtaacgttacggttaaaccttccgtaacgtaaaccgtaaaatcggaacggaccgtaaacggtaccccgttaaagggaaaacccggccccggtaaacggaaacccggttaacgggtaccgtttagggtttaaccgtttacgtttaaccgttaggttaacgggaaacgggtaaacgggggaccgggggtaaccacgggttaccctaacggttttaaccccttaaccggttaacccgttaaccgtccccggtaacttaagggtttacccgggtaaccgggtttaccgggtaccgggggggaaaccccggtaacgggggtacccgggtaacccgggg

SEQ ID NO: 203973 - DNA, 681 bp, Homo sapiens
  misc_feature: GYAE6OF02J2KA2.24.85.H08.1.454.CMB.1.raw
  modified_base (270)..(270): a, c, t, g, unknown or other
  misc_feature (270)..(270): n is a, c, g, or t
  modified_base (480)..(480): a, c, t, g, unknown or other
  misc_feature (480)..(480): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgacttgacctcagggtctcgtggctcacgtccaccaccacgcatgtgacctcaggggtcccctggacgacctctccgtgtcgccagcctctgggacttccgccttacaataacttctggatgaccncgtcgggtccaccgaagcctccgaggggaagggctcgtagtttgggctactacgtaagttaacagttagtagtcggggtaattgcgtcaactacctagtacgaccggtacttccgggtagaacggggcctaattccgactaacgtcctacgacgtagaccgaaaccgtccaaagtaaccaccgtaactgtaactcgttaagactaaacgngtacgacgacgacgttaacggaaacgcccgaaacgaccgaccggtcgttacgtagtaaccgttacgtacggtccgaaggtaacgggacgggtaccgtagaccttagtttacccgtaccgttaacctcggttacccgtacgtaggttacggtaccgggtaccggttaccgggggaacccggttaacggggaccctaccgggg

SEQ ID NO: 203974 - DNA, 618 bp, Homo sapiens
  misc_feature: GYAE6OF02H3CNT.24.85.H08.1.454.CMB.1.raw
  modified_base (503)..(503): a, c, t, g, unknown or other
  misc_feature (503)..(503): n is a, c, g, or t
tcagactactatgtcacgaccggtgctcgatttagtatcactcagtcgcgggggagccccagccctgggattcccagctgtttctgcttgctgatcaggactgcacacagagaactcaccatggagtttgggctgagcttgggtttttccttgttgcttattttaaaaggtgtccagtgtgaggtgcagctgggtggaggtccgggggaggcttagtcagccgtgggggtccctgagactctcctgtgcagccttcgtggtacttcgccctttcaaacttaaccttcgtaggatgcctaacgtcgggtcccgaccaagccttaccgaaggggaacgggggtcttggtagtttttcggggtccttacgtaacgttaattaactagtttgacgtgggagtacgctacacactagcggacggactccggtaggaacggccgtattccgacctatcctaccagacgacaacgaccaagaaacacactagtatcgtagacaagtgaancgaacgacctaaggaaccgaccgaacgacgacgcgtaggttacgtacttacgtggtacgacggaaggacggggcacgactagttacctaccgtacctacgtaccctctagtacgg

SEQ ID NO: 203975 - DNA, 653 bp, Homo sapiens
  misc_feature: GYAE6OF02IX650.24.85.H08.1.454.CMB.1.raw
  modified_base (270)..(270): a, c, t, g, unknown or other
  misc_feature (270)..(270): n is a, c, g, or t
  modified_base (284)..(284): a, c, t, g, unknown or other
  misc_feature (284)..(284): n is a, c, g, or t
  modified_base (498)..(498): a, c, t, g, unknown or other
  misc_feature (498)..(498): n is a, c, g, or t
  modified_base (512)..(512): a, c, t, g, unknown or other
  misc_feature (512)..(512): n is a, c, g, or t
  modified_base (526)..(526): a, c, t, g, unknown or other
  misc_feature (526)..(526): n is a, c, g, or t
tcagactactatgtcacgaccggtgctcgatttagtatcactcagtcgcgggggagccccagccctgggattcccagctgtttctgcttgctgatcaggactgcacacagagaactcaccatggagtttgggctgagctgggttttcctgttgctatttaaaaggtgtcagtgtgaggtgcagctggtggagtccggggagtcttagttcagccgtggggggtccctgagacctctccgtgtgcaggcctacgtggacttccgcctttanaattaacctttcgnggtattcgcctacggttcgggtcccaccaaacggccgttaccggaaggggagggtctggttagttttcggggacttaccggtacgttaacttaaacgtgtttacgagttcggggaagtacgtccgttacaactactagtcggacggtactccggtagggaaccggtccgagttcccacgtactcgtaccagaacgacgtaacgacaacgaaacncactacgtgttacngaactaagacgacncgacaccgtaacgaacggacccgaacgtacaccgggtactggtagtaacttcgagttgaaccgtaagggaaccgggtacaacgtcgtaaccttaccgtaccttaacccgactccgtaccgtgtacgg

SEQ ID NO: 203976 - DNA, 613 bp, Homo sapiens
  misc_feature: GYAE6OF02HMYCG.24.85.H08.1.454.CMB.1.raw
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggattcgccttcaataacttctggatgcactgggtccgccaagctccgaggggaagggctgtatttgggtctacacgtattaacatttgatggggatagctcacactatcgcggactccggtaggaacgggccaattcaccatccctacagacgacaaccgacaacgaaaccacaactagtactcgtacgaactaaagtcgagaccgaacgtccgtaacggaaacgacccggaacggaaccgtacggtacttacggttaggttaacttacgttagtcgaacgtaagggacggggaccaggctaactttaccgtacctaactaccgtacgactacggtacggtaccgtaccgtcggggaacccgaaggggtacccgtaaccggg

SEQ ID NO: 203977 - DNA, 851 bp, Homo sapiens
  misc_feature: GYAE6OF02IXJMC.24.85.H08.1.454.CMB.1.raw
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcgagggttcttcggtggctcacgtccaccaccacgcatggtacgacctcgacggggtccctgagaccttctccgtgtgcacgtcctctggtacttccgcctttacaaattaaccttcgtaggtatcggtcgtaccgtcggggtcccgaccaacgtccgtacccggaaggggacggggtcgtgtacgttttcggggtaccttcgtaaccggtttaattaacgtagttaggtagttggggtaagtacgtcctacctaacgtactacggtcggaccggtacccgtccggtacggaaccggggtacccgtacgttaccaaccgtacttaccctacctaaggaaccgtaacctaaacccggaccgaaaccgtaaacccgaaaccgtaccgttaagtttcctaaccttacgtaaaccgtaaagttacggacgtaacgaaccggtacgtaacggtaaaccggacccggtacgaaccgtaccgggtacgttacggttacgtttaactttacggtacggttacggtaacgggtaaaccggggacgggggtacctaacgggtaccgttaagttttaaccccggttacctttaacccggttaccgttaaccccggttacggttaaccgggtttaccgggtaaccgggttacccgggttacccggggaaccccggggttaaacgggttaccccggttaaccccggggg

SEQ ID NO: 203978 - DNA, 695 bp, Homo sapiens
  misc_feature: GYAE6OF02F6372.24.85.H08.1.454.CMB.1.raw
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggacttccgcctttacaacttaacttcgtggactgcacgtcgggtccgccaagctccgaggggaacgggtctaggtagttttcgggctacgtacgttaattaacagttcgagttgggagtacgtcctacaactacgtaacgtcggaccggtacgttccggtaggaacgggtcccgtaatttccgaacctagttccgtaccgaaggtaacgaaccgaacgacccgaaacgaaaacaccgtaacgttagtactaccgtagaacctaaagtcggacacgtacgaccgtaaggaaaccgccgaacggaccgtacggtcgttacgttacgttacgttacgtagtacgaacgtaaagggccggggacctaagtacgtaacgtttaaccgtcccgtaaccgttaccgtcccgtacgttagtaccgggttacggttaccggtacggggacccggtaacgggtacccgtacggg

SEQ ID NO: 203979 - DNA, 623 bp, Homo sapiens
  misc_feature: GYAE6OF02HQUJ8.24.85.H08.1.454.CMB.1.raw
  modified_base (430)..(430): a, c, t, g, unknown or other
  misc_feature (430)..(430): n is a, c, g, or t
  modified_base (456)..(456): a, c, t, g, unknown or other
  misc_feature (456)..(456): n is a, c, g, or t
tcagactactatgtcacgaccggtgctcgatttagtatcactcagtcgcgggggagccccagccctgggattcccagctgtttctgcttgctgatcaggactgcacacagagaactcaccatggagtttgggctgagcgtggtttcgtgttgctatttaaaggtgtcagtgtgaggtgcagctgggtggaggtccgggggaggtcttagttcaggccggtgggggtcctggagcttctcgtgtcgacgcgtcctgtggtacttccgtccttacaaattacgttcgtaggatcgctacgtcggtccgccaagccgtacgagggacgggctgtgtttggctacgtagtataactgttcgaagtggagttacgcttacactacgttaacgcggacgtaccgtcggtaggtaaacgggccttacttcaaccctnttacgccgagacgaacaccgacgaanaaacctactacgtatcgtacgtacgtaacgtaaagtcgagaaccgttacgtaaccggtaacgaaaccgtaccgaccggaacgtcgtacgtgtactacgtagtcgaaggcgaacggggacggacagtaccttagttaccctacgtaccgtacgcctaacgtgtccggg

SEQ ID NO: 203980 - DNA, 664 bp, Homo sapiens
  misc_feature: GYAE6OF02G2M52.24.85.H08.1.454.CMB.1.raw
  modified_base (167)..(167): a, c, t, g, unknown or other
  misc_feature (167)..(167): n is a, c, g, or t
  modified_base (332)..(332): a, c, t, g, unknown or other
  misc_feature (332)..(332): n is a, c, g, or t
  modified_base (444)..(444): a, c, t, g, unknown or other
  misc_feature (444)..(444): n is a, c, g, or t
  modified_base (451)..(451): a, c, t, g, unknown or other
  misc_feature (451)..(451): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgnggctcacgtccaccaccacgcatgtgacctcaggggtccctgagactctcctgtgcagcctctggacttcgccttacaattacttcgtggatggcacgtcgggtcccaccaagtcctccgaaggggacgggtctggtagttttcggggctcgacggttattaacngtttggagtcggggatacgtctaccactactacgtcgaccggtacctccggtaggaacgggtcctaagttccaccgtactcgtaccgagtacgaaccaccgacaagaaaccnctacgtntactactgaacaagtgaacgacgacggtacctacggaaacgcccgtaacggacgaccggtcttaggtacgtttagttaacgtggtagaaccggaagggtacccggggactaacggacctttacgttacccgtaccttaaccgttccgtacccgtagtttacggtcgggaaccgtttcccgggtaggggaccctaaggggtaccccgttacggg

SEQ ID NO: 203981 - DNA, 697 bp, Homo sapiens
  misc_feature: GYAE6OF02JYQII.24.85.H08.1.454.CMB.1.raw
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcaggtcttcgtggctcacgtccaccaccacgcatgtgacctcagggtccctgagactctctgtgcacgcctcgtggacttcgccttacaagttaacttcgtaggtatgacgtacgtcggtccgaccaacgcctacgagggagggcgtagtacgttggtctacgtacgtactaactagttgtaggtggtagtacgacgtttttcaactacgtatggtaccggtacgtaccggtaaggaacgggtaccgtacgttaccgaccgtactacctaccgaacggtaacgaacccgaaccgaccgaaacgtaaaccaaccgtacttacgtaacctacgtacgtaacgtaaacgtagacgtacgaacggtaccgtaaggaaaccgtacccgaacgtaccggaccggtaccgttagtacgttacgttacgtaggttacgaacggaacggacgggaccgtagacttacgttaccgttaccgttaccgtaaccgtccgtacgtacgtacggtaccggtaccggtcgggaaccggtaccgggtaccgtaaccgg

SEQ ID NO: 203982 - DNA, 718 bp, Homo sapiens
  misc_feature: GYAE6OF02FFZMU.24.85.H08.1.454.CMB.1.raw
  modified_base (530)..(530): a, c, t, g, unknown or other
  misc_feature (530)..(530): n is a, c, g, or t
tcagactactatgtcacgaccggtgctcgatttagtatcactcagtcgcgggggagccccagccctgggattcccagctgtttctgcttgctgatcaggactgcacacagagaactcaccatggagtttgggctgagctgggttttccttgtgctatttaaaggtgtccagtgtgaggtgcagctgggtggaggtccgggggaggcttagtcaggccgtgggggtccctgagacctctcctgtgcacgtcctcgtggactttccgccttactaaattaaccttcgtaggacttcgacctaccgttcggggtccccgaccaacggcctaccggaaggggaacgggacttgtagtttcggggtactcgaacgttaattaactagttacggagtacggggtagtacgctacactacgttagcggtccggtacgtccggaggtaacgggccgtattaccaccgtacttccgacgaggacgaaccaaccggaccaaagaaacccactactacgtacttcgagaactaaagtgacnccgaacgtaccgtacgggaaaaccgcccgggtaaacgaccgtaaccgggtcttacggtagttaccttacgtcggtacggaacggtaacggggggaccggggtacccctaaggtacccgtttaacgtttaccccgtaacccgtttaaacccgtacccgtttaccccggtacgttaacggttaccggggg

SEQ ID NO: 203983 - DNA, 773 bp, Homo sapiens
  misc_feature: GYAE6OF02G5B6L.24.85.H08.1.454.CMB.1.raw
  modified_base (260)..(260): a, c, t, g, unknown or other
  misc_feature (260)..(260): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcgaggtcttcgtggctcacgtccacaccacgcatgtcgaccctcgaggggtccctagacgacttcctcctggtcgcagtccctcgtggtacttccgtccctttanaaattaacctttcgtaggattcgactaccggttcggggtccacaacgccgtccgaaggggacgggcttagtagttttcgggtctactaacgttaattaacgattggagttagggatacgcttacgactacgtagtacggtccggtaccgttccgggtaggtaaaccggggtccgtaactttacccaacccgtaacgtttccctaaccggaacggtaacggaacccaaaccggtaccgaaacgaaaaccctacgtaaccgttacgttaaacgttcctaaggaacctaaacgtggaaccgtaacgtacggtaaccgtaacggaaaccggacccgaaaccggaccggtaaccggtcgttacggttaacgttttaccgtacgtttcggaacgttaccggaaagggtccggggacctaggtacccttacgtttacccgtaccgttaccttaccggtaccgtacttaggttacggaccggttcgggtaccgggaacgtaccggggtaaccggtaccggg

SEQ ID NO: 203984 - DNA, 797 bp, Homo sapiens
  misc_feature: GYAE6OF02IG63X.24.85.H08.1.454.CMB.1.raw
tcagactactatgtcacgaccggtgctcgatttagtatcactcagtcgcgggggagccccagccctgggattcccagctgtttctgcttgctgatcaggactgcacacagagaactcaccatggagtttgggctgagcttgggttttccttgttgctaattttaaaggtgtccagtgtgaggtgcagctggtggagtccgggggagcttagttcagccgtgggggtcctgagactctcctgtgcacgctctggattcgccttacaattaacttctggatgcacgtcgggtccaccaagccgtaccgaggggaaggggtctggtagttttcggggtctacgtaacgttaattaacgtagtttggagtggggtaagtcgcttacaactactagtcggaccggtaactccggtaggaaacgggtcccgtaacttccaacccgtacttaccgtaccgaacggaaccgtaaaccaaacccggaacccaaaacgtaaaacccaaccgtaacctttaggttaaaccttccgtaacgtaaccgtaaaacgttggaacgaccgtaacggtaaccgtaacgggaaaacccggacccggtaaaccggtaacccggaccgggttccgtttaacgggttacgtttaaaccttttacggtacggttaaccgggaaccggtaaaacgggggggtacccgggggtaccctaaacgggttaccctttaaaaccggttttacccccgttaacccccgtttaaacccggtttaaaccccgtttccccggtaccgtttaaaccggttacccgggggg

SEQ ID NO: 203985 - DNA, 858 bp, Homo sapiens
  misc_feature: GYAE6OF02JXI7S.24.85.H08.1.454.CMB.1.raw
  modified_base (799)..(799): a, c, t, g, unknown or other
  misc_feature (799)..(799): n is a, c, g, or t
tcagactactatgtcacgaccggtgctcgatttagtatcactcagtcgcgggaggacgctgaccacacggtacgtgatgttgtactgctcctcccgcggctttgtcttggcattatgcacctccacgccgtccacgtaccagttgaacttgacctcaggtcttcgtggctcacgtccaccaccacgcatgtcgacctcaggggttccctggacgactcctcctgtcgcacgcctgtggattccgtccttactaaagtaacttcctggtactgaccgtacgtcgggtcccgaccgaacgtccgtacccggaagggggaacggggcttacggtaggttttcgggtaccgttacgtaaccgttaatttaaaacctagttttaaggaacgtttacgggggtaaaggtacgttaccgtaccgtaaaccttaaccgttaaaggtttcggtaccggtaaccgttttacccggggttaagggtaaaccgggggtaacccgttaacgtttacccggaaacccttagtaccccggtttaaaccaacgggaaacggtaaccccgaaaccgtacccgaaaacgtaaaaccccaaccggtaaaccttacggttaacttccgtacggtaaactaaagttcggaaacgaccgttaacggaaccctaaggaaacggtaccccgaaacgaccgttaaccggtcgtaacgtttacgggttaaacctttcggtaacggttaccgtaaccggtaaaggggaccccgggtaacgtagtacccgttagttaacccgttcccgtaaccgttccgttacccgngttttaaccggacggttaccgtcggggaaccggaaccgggtaccggtaacggttcccgg

SEQ ID NO: 203986 - DNA, 541 bp, Homo sapiens
  misc_feature: GYAE6OF02HLAZO.24.85.H08.1.454.CMB.1.raw
  modified_base (316)..(316): a, c, t, g, unknown or other
  misc_feature (316)..(316): n is a, c, g, or t
  modified_base (464)..(464): a, c, t, g, unknown or other
  misc_feature (464)..(464): n is a, c, g, or t
  modified_base (467)..(467): a, c, t, g, unknown or other
  misc_feature (467)..(467): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggattcgccttcaatacttctggatgcactgggtccgccaagcctccgagggaggggctgtagtttgggcctcgacgttattaacnttggatggggatagctcacactatgcgtactcgtgaacgggccattccaccatcctaccgagacgaaccaacgccaagaaaccacactgtactctagacaaatgagcacgaccgtagaaacgccgacgacacggctgtagtattacgngtnacgaggacggggccagctagttacgtcttactcctccgctagcggtacgtcgtcgggaccacgggacctacggg

SEQ ID NO: 203987 - DNA, 688 bp, Homo sapiens
  misc_feature: GYAE6OF02JE400.24.85.H08.1.454.CMB.1.raw
  modified_base (154)..(154): a, c, t, g, unknown or other
  misc_feature (154)..(154): n is a, c, g, or t
  modified_base (323)..(323): a, c, t, g, unknown or other
  misc_feature (323)..(323): n is a, c, g, or t
tcagactactatgtcacgaccggtgctcgatttagtatcactcagtcgcgggaggacgctgaccacacggtacgtgctgttgtactgctcctcccgcgcttgtcttggcattatgcacctccacgccgtccacgtaccagttgaacttgacctnagggtcttcgtggctcacgtccaccaccagcatgtgacctcaggggtccctgagactctcctgtcgcagcctcgtggacttccgcctttcaaactacttctggactggccacgtcgggtaccaaccaagcctcccgaaggggaaggggcctagtacgttttgggcctanacgttaattaacactttaggacgtgggtattacgctacactacgtacggcgactccggagaccgggtcacttcgactatccgtacccaaggacaaccgaacgcccgaacgaaaccaactaacgtcgtaactactacgaactaaagtcgacgacgaacgaccgtacgaacgtaccggacccgacgaccggtactacggttacgttacgttacgttacgtacggaacggtaaacgggacgggggtacctagggtacctaacggtttaacccgttaccgttaaccttccggttaacccgacgtttaaccggtacggttaccggttaccggtccggggtacccggtaaccgggtacccggtaaccgggg

SEQ ID NO: 203988 - DNA, 710 bp, Homo sapiens
  misc_feature: GYAE6OF02F1ONQ.24.85.H08.1.454.CMB.1.raw
  modified_base (271)..(271): a, c, t, g, unknown or other
  misc_feature (271)..(271): n is a, c, g, or t
  modified_base (321)..(321): a, c, t, g, unknown or other
  misc_feature (321)..(321): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggattcgccttacaattaacttctggatgcacgtgggtccncaagctaccgaggggagggctgtagtttgggtctacgacgttattaactnttgagtgggagtagctcactactagtcggcggtacctcggtaggaacgggccgtacttaccacctattcctaccgagacgaaccaaccgaccaaacgaaaccacctaacgtagttactaccgtaggaactaaatcggaacgaccacgtacccgtaagggaaaccgaccccgaaccggaccgaaccgggtcgttacggttaggtttaactttacggttcggtagaaccggaaggggaaccgggggacctagggtacccttaacggtttacccgttaaccccgttaacccgttaaccccttacccggtaccgttttaacggttaccgggtacccgggttcgggttaaccggggggtaaccccggtaaccgggggtaccccggtaccggggg

SEQ ID NO: 203989 - DNA, 778 bp, Homo sapiens
  misc_feature: GYAE6OF02HSWTA.24.85.H08.1.454.CMB.1.raw
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcgaggggtccctgagacctctcctgtgcagcctctggacttccgccttacaaattaacctttctaggattcgacctaccgttcggggtaccccgaccaaacggtcccgtacccggaaggggggaaacgggggtccttagggttaacgtttttcgggggtaccttaccggtaaaccggtttaagtttaaaaccgtagttttaggaacggttagggggtaacgttaacggtccttaccgaacctaacgttagtcgggaccggtaccgttccgggtaagggaaccggggtccgtaactttccaacccgtacttacctaccgaaggtaacgaaccaaccgacccgaaagaaaacccactaacgttagtaactcgtagaactaaagtcgaagaccacgtacctaaggaaaccgccgaacgaccgacggtctagttacgtacgttacgtggtacgacggtaaggggacggggtaccaaggtaccgttaactttacccgtcctttaaccgtaccgtacccgtagtttacggtacgggtaccggttaccgggtaccggggtaacccgaccggggtacccgtaaccgggg

SEQ ID NO: 203990 - DNA, 783 bp, Homo sapiens
  misc_feature: GYAE6OF02I6BO7.24.85.H08.1.454.CMB.1.raw
tcagactactatgtcacgaccggtgctcgatttagtatcactcagtcgcgggggagccccagccctgggattcccagctgtttctgcttgctgatcaggactgcacacagagaactcaccatggagtttgggctgagcttgggttttccttgttgcttattttaaaaggtgtccagtgtgaggtgcagctggtgggaggtccggggggaggtcttaggttcaggcccggttgggggggtccccttggacgaccttcctccgtggtgcctagcctcgtggacttccgcctttacaaacttaacctttcgtaggatgcgaccggttcgggtcccgaccaaggtcccgtaccggaaggggaacgggtcgtaggtaggttttcggggtccttcgtaacgttaatttaacgtaagtttacgaggttggggtaaggttagccttacgaacctaacgttacgtacggaccggtaaccgttacccgggtaagggaaccgggtaccgtaacttaccgacccgtataccgtacgaacgggaacaacccgaaaccgccgaaaagaaaccctacgtaaccgtagtttaactcgttacgaacgtaaacgtacggagaccctaacggaccgtaaacggaaacggtaaccccggaacgtaacccggacgtccggttagttacgttaacgttttcggacgtacggtaaccggtaaagggggaccgggtaccgtaaggtccgtttaactttacccgttaccctttaaccggttccctaaccgttacgttacgtacccggg

SEQ ID NO: 203991 - DNA, 651 bp, Homo sapiens
  misc_feature: GYAE6OF02IGPKD.24.85.H08.1.454.CMB.1.raw
  modified_base (442)..(442): a, c, t, g, unknown or other
  misc_feature (442)..(442): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggattcgccttcaatacttctggatgcacgtgggtcccgcaagcctaccgagggaagggctggtatttcgggtcctacgacgttatacagttatgtaggtaggtagtacgctacactactagacggcggtacgtacggacggacggtacctataccacgtactccgtacgagaacaaccgaacgaccgaaacgaacactacgtgtactcganaacgaagtgacgacgacgtaaccgacggaaccgaccgaaacgtacccgtacgtgttacggttacgtttattaccggtgtaaccggagggaaaccggggacggacgaaccgtccgtttaaccttccctaacccgtttaaccgtacccgtacgttacgtacggtaccgggttaccggtcggggtaacccgggaccggaacggtaccccggg

SEQ ID NO: 203992 - DNA, 747 bp, Homo sapiens
  misc_feature: GYAE6OF02HT8UV.24.85.H08.1.454.CMB.1.raw
  modified_base (516)..(516): a, c, t, g, unknown or other
  misc_feature (516)..(516): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcgacggggtccctggacgacctctcctgtcgcacgtcctcgtggtacttccgtccttacaaattaacttctggatcggctacgtcgggtccgacctaacgcgtaccggaaggggacgggtcttaggtacgttttcgggtacctacgttaacgttaatttaaaccgtagtttaggacggttaggggtaacgttacgcccgtactaaaccgtcgtaacgtccggtaccggtaccgttaccgggtaaggaacggggttcctaacttccaaccgtatacccgaccgtaaggaactaaccgaacccgtaccgaaacgtaaaccnccgttaacttacggtacctacgtaacgtaactaaaacgtggaaccgaccgtacggtacccaacgggtaaaccgccgaacggaaccggtacggtacgtagttacgttaacgttcgtacggtacgaacgggacgggacggggtacctaggtacttaacggttaccctacctaccgttaccgtccgtagtacgtcgggtaccggcggacggggtacccgagggtacctaccggg

SEQ ID NO: 203993 - DNA, 533 bp, Homo sapiens
  misc_feature: GYAE6OF02FJXRE.24.85.H08.1.454.CMB.1.raw
  modified_base (385)..(385): a, c, t, g, unknown or other
  misc_feature (385)..(385): n is a, c, g, or t
tcagactactatgtcacgaccggtgctcgatttagtatcactcagtcgcgggggagccccagccctgggattcccagctgtttctgcttgctgatcaggactgcacacagagaactcaccatggagtttgggctgagctgggttttccttgttgctattttaaaaggtgtccagtgtgaggtgcagctggtggagtccgggggaggcttagttcagcctggggggtccctgagactctcctgtgcagcctctggattcgccttcaataacttctggatgcactgggtcccgccaagctccgagggaaggggctgatttgggtctcacgtattaacatttgatgggatagctcacactatgcggactcgtgaagggccattcaccntcctccagagacaacgccaagaaacacactgtatctgacaaatgagcagcctagaacgccgaacgacaccggctagtgtattacgtgtgacgaagggcggggaccaggacctagttacctcctacctaccgtaccgtctagtaccggg

SEQ ID NO: 203994 - DNA, 251 bp, Homo sapiens
  misc_feature: GYAE6OF02H0HCH.24.85.H08.1.454.CMB.1.raw
  modified_base (200)..(200): a, c, t, g, unknown or other
  misc_feature (200)..(200): n is a, c, g, or t
  modified_base (213)..(213): a, c, t, g, unknown or other
  misc_feature (213)..(213): n is a, c, g, or t
  modified_base (223)..(251): a, c, t, g, unknown or other
  misc_feature (223)..(251): n is a, c, g, or t
tcagactactatgtcacgaccggtgctcgatttagtatcactcagtcgcgggaggacgctgaccacacggtacgtgctgttgtactgctcctcccgcggctttgtcttggcattatgcaccctcacgccgtccacgtaccagttgaacttgacctcagggtcttcgtggctcacgtccaccaccacgcagtgtgacctcnggggtccctgganctctccgtgnnnnnnnnnnnnnnnnnnnnnnnnnnnnn

SEQ ID NO: 203995 - DNA, 642 bp, Homo sapiens
  misc_feature: GYAE6OF02F175N.24.85.H08.1.454.CMB.1.raw
  modified_base (534)..(534): a, c, t, g, unknown or other
  misc_feature (534)..(534): n is a, c, g, or t
tcagactactatgtcacgaccggtgctcgatttagtatcactcagtcgcgggggagccccagccctgggattcccagctgtttctgcttgctgatcaggactgcacacagagaactcaccatggagtttgggctgagctgggttttccttgttgctattttaaaggtgtccagtgtgaggtgcagctggtggaggtccggggagcttagttcagccgtgggggtccctgagactctcctgtgcagcctcgtggacttccgccttacaattaacttcgtggatgctacgtcggggtccgaccaagtccgtaccggagggggaacgggctaggtagtttcgggtctacgacgttattaacagttgatgggagtagctacacactagtgcggtactccggaggaacgggccgtataccactcgtcctaccgaaggacgaaccgaaccgaccgaacgaaaccactacgtgttaactctagactaaatgaacgcacgacgtaacggaaacgtcccgaacgtaccgacggtcttaggttnttaacttagtggttacggaccgtaaggggggaccggggtacccaaggtaccttaaccgtttaacccgtccttaaaccgttaccgtacccgtaccgttaggtacccggg

SEQ ID NO: 203996 - DNA, 632 bp, Homo sapiens
  misc_feature: GYAE6OF02FRKH1.24.85.H08.1.454.CMB.1.raw
  modified_base (334)..(334): a, c, t, g, unknown or other
  misc_feature (334)..(334): n is a, c, g, or t
  modified_base (361)..(361): a, c, t, g, unknown or other
  misc_feature (361)..(361): n is a, c, g, or t
  modified_base (423)..(423): a, c, t, g, unknown or other
  misc_feature (423)..(423): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcgacggggtccctggacgtaccttctcctgtgcacgcctcgtggattccgtccttactaattaacttctggactgcacgtcgggtccaccaagctccgaggggaagggtctagagtttgggctcgacgtattaactnttgagtgggagtacgctcactactagngcggtacctcggtgacgggctactccacactcacagacacgaacgacgaacaaacacacgtntactctagacaaagtgacgcgacgaccgtaagaaccgaccgacgacgacggtctacgttacgttacttacgtgtacgaggtaaacgggacggggtaccagtacctaacggttaacccttccgttaaccttacccgttccgtaacgttacggtacgggtaccggttccggggtaccgggaaccgggtaccggggtaccgttaacccgggg

SEQ ID NO: 203997 - DNA, 593 bp, Homo sapiens
  misc_feature: GYAE6OF02JEFB5.24.85.H08.1.454.CMB.1.raw
  modified_base (241)..(241): a, c, t, g, unknown or other
  misc_feature (241)..(241): n is a, c, g, or t
  modified_base (268)..(268): a, c, t, g, unknown or other
  misc_feature (268)..(268): n is a, c, g, or t
  modified_base (342)..(342): a, c, t, g, unknown or other
  misc_feature (342)..(342): n is a, c, g, or t
  modified_base (349)..(349): a, c, t, g, unknown or other
  misc_feature (349)..(349): n is a, c, g, or t
  modified_base (426)..(426): a, c, t, g, unknown or other
  misc_feature (426)..(426): n is a, c, g, or t
  modified_base (430)..(430): a, c, t, g, unknown or other
  misc_feature (430)..(430): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccacacgcatgtgacctcaggggtccctgagactctcctgtgcagcctctggattcgccttnaatacttctgatgcacgtcgggtcccnccaagcctaccgagggggaacgggctggtacgttttgggcctacgacgttattaacattgagtgggagtagctnacactancggcgactcggtgaacggccgattccaccatcctacagacgaccaacgccaagaaaccacactgtatccagactaancganccgagcctaagaaccgaccgacgacgacggtcttgttagttaccttagtggtagacgaaaggggtcgggacctagtaccgtactttaacctcccgtaactccgtacccgattacggtacggccggtttaccggccggggtaacgaccgggtacgtaacccggg

SEQ ID NO: 203998 - DNA, 725 bp, Homo sapiens
  misc_feature: GYAE6OF02H3CCA.24.85.H08.1.454.CMB.1.raw
  modified_base (264)..(264): a, c, t, g, unknown or other
  misc_feature (264)..(264): n is a, c, g, or t
  modified_base (288)..(288): a, c, t, g, unknown or other
  misc_feature (288)..(288): n is a, c, g, or t
  modified_base (382)..(382): a, c, t, g, unknown or other
  misc_feature (382)..(382): n is a, c, g, or t
tcagactactatgtcacgaccggtgctcgatttagtatcactcagtcgcgggggagccccagccctgggattcccagctgtttctgcttgctgatcaggactgcacacagagaactcacatggagtttgggctgagcgttgggtttttccttgttgcttaattttaaaaggtgttccagttgtgaggtgcagcgtggtggtaggtccgggggagtctttagttcgaggccgttggggggtccctgacgacttcctcctgtgacncgcctcgtggactttccgcccttnaaattaacttctaggatgcacgtcgggtcccacacgccgtccgaagggggacgggcttggtattttcgggtcctacgtaacgtttaattaacgntttaggagttagggaagtcgccttacaactattacgtcggacggtaaccgtccggtagggaaaccggccgttacgttaccaacctctacctaccgaagaacgaaccgaacccgaactaaacgaaaaccctacgtaacgttagttaacctcgttacgaaacgtaaagttcggacgtaacccaacggtccgtaaacgggaaaccgtacccgaacccgggtacctaacggccgttaggttaacgtactttaccgtgttaacgacgggttaacgggaccgggtacaaccgttacgtaacccgtttccgttaccctaaccttacccgtcccgtacttagggtaccggg

SEQ ID NO: 203999 - DNA, 760 bp, Homo sapiens
  misc_feature: GYAE6OF02ISC4U.24.85.H08.1.454.CMB.1.raw
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtcgaccttcgacggggtccctggacgtacctccttcctggtcgccacgtccttcgtgggtacttccgtccttactaaattaacttcgtggatcgcgtactcgggtccgaccaacgtccgtaccggagggggaacgggtctaggttacgttttcgggtccttccgtaacggtttaattaaaccgtatttaggaggtttacggggagttacggcctaccgaactacgttaacgtcgtccgggtacctaccggtacgggaaccgggtcctactaccgtacctacgtaccgtaccgaaggtaacccgaaccgtaacccggaccgtaaaccggtaaaacctacctaacgttagttacctacgtacgtaaacgtaaacgtgtaaccgactacgtaccgtaacgaaccgacggaacccgacggtacgtcgttagtacgtttaagttaccgtggttacgaaccggtaaacgggcggggtaccaacggttacctacgttttacccgcttaaccgtaccttaccgagttcgtacgggtaccggtttacggaccgggacggtaccgggtacctaccgggg

SEQ ID NO: 204000 - DNA, 739 bp, Homo sapiens
  misc_feature: GYAE6OF02FQNI4.24.85.H08.1.454.CMB.1.raw
  modified_base (259)..(259): a, c, t, g, unknown or other
  misc_feature (259)..(259): n is a, c, g, or t
  modified_base (278)..(278): a, c, t, g, unknown or other
  misc_feature (278)..(278): n is a, c, g, or t
  modified_base (590)..(590): a, c, t, g, unknown or other
  misc_feature (590)..(590): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcaggtcttcgtggcctcacgtccaccaccacgcatgtgacctcgaggggtccctgacgacttcctccgtgtgcacgcctctggattcgccttacaatacttcgnggatgctactcggggtccnccaagcctccgagggaaggggctagagtttcgggctacgacgttaacttaacctagtttggagtagggggattagcttacaacgtactagtcgcggtactccggtaggaaacgggtccgtaattccgacctagtcccgtaccgaacggtaagaacccaacgcccgaaacgaaactctaaccgttagtaacttcctaaggaccttaaaaggtcgacgacgtaacgtcccgtaacgggaaaccgacccggtaacgacggtaaccggtacgttaggttacgtaaacgtttaccgtgtaccgaacgtaaacggggnggggtaccctaaggcccgttaaagttaccccgttacccgttaaccgttacccgttacccggttaaccgttacggtttacccgggaaccggggtttcccgggtaacccggggggaacccggttaaacccgggggtcccgtaaacccgggg

SEQ ID NO: 204001 - DNA, 672 bp, Homo sapiens
  misc_feature: GYAE6OF02ID29D.24.85.H08.1.454.CMB.1.raw
tcagactactatgtcacgaccggtgctcgatttagtatcactcagtcgcgggggagccccagccctgggattcccagctgtttctgcttgctgatcaggactgcacacagagaactcaccatggagtttgggctgagctgggttttccttgttgctattttaaaaggtgtccagtgtgaggtgcagctggtggagtccggggagcttagttcagccgtgggggtccctggagactctcctgtgcacgcctcgtggacttcgcctttcaattaacttctggatgctacgtcgggtccgccaagccgttaccgaagggggtaacgggggtccttaggtacgttttcggggtccttcgtaacgttaattaaaccgtagttggagtggggagtacgaccttcaacgtactatcggccggacgtaccggtagaaacggggtccgtaattccaacccgtatcccgtaccgaaggaacgaaccaaaccggtacccaaagaaaaccaccgtacgtagtaactctagactaaaatcgaacgcacgaccgtaaggaaaccgaccgacgaaccgacgggacttgtacgttaattacgtcggtacgacggaaggggacggggaccaaggtacttaacgtttaccttacccgttaaccttaaccgtcccggtacttagtaccggg

SEQ ID NO: 204002 - DNA, 728 bp, Homo sapiens
  misc_feature: GYAE6OF02HE2B0.24.85.H08.1.454.CMB.1.raw
tcagactactatgtcacgaccggtgctcgatttagtatcactcagtcgcgggggagccccagccctgggattcccagctgtttctgcttgctgatcaggactgcacacagagaactcaccatggagtttgggctgagtctgggttttccttgttgctattttaaaaggtgtccagtgtgaggtgcagcgtggtggaggtccgggggaggtcgttagttcgacggtccggttcgggggggtccctggacgaccttcctccgtgtcgcacgcctcgtaggtacttccggcctttactaaacttaacctttcgtaggactgacctacgtcggggtcccgaccgaacgccgtaccggaggggaacggggtcgtaggtagttttcggggtccttcgtaacgttagttaaactagttacgtaggtacgggagttacgtcgtacactaccgtaagtcgacggtacctacgggtagaacggggtaccctagttacccacctacgtccttccgaacgtacgaaccaaccgacctaaacgaaaccactactgtaacttcgaagtacaagtgacgaccgacgtaccgtaagaaaccgtccgaaaccggtaccgacggtacgttaggtatttaccgttagcggtaacgtaacggggaacggtaacggggccctaagtaccctttaacgttacccgttaaccgttaacgtaccccggtttaccgtacgttaaggtcccggg

SEQ ID NO: 204003 - DNA, 751 bp, Homo sapiens
  misc_feature: GYAE6OF02IR9RM.24.85.H08.1.454.CMB.1.raw
  modified_base (266)..(266): a, c, t, g, unknown or other
  misc_feature (266)..(266): n is a, c, g, or t
tcagactactatgtcacgaccggtgctcgatttagtatcactcagtcgcgggggagccccagccctgggattcccagctgtttctgcttgctgatcaggactgcacacagagaactcacatggtagtttgggctgagcgttgggttttccttgttgcttaagttttaaaaggtgttccgagtgtgaggtgcagcgtggtggacggtccgggggaggtcttagttcgagtccggtcggggggtccctggacactctccgtgtcgacncgtcctgtaggtcttccgtaccttactaaacttaactttcgtaggtatacgtactacggtcggtcccggaccaagcccgtacggaggggaacggggtcgtaggtgtttgggacctagtaacgttaattaactagttacgagtagggtagtgtactacaacgtaacgtacgtcggacggtaccgtacgggaggtaacccgggtacggtaactttaccgaacgtactaccgtacgaaacggtaaccgaaaccgaaaccggacccaaaacgtaaaaccgaaccgtaacgttaacgtacggttactaggaaaccgtaaagtaggacgacgaacgacgtaacggaaacgaccggaaccgtaacggacgtacgttaggtcgttaacgttagtcggttaacggaaccgggtacgggtaggggaacccgtagttaaccgtaactttacccgtaaccgtaaccgttacccgtaccggttagtaccgttaacggg

SEQ ID NO: 204004 - DNA, 614 bp, Homo sapiens
  misc_feature: GYAE6OF02HBM2X.24.85.H08.1.454.CMB.1.raw
  modified_base (310)..(310): a, c, t, g, unknown or other
  misc_feature (310)..(310): n is a, c, g, or t
  modified_base (469)..(469): a, c, t, g, unknown or other
  misc_feature (469)..(469): n is a, c, g, or t
  modified_base (487)..(487): a, c, t, g, unknown or other
  misc_feature (487)..(487): n is a, c, g, or t
tcagactactatgtcacgaccggtgctcgatttagtatcactcagtcgcgggggagccccagccctgggattcccagctgtttctgcttgctgatcaggactgcacacagagaactcaccatggagtttgggctgagcttgggttttccttgttgcttaattttaaaaggtgtccagtgtgaggtgcagcgtggtgggacggtccgggggagcttagttcacgccggtggggggtccctggacgactctccgtgtgcagcctcgtggtattccgtccttacaattaacttcgtggatgcacgtcggtccncaagctcggagggacgggctcggtagtttcgggtctacgtaacgttattaacgtagttgaacggttgggtagtacgtctacacgtactagtcgacggtactcggtaggaacggtccgtactccactacttccaccgagaacgaccgtaaccaccgaaanaaaccacgtactgtactnacgtacaaagtgaacgcgagaccgtaagaaccgaccgacacgtacggtcttagtacgttatcgtgtagacgaaggggcggaccagtacttacttaccttaccgtaactccgtaccgattacggtcgg

SEQ ID NO: 204005 - DNA, 740 bp, Homo sapiens
  misc_feature: GYAE6OF02G6V5A.24.85.H08.1.454.CMB.1.raw
  modified_base (252)..(252): a, c, t, g, unknown or other
  misc_feature (252)..(252): n is a, c, g, or t
  modified_base (270)..(270): a, c, t, g, unknown or other
  misc_feature (270)..(270): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggattcgccttcaataacttcnggatgcacgtcgggtccnccaagcctccgaggggaaggggctggtagtttgggctcgacgttaattaacgattgagtggggtatagctacactactatggccggtactccggtaggaacgggccgtacttcgacctacttccgtacccgaggaacgtaaccgaacccgacctaaacgaaaaccctaccgtaacgttacgggtaacttaccgtaacggtaacctaaaaggttcgggaacgtaccgtaacggtaccccgtaaagggaaacccggacccggtaaaccggaaccgtaacccgggttcgttacgggtttacgtttaacgtttaccgggttggttaacccgaacgggtaaacggggaccggggtacccgtagtaccgttaactttaccccgtacccgttacctaccggtacccgtacgtttaacggtaccgggtaccggttccggggacggggtaacccgtaacgggggtacccgtacccgggg

SEQ ID NO: 204006 - DNA, 882 bp, Homo sapiens
  misc_feature: GYAE6OF02F5KIE.24.85.H08.1.454.CMB.1.raw
tcagactactatgtcacgaccggtgctcgatttagtatcactcagtcgcgggggagccccagccctgggattcccagctgtttctgcttgctgatcaggactgcacacagagaactcaccatggagtttgggctgagcttgggttttccttgttgcttaattttaaaggtgtccagtgtgaggtgcagctggtggaggtccgggggagcttagttcagccgtcgggggtccctgacgactctcctgtgcacgtcctcgtggtacttccggtcctttacaaacttaacctttcgtagggtatcggaccgtacgttcggggtccccgacccgaagtcccgttaccggaaggggggaacgggggtccgttagggttaacggtttttcgggggtaccttaccggtaaccggtttaaacttttaaaccgtagttttaggaaggttacgggggtaaggttaacggtccgttaccaaaccgttaaccgttaaggttccgggaccgggttaacccgtttacccggggtaacgggtaaaaccgggggttcccggttaaacttttaccccgaacccgtactttaccccgtaacccggaagggaaacccgtaaacccgaaacccgtacccgaaaacggtaaaaacccaccgttaacgtacgttaacttccgtaacgtaactaaaacgggtcgaacgtccggaacggtaccctaaacgggaaacccgaccccggggaaacgtaaccggtaccggtacgttaggtttaaccgttagttacccggttaggtaccggaaccggaaagggggggtccggggaccctaacggtaactttaccgtttaacccgttacccgttaccggttacccgtcccgttacggttaggtacccggggg

SEQ ID NO: 204007 - DNA, 836 bp, Homo sapiens
  misc_feature: GYAE6OF02IQWRB.24.85.H08.1.454.CMB.1.raw
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcgagggtcttcgtggctcacgtccaccaccacgcatgtgacctcgaggggtccctgacgactctcctgtgcacgcctcgtggattcgccttcaataacttctaggatcgctacgtcgggtcccaccaagcctaccgaggggaacggggcttaggtagttttcggggacctacgaccggttaattaaaccagttggacgttgggagtacgacctaccacgtacttgtcgggaccggtaacgttcccgggagggaaacggggtacccgtacttaccacccgtaacgttcccgtacccgaaggaccgaaaccccgaaaccgggacccaaaacggtaaaacccaccgtaaaccgttaggttaaccttaaccgttagaacccgtaaaaatcgggaaacgtcccgaacgttaccccggaaaggaaacccggtccccggaaacgtaaccccgtaccgggtacgtttacgggtttacgttttaaacgttaaccggttacggtaaccgggaaacggttaaaccgggggtaccggggggaccccttaaaggttaccccgtaacggttttaaccccctttaacccggtttaaacccctttaccgaccccggtttaggtaaccgtttaccggggttacgggttcccgggtaaccgggggaccccggttaaccgggggaaccccgtaccggggg

SEQ ID NO: 204008 - DNA, 651 bp, Homo sapiens
  misc_feature: GYAE6OF02F74GX.24.85.H08.1.454.CMB.1.raw
  modified_base (384)..(384): a, c, t, g, unknown or other
  misc_feature (384)..(384): n is a, c, g, or t
  modified_base (526)..(526): a, c, t, g, unknown or other
  misc_feature (526)..(526): n is a, c, g, or t
tcagactactatgtcacgaccggtgctcgatttagtatcactcagtcgcgggggagccccagccctgggattcccagctgtttctgcttgctgatcaggactgcacacagagaactcaccatggagtttgggctgagcgtggtttcgtgtaggctatttaaagtgtcagtgtgagtgcagctggtggaggtccggggaggcttagttcagtccgtgggggtccctgagtactctcctgtcgcagtcctgtggtattccgtccttacaattaacttcgtaggatgcctacgtggggtcccgccaacgccgtaccggaggggtaacggggctaggttagtttggtcgtactacggttaattaacgattaggatcgggagtacgtcnactactagtcgaccggtctacggtagaacgggtccctaagtccacctatcccgtaccgagaacgacctaaccgaccgaaagaacctacctaggtctacgttacgatacgaaatgacaagacgtacgacgaaacgacccgaanaccggagttcctggtaacgttctacgtagcgtaccgaaagggggttacggacctacggtaactttacctaaccgggtttaccctaaaccgggttccctccgggttaccctaaggttccccggggg

SEQ ID NO: 204009 - DNA, 630 bp, Homo sapiens
  misc_feature: GYAE6OF02GM7S5.24.85.H08.1.454.CMB.1.raw
  modified_base (229)..(229): a, c, t, g, unknown or other
  misc_feature (229)..(229): n is a, c, g, or t
  modified_base (312)..(312): a, c, t, g, unknown or other
  misc_feature (312)..(312): n is a, c, g, or t
  modified_base (337)..(337): a, c, t, g, unknown or other
  misc_feature (337)..(337): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcagggtccctgagactctcctgtcgcagcctntggattcgccttcaataacttctgatgcactgggtccgccaagctaccgagggagggctggatttgggctcgacgttataacnttgagtgggatagctcaacactagnggaccggactcgagacggccattcacgatccgtcaaggtacgaccaaccgcaacgaaacacgacgtatacgtactagaactaaagtcgaacgtcgtaacgtaccgtaaggtaaaccgccggaacgaaccgacggtaccgtggttacgtacgttacgtggttacgaacggaacgggtaccgggggacctacgacgtaacgtttaacccgttaccttaaccgttacccgtacccgtacgttacgtaccggttacgtccggtaccggggtaacccgaacggggtacccgtaccggg

SEQ ID NO: 204010 - DNA, 605 bp, Homo sapiens
  misc_feature: GYAE6OF02F0USI.24.85.H08.1.454.CMB.1.raw
  modified_base (371)..(371): a, c, t, g, unknown or other
  misc_feature (371)..(371): n is a, c, g, or t
  modified_base (464)..(464): a, c, t, g, unknown or other
  misc_feature (464)..(464): n is a, c, g, or t
tcagactactatgtcacgaccggtgctcgatttagtatcactcagtcgcgggggagccccagccctgggattcccagctgtttctgcttgctgatcaggactgcacacagagaactcaccatggagtttgggctgagctgggtttttccttgttgctattttaaaaggtgtccagtgtgaggtgcagctggtggagtccggggaggcttagttcagcctggggggtccctgacgactcttcctgtgcacgcctcgtggattccgcctttacaattaaccttcgtggatgcacgtcgggtcccgccaagctccgaggggaagggctgagtttggctcgacgtattaacagttgatgggatagctcacactangcggactccggtagacgggcccgattccgacctatccgtaccaggacgaccaacgaccaaacgaaaccacactatacgtctagacaatggacncagtaccctaggaaaccgccggaacgacgaccggtctagtgttaactaccgtgtcgaacgtaacgggaggggtaccctaagaccttaacgttacccttaccgttaacccttacccgttcccggtacgttacgtaaccgggg

SEQ ID NO: 204011 - DNA, 905 bp, Homo sapiens
  misc_feature: GYAE6OF02ISSVS.24.85.H08.1.454.CMB.1.raw
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgacttgacctcagggtcttcgtggctcacgtccaccaccacgcatgtgacctcgaggggtcccctgagactctcctgtgcagccctctgggacttccggtcctttacaaattaacctttctggattggacctacgtcggggtcccgacctaaggccgtacccgaaggggggtaacgggggtcttacgggttacgtttttcggggggtcctttaccggtaaccggtttaatttaaaccgtaaccggttttggtacggttacggggggtagtttaacggccctttaccgaaccttaacgttaacgttcgggaccgggtaacctttcccggggtaaggaaaccgggggttcccgaaacgttttcccgaaaccttacgtttccccgttaacccgaaacgggaaacctaacccggtaaaacccggcccgtaaaacgggaaaaaccctaaccgtaaaccgtttacggttaaaccttaccgttagggaaaccctaaaaagttcggaaaccggtccaaacgggtaccccgtaaacgggaaaaccgggacccggaaaaccgggaccgaaacccggggttccgttaccggtttacgttaacgttttaacgtcgggttacgtacgggtaaacgggtaccggggggacctaacgggtaccctaacgttttaacccgtaacccggttaaccttacccgttcccgtacgttaccggttacgggtaaccgggttccggtaacgggggtacccgaacgggggtacccggtaacgggg

SEQ ID NO: 204012 - DNA, 882 bp, Homo sapiens
  misc_feature: GYAE6OF02IQCOE.24.85.H08.1.454.CMB.1.raw
  modified_base (274)..(274): a, c, t, g, unknown or other
  misc_feature (274)..(274): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggacttcgccttcaataacttctggatgctacgtcggggtcccnccaagccgtaccgaaggggaacggggctaggtagttttggggtcctacgtacggttaattaaccagtttcggagttaggggtaacgttaggcctacgaactacttagtcggcccggtaccgtccggtagggaaacggggtccctaagtttcccgaacccgtattcccgtaccgaaacggtaacggaacccgtaaacccggacccgaaacggtaaaaacccctaaaccgtaccgtttaacggttaactaccgttacggaaacctaaaaagttcgggaacgtaccgtaaccggtacccggttaaacggaaaaacccggtccccgggaaaccggtaaccccgggtaaccggggttacccgttaaggggttttaaccgttttaaaccggtttttaaccggtagggtttaacccgggaaacggggtaaaacgggggttaacccggggggggaccccttaaaccgggtacccgtttaaaaccgtttttacccccggtaaccctttttaaccccggtaacccggtcccggttaaccgtttaacggtccggggttaacccgttccggggtaccggggggtaccccggaaacgggggttacccccggtaaccggggg

SEQ ID NO: 204013 - DNA, 861 bp, Homo sapiens
  misc_feature: GYAE6OF02INTRP.24.85.H08.1.454.CMB.1.raw
tcagactactatgtcacgaccggtgctcgatttagtatcactcagtcgcgggggagccccagccctgggattcccagctgtttctgcttgctgatcaggactgcacacagagaactcaccatggagtttgggctgagtctgggttttccttgttgctattttaaaaggtgtccagtgtgaggtgcagctggtggaggtccggggaggtcttagttcgagtccgtggggggttaccctggtacgacgtcctcctgtcgcgacgccttctacggtacttccgtacctttacaaacttaacctttcgtggtaactcgcctacgttacggggtccccgacccgtaaacgcccgttaccggaagggggtaaggggtcctagggttacgttttcgggggtaccttacgtaaccggttaatttaaacgtagtttacggagttacggggacgttagtaccgtacctaaccgtaacttaacgtcggccggtaaccgtccgggttaacggtaaaccggggaccgttaacgttcccaaccgtacgttacccgtacccgtaaacggacgtaaacccgaaaccgacccgtaaacgaaaacccgtaccctaaccgttaacggttaaccttacgtacgtaaaccgtaaagttaccgggaaacggtcctaaacgtcccggtaaaggtaaacccgcccggtaaaccggtaacgacccgggtgtttaaccggtaacgttttaacgttaccgttcgggttaaccggaaggtaaaccgggggaccggggttaacccgtaaaggtacccgtttaaatttaacccggtttacccgttaaaccttaaccccggttaccggttaccgttaacggttaaccggggg

SEQ ID NO: 204014 - DNA, 865 bp, Homo sapiens
  misc_feature: GYAE6OF02IU24L.24.85.H08.1.454.CMB.1.raw
tcagactactatgtcacgaccggtgctcgatttagtatcactcagtcgcgggggagccccagccctgggattcccagctgtttctgcttgctgatcaggactgcacacagagaactcaccatggagtttgggctgagcttgggttttccttgttgcttaagttttaaaaggtgtccagtgtgaggtgcagctggtggaggtccgggggagtcttagttcgacgtccgtggggggtccctggacgactcgtctgtagccacgtcctcgtggtacttcgaccttacgtaaacttaacttccgtggaactcggccgtaaccggttccggggtacccggtcccaaacggtcccgtaaccgggaagggggggtaacgggggcgttaacgggttacggttttacggggtccttaaccgtaaccggtttaatttaaaccgttacggttaggtaagggttagggtaagtacgtaccttaacgtaacctaacttacggtacggaccggtaccggtaccgggtaagggaaccgggtcccgtaacgttcctaacccgtaagttcccgtaaaccgaaggaaaccgaaaccaaacccggtaccgaaaacgtaaacccgaactaccgttaagtaaccttacggtacgtaaacgaaacgttcggaacgaccgtacgtaacccggtaaagggaaacccggtcccgaaacgggtaacccttcgggtacttacggggttaatttaacccgttacggttcgggtaacggaacgggtaaaccgggggtaccggggtaactaagttaacccgttaaccggttttacctaacccccgttttaaccgttaaccccggtccccggttacttaccgggtttaccccgggg

SEQ ID NO: 204015 - DNA, 567 bp, Homo sapiens
  misc_feature: GYAE6OF02HG2B3.24.85.H08.1.454.CMB.1.raw
  modified_base (406)..(406): a, c, t, g, unknown or other
  misc_feature (406)..(406): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggattcgccttcaattaacttctggatgcactgggtccgccaagcctccgaggggaaggggctagtagtttgggtctcgacgtattaacattgagtgggagtagctacacactatgcgactcgtgacggccattcacctatctccagacgacaacgccaagaaacacactgtatcngacaagtgagcagccctaggaaacgcccgaacgaccgacggcttaggttgtacgttacgtgtacgacggaacgggacggggccaggacctacttaccgtcctaacctacgtaccgtcgtaacgtcggtacggtcgtacggggaccacgggaccgtaccggg

SEQ ID NO: 204016 - DNA, 654 bp, Homo sapiens
  misc_feature: GYAE6OF02FZW62.24.85.H08.1.454.CMB.1.raw
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcgaggggtccctgagactctcctgtgcagcctctggattcgccttcaatacttctggatcgcacgtcgggtccgccaagcctcgaggggaagggtctgtagtttgggcctcgtacgtattaacattgagtggggagtagctcacactagtggcgtactccgtaggacggcctattccaccgtatcctaccgaagacgaaccaacgccaaacgaaaccactaacgtagtacttacgtacgaactaaagtcgaacgtaccgaacgtacccgtaaggaaaccgcccggaacggaaccgacggtcttacggttagtaactttacgtggtacgaagaacggggacggggacctaagtcctaacgtttacccgtcccttaaccttcccggtacccgttacgttacggttaccggtaccggttaccgggtacggggaacccgacgggggtaaccctacccgggg

SEQ ID NO: 204017 - DNA, 862 bp, Homo sapiens
  misc_feature: GYAE6OF02IHX3O.24.85.H08.1.454.CMB.1.raw
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcgacggggtccctgacgactctcctgtcgcacgcctcgtggtactttccgccttacaaacttaacctttcgtagggtattcggcctaaccggttcggggtaccccgaccgaaacggcccgttacccggaagggggaacggggtcttaggttaacgttttcggggtaccttaccggtaaccggtttaactttaaaccgtagttttaggaacggttaggggaagttacgccttaccaacctacgttagtacggaccggtaccgtaccgggtaagggaacgggtacctaattccgaaccgttactcccgtacgaagtaccgaaaccgaaacccgtccgaaaacgaaacccgtacctaacgttagttaacgtcctacggaaactaaaacgtggtaacgaccgtaacggtacccgtaaaaggaaacccggtaccccggaaaccgtaacccgggtaccgggttcgttaacgggtttaactttaaacgttaccgtttaacgggtaacggtaaaccgggaaaggggtaaccgggggtaaccctaaggttacccgttaaccgtttaacccgtcccgttaaacccgttaccgtacccgtacgtttaaccggttcggggtaaccggttccgggttaaccggggggaacccgtaacgggggtaacccgtacccgggg

SEQ ID NO: 204018 - DNA, 805 bp, Homo sapiens
  misc_feature: GYAE6OF02GZV85.24.85.H08.1.454.CMB.1.raw
  modified_base (163)..(163): a, c, t, g, unknown or other
  misc_feature (163)..(163): n is a, c, g, or t
tcagactactatgtcacgaccggtgctcgatttagtatcactcagtcgcgggggagccccagccctgggattcccagctgtttctgcttgctgatcaggactgcacacagagaactcaccatggagtttgggctgagctgggtttccttgtgctatttaaagngtccagtgtgaggtgcagctggtggaggtccggggaggtcttagttcaggccgtgggggtccctgacgtactctccgtgtcgcacggcctcgtggacttcgccttacaattacttcgtggactgacacggtcggtacccgacctaagccttaccggaagggaagggtcctggtagtttcggggtactaccgtagttaacttaactgttaggagtagggagtacggtctacacgtacgtagtcggaccggtacgttaccggtaggaaccggggcgtacttaccgaaccgtcgtacctaccgaagacgaaacccgaaccgaaccaaacgtaaaaccgtaccgtacgtttaacgtaacgttaccgtaacggtaacctaaaggtccggtaaagtacccgtacggtaaccggttaaaccggtaaacccgggaacccggtaaaccgggaacccgttaaccggggttcccgttaaaggggttacccgttaacgtttacgggttacccgggtaagtaaccggggtaaacgggggttaccccgggggaccgttaaaccggttacccgtttaaccggtttaaccccgttaccccggtttaaaccccggttaacggtttcccccgttacggttaacgggtttaccccgggggg

SEQ ID NO: 204019 - DNA, 628 bp, Homo sapiens
  misc_feature: GYAE6OF02HOOJO.24.85.H08.1.454.CMB.1.raw
  modified_base (222)..(222): a, c, t, g, unknown or other
  misc_feature (222)..(222): n is a, c, g, or t
  modified_base (242)..(242): a, c, t, g, unknown or other
  misc_feature (242)..(242): n is a, c, g, or t
  modified_base (259)..(259): a, c, t, g, unknown or other
  misc_feature (259)..(259): n is a, c, g, or t
  modified_base (271)..(271): a, c, t, g, unknown or other
  misc_feature (271)..(271): n is a, c, g, or t
  modified_base (361)..(361): a, c, t, g, unknown or other
  misc_feature (361)..(361): n is a, c, g, or t
  modified_base (399)..(399): a, c, t, g, unknown or other
  misc_feature (399)..(399): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtncagcctatgattcgccttanaataacttctggatcgntacgtgggtccnccaacgctaccgaaggggaacgggtctggtattttcggggacttaccacggttaattaactattgaagtgggagtagcgtacacacttancggcgacgtccggagaacgggcctatcacatccacganagaccaacgccaagaaacatactgtatctagaacaaagtgaagcaagaccacggaaacgacccgaacggaccacggtcgtagttagttaacgttagtacggtagaacgtaagggacggggtaacacggtactaaccgtttacccgaccttaactacccgtcccgttacgttacggacgggtaccgttaccgggtaccgggggtaaccgaaccgggggaccctaacgggg

SEQ ID NO: 204020 - DNA, 690 bp, Homo sapiens
  misc_feature: GYAE6OF02G1TRB.24.85.H08.1.454.CMB.1.raw
  modified_base (267)..(267): a, c, t, g, unknown or other
  misc_feature (267)..(267): n is a, c, g, or t
  modified_base (309)..(309): a, c, t, g, unknown or other
  misc_feature (309)..(309): n is a, c, g, or t
tcagactactatgtcacgaccggtgctcgatttagtatcactcagtcgcgggggagccccagccctgggattcccagctgtttctgcttgctgatcaggactgcacacagagaactcaccatggagtttgggctgagtcgttgggttttccttgttgcttaattttaaaggtgtccagtgtggaggtgcagcgtggtggaggtccgggggaggtcttagtcgaggccggtgggggtcctgacgactctcctgtgcacgcctgtggtnttccgccttacaataacttcgtggtatcgcacgtgggtcccncaacgctaccggaggggtaacggggtctggtacgttttgggtcctactaacggttaattaacgtagttagaggttgggagtagtcctacactactagtcggcggtacgtcggtaggaacggtccgtattaccactactaccttaccgagtaacgaaccgaacccgacctaaacgaaacctacgaacgttgtaacttcgtaacaacgtaaacgtcgaacgacgtaacgtaccgaacgaaaccggacccgaaccgtaacgaccggtacgttaggtacgttaagtttaccgtaggtacggaacggtaacgggacggggtacccaagtaccgttaaacttacccgttaaccccttagtaccccgtcgtacgttaccgtaaccggg

SEQ ID NO: 204021 - DNA, 799 bp, Homo sapiens
  misc_feature: GYAE6OF02IL8F6.24.85.H08.1.454.CMB.1.raw
  modified_base (671)..(671): a, c, t, g, unknown or other
  misc_feature (671)..(671): n is a, c, g, or t
tcagactactatgtcacgaccggtgctcgatttagtatcactcagtcgcgggggagccccagccctgggattcccagctgtttctgcttgctgatcaggactgcacacagagaactcaccatgggagtttgggctgagcgtggtttttccttgttgcttaattttaaaaggtgtccagtgtgaggtgcagctggtggaggtccgggggagtcgttagttcgaggccggtcgggggtccctgacgtacctcctcctgtcgcctacgtcctcgtggacttccgtccttactaagttaccttcgaggtactcgacgtacgtcgggtcccgaccgaacgtccgtaccggaagggggaacggggtcgtaggttacggtttacgggtcctacgtacgttaacttaacgtagttaggaaggttagggagtacggtactctaactacgtactacggcggtaccgttccggtaacggacgggtcccgtaacgttcccaaccgtatcccgtaacggacgtaacgaacgaaccgtaccaaagaaactaccgtaacgttagttaacctcgttaacgaaccttaatacggtaccacggtaccgacggtaaacgaaacccggtacccggaaccggtaacggtacccgggttacgtttacggttaacggttaaccgtttttacggnggtttaaaccggtgggaaaacgggggggtcccgggtaacctaaacgggtcctttaaaaccccgttttacccgttaccccgtttaaaccttacccggggtacgtttaacccgttaggtaacccgggggg

SEQ ID NO: 204022 - DNA, 834 bp, Homo sapiens
  misc_feature: GYAE6OF02I3FLD.24.85.H08.1.454.CMB.1.raw
tcagactactatgtcacgaccggtgctcgatttagtatcactcagtcgcgggggagccccagccctgggattcccagctgtttctgcttgctgatcaggactgcacacagagaactcaccatggagtttgggctgagcttgggttttccttgttgcttaagttttaaaaggtgtccagtgtgaggtgcagcgtgggtggaggtccgggggaggtcttaggttcaggtccggtcggggggtccctgacgtactctccgtgtcgcacgtcctcgttcggtactttccggtccttactaaaactttaaacctttcgttagggtattacggcctacgttccggggggtcccgaccccaaacggtccccgtacccgggaaaggggggtaaacggggggtccttaaggggttacggtttttccggggtccgttaccggtaaaccggtttaactttaaacgtacgttttaggtaaggttacgggtagttaacgtccgttaacaaccgtactacgtacggacggtaccgttccgggtaaggaacggggtacccgtactttacccaaccgtaccgttcctacccgaacgtaaccgaaacccgaaccgaacccaaaacggaaaaccctaaacctaccgttaacgtaacttccgtacggtaaactaaacggacgtacggaacctacggtaacccgtaaggaaacccggaccggaaccgaccggtaaccggttcgttacgtaagtttacgttacttagggtcgacgggtaacgggaacgggggtcccaaggttaccttaaccgttcttaccgttaacccgttaccgtcccgtataccgggttacgg

SEQ ID NO: 204023 - DNA, 733 bp, Homo sapiens
  misc_feature: GYAE6OF02GO0U6.24.85.H08.1.454.CMB.1.raw
tcagactactatgtcacgaccggtgctcgatttagtatcactcagtcgcgggaggacgctgaccacacggtacgtgctgttgtactgctcctcccgcggtctttgtcttggcattatgcacctccacgccgtccacgtaccagttgaacttgacctcgagggttcttcgtggctcacgtccaccaccacgcatgtgacctcgagggtccctgagactctcctgtgcacgcctcgtggtacttccgtcctttactaataacttcgtggatcgcctacgtcgggtccgaccaacgccgtccggaaggggaacggggtctggtagtttgggtcctactacgttattaactagttggtagtgggtagtacgtctacactacgttagtcggtacggtacgtaccggtagggaacgggtaccgtacttacccactaccgttcgtaccgaaggtaacgaacccgtaaaccgaccgaaacgtaaaacccacgttaacgtcgttaacttaaccgtcgtaaactaaacggttacgacgaccgtacgaccgtaacggaaaccgcccgtaacgaccggtacgtagtacgtttacgtaaacttacgtacggtaccgaaggtaaacggggaccgggactaacgtacgttaaccgttacccgtaccgttaaccctaacggtcccgttacgtaggttacgggtaccggtttcgggaacccgggtacggaaaccggtccggggtacccgg

SEQ ID NO: 204024 - DNA, 659 bp, Homo sapiens
  misc_feature: GYAE6OF02GGRYK.24.85.H08.1.454.CMB.1.raw
  modified_base (221)..(221): a, c, t, g, unknown or other
  misc_feature (221)..(221): n is a, c, g, or t
  modified_base (228)..(228): a, c, t, g, unknown or other
  misc_feature (228)..(228): n is a, c, g, or t
  modified_base (250)..(250): a, c, t, g, unknown or other
  misc_feature (250)..(250): n is a, c, g, or t
  modified_base (264)..(264): a, c, t, g, unknown or other
  misc_feature (264)..(264): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcagggtccctgagactctcctgtncagcctntgattcgccttacaatacttgnggatgcagtggccncaagctcgaggggacgggtctggtacgtttgggtcctcgtacgttaattaacagttaggagtgggagttagcctacacactagtcggcgtacgtcggtagacggctatcacatccacagacacaacgcaagaacacactgtatctagaactaagtggacgaccgaagtccgtaagaaaccggtacccgaacggaccggtaccggtcgtttagggttacgtttacgtttacgtacgggtacgaacggaagggggaacggggtacccaacgttaccgttaccgtttaaccccgtcccgtttaaacccgttacccgtttcccggacgttttaccggtaccgggttaccggttaccggggtacgggggtaacccgaaaccgggggtaccgtacccgggg

SEQ ID NO: 204025 - DNA, 958 bp, Homo sapiens
  misc_feature: GYAE6OF02HANMM.24.85.H08.1.454.CMB.1.raw
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtcgacctcaggggtccctgagactctcctgtgcacgtcctctggacttcgcctttactaaacttaaccttcgtaggattcgctacgttggggtcccgacccaaaggccgtccggaaggggggtaagggggtccttaggtaaggttttcggggtcctacgtaacggttaacttaacgtacgtttaggtaggtagggtaaggtacgtaccttacaacgtaccgttaagtcgggtaccggtaccgttaccggggtagggaaccgggggtaccctaaacgtttcccgaaaccgtaacgttcccgttaacccgaaacggaaaccggaacccgtaaacccgaacccgaaacggaaaaaccctaaccctaaaccggtttacggttaaacctttaccgtaacggtaaaccctaaaaggtttaccggaacggtacccgtaaaccggtaacccggttaaaacgggaaaacccggttaacccgggaaacccggtaaccggtaaccgggtaccggtttacggttaaccggttttaacgttttaacccggtacgggttacggtaaaccgggtaaacggggaaccgggggggtaccctaaccgggtacccgtttaaccggttttaaacccccttaaccccgggttttaacccctttaacccgggttacccccgggtttaaccttaacgggtttacccgggggttaacccgggttttacccggggtaaccccggggggtaacccgggttaaaaccggggggaccccggtttaacccgggggg

SEQ ID NO: 204026 - DNA, 662 bp, Homo sapiens
  misc_feature: GYAE6OF02FPS8P.24.85.H08.1.454.CMB.1.raw
  modified_base (478)..(478): a, c, t, g, unknown or other
  misc_feature (478)..(478): n is a, c, g, or t
tcagactactatgtcacgaccggtgctcgatttagtatcactcagtcgcgggggagccccagccctgggattcccagctgtttctgcttgctgatcaggactgcacacagagaactcaccatggagtttgggctgagctgggttttccttgttgcttagttttaaaggtgtccagtgtgaggtgcagctggtggaggtccgggggagcttagttcagccgtcgggggtccctgacgactctccgtgtcgcacgcctctggtattccgccttacaattaaccttcgtggtactgctacgtcgggtcccacgaacgcgtaccggaggggacgggtcgtagtggtttgggctacgaacgttattaacgtgttaggagtagggaactacggtctacgacgtacgtagtcggacggtaccgtcggtacgacgggaccgtacttccgaactcgtacctaccgagacgaacctaacgaccgtaanaaaccgacgaacgtagtaaccttcgtacgaactaagtacgacgacgtacgaccgtaagaaccgaccgtaacgaccgtaccgtcgtagtagttactacgtgacgtaacggaagggaccgggtactaacggtaccgttaacgttacccgtcgttaacccgtaccggtcccgttacgtcggtaccgg

SEQ ID NO: 204027 - DNA, 686 bp, Homo sapiens
  misc_feature: GYAE6OF02IX8TV.24.85.H08.1.454.CMB.1.raw
  modified_base (424)..(424): a, c, t, g, unknown or other
  misc_feature (424)..(424): n is a, c, g, or t
  modified_base (466)..(466): a, c, t, g, unknown or other
  misc_feature (466)..(466): n is a, c, g, or t
  modified_base (512)..(512): a, c, t, g, unknown or other
  misc_feature (512)..(512): n is a, c, g, or t
  modified_base (527)..(527): a, c, t, g, unknown or other
  misc_feature (527)..(527): n is a, c, g, or t
  modified_base (577)..(577): a, c, t, g, unknown or other
  misc_feature (577)..(577): n is a, c, g, or t
  modified_base (626)..(626): a, c, t, g, unknown or other
  misc_feature (626)..(626): n is a, c, g, or t
tcagactactatgtcacgaccggtgctcgatttagtatcactcagtcggtcgggggagccccagccctgggattcccagctgtttctgcttgcgtgagtcaggactgcacacagagaactcaccatggagtttcgggactggtagtcgttgggtttttccctttgggttcgaccgttaacgtttttaaaaagggtcgtcccgtagttcgttggaggttcgccacgcgtcggtggtacggtcccgggggtacggtcgttacgttaccacggtccgtaggggggtccctggacgtactcgtccgtgtcgcgacgccgtcgtggtacttcggtccttaacgtaacttaacttccgtagaattcggactacggtcgggtcccgaccgtaacgcgtaccggaaggggaacgggtctaggtagttggtcnctagttacttaacgtagttgagtacgggatagtcctacaacncgtagtgacggtaccgtccgtaggaacggtcgtacttccaaccgtntaccctagacggaanacccgaacgaccgaagaaacctacgacttagtactcagtacaacgtgacnctaagccttaaggaaccgcccaggaactcgtactggtaacttattacgngagtacgaacgggtcgggactacgattaccgttcaccgtacctccgtcctagtctacggg

SEQ ID NO: 204028 - DNA, 661 bp, Homo sapiens
  misc_feature: GYAE6OF02J2FPJ.24.85.H08.1.454.CMB.1.raw
  modified_base (352)..(352): a, c, t, g, unknown or other
  misc_feature (352)..(352): n is a, c, g, or t
  modified_base (392)..(392): a, c, t, g, unknown or other
  misc_feature (392)..(392): n is a, c, g, or t
  modified_base (599)..(599): a, c, t, g, unknown or other
  misc_feature (599)..(599): n is a, c, g, or t
  modified_base (632)..(632): a, c, t, g, unknown or other
  misc_feature (632)..(632): n is a, c, g, or t
  modified_base (641)..(641): a, c, t, g, unknown or other
  misc_feature (641)..(641): n is a, c, g, or t
tcagactactatgtcacgaccggtgctcgatttagtatcactcagtcgcgggggagccccagccctgggattcccagctgtttctgcttgctgatcaggactgcacacagagaactcaccatggagtttgggctgagctgggttttccttggttgtcttaagttttaaaaggtgtccagtgtgaggtgcagtcgtggtggacggtccgggggagtcttagttcgagccgtcgggggtccctggacgtactcgtccgtgtgacgcgtcctcgtggtcttccgtcctttacaattaaccgttctggatcgctacgtcggtaccgccgaacgtccgtaccggagggaacgggtcncggttagttttcggggtccttcgaacgttaacttaaacgnttcggtaagtgggtagtagtctcactacgtagtcggcgtacgttccggaggaacgggcgtacgtccgtaacctacgtccgaccgagaaccgaaccgaaacgtccaaaccgaaaccaactacgtcggtaactcgtacgaacaagtgaacgacctcggtaaccaacggaacgtacccgaacggacctcggtactaggttacgtatacgngtacgtcgaaggcggtacacgtctacgttaccncgttaaccnccgttacgtcgttagtacgg

SEQ ID NO: 204029 - DNA, 676 bp, Homo sapiens
  misc_feature: GYAE6OF02H38FY.24.85.H08.1.454.CMB.1.raw
  modified_base (183)..(183): a, c, t, g, unknown or other
  misc_feature (183)..(183): n is a, c, g, or t
  modified_base (249)..(249): a, c, t, g, unknown or other
  misc_feature (249)..(249): n is a, c, g, or t
  modified_base (604)..(604): a, c, t, g, unknown or other
  misc_feature (604)..(604): n is a, c, g, or t
  modified_base (662)..(662): a, c, t, g, unknown or other
  misc_feature (662)..(662): n is a, c, g, or t
tcagactactatgtcacgaccggtgctcgatttagtatcactcagtcgcgggggagccccagccctgggattcccagctgtttctgcttggctgatcaggactgcacacagagaactcaccatggagtttgggctgagcgtggttttcgtgtagcgtatttaaaggtgtcagtgtgaggtgcngctggtggagtccggggagcttagtcagccgtgggggtaccctggacgtacctctccgtggtcgcnggccttcgtaggacttccggtacctttcaaattacttcgtaggattgcacgttcgggtccacgtacgcctccggaaggggtacggggcttaggtaggttttcgggaccttacgtaacggtttacttaaactgttaggagtttggggaactcggcctacgacggtaactcggtcggtaaccggtccgtaccgtagggaccggaccgtagttacccaccgtaccgttccgacgacggaacgaaaccgtaccggtaccaaacggaaacgttactacccgttaggtaacctcggtaacaacgtaagtacggacacgtacggacgtaacggaaaccgcgaacggacgcgtcgtaacgttntacgttacctggcgacgaacggccgggacagtaccgactttaccacttacccgttacnccgtacgtctacgg

SEQ ID NO: 204030 - DNA, 638 bp, Homo sapiens
  misc_feature: GYAE6OF02F13LN.24.85.H08.1.454.CMB.1.raw
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcgaggggtccctgagactctcctgtgcacgcctgtggacttcgccttcaaattaacttcgtggatcgcctacgtcgggtccaccgaagcctaccggaggggaagggtcctggtacgtttgggtcctacgtaacgttaattaacagttaggagtggggtatacgcttcaactactagtcggccgtaccgtcggtaggaacggcctattaccgaacctactccacgaagacgaccaacgacaaacgaaaccactagttcgtactcgtagaacaaagtcgaacgtcgacgaccgtagaaccgtccgaacgtacgcggtatagtacgttacgttacgtgtacgaacgtacggggacgggcctaaggtactaccgttactcccgtaacttccggtaccgtgttaggtaccggtcgtacgggtaccggacggtaacggccgtaccgg

SEQ ID NO: 204031 - DNA, 765 bp, Homo sapiens
  misc_feature: GYAE6OF02I7VFG.24.85.H08.1.454.CMB.1.raw
  modified_base (377)..(377): a, c, t, g, unknown or other
  misc_feature (377)..(377): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgacttgacctcagggtcttcgtggctcaccgtccaccaccacgcatgtgtacctcgacggggtccctgacgacttcctcctggtgcacgtcctcgtaggtactttccgtcccttataacttaacctttcgtaggacttcggctaccgtcgggttacccgaacaacgtcctaccggaaggggacgggtcttcggttacgttttcggggtctaccggtaacttaacgtttaaacngtttaggagtggggaacgttagccttacaactactagtcggacggtacctccggtaggaaccgggccgttaagttaccactacgtcctacgagaccggtaaccaaccgtaccgaaagaaacctacgtaacgttagtacgttactaagaaccgtaaagtacgggacaacgtaacccgtaacgaacgaaaaccgcccggacgtaaccggtacgggcttaacggttacggtttaacttacggtaggtaaccggacggtaacggggtaacggggctacggtaacccttacggtttaacccgtccttaaaccgttccctaacccggtcgtttaggtacgggttaccggtaccggggtcggggaaacccggtacggggtacccggttaaccggg

SEQ ID NO: 204032 - DNA, 729 bp, Homo sapiens
  misc_feature: GYAE6OF02H9DJQ.24.85.H08.1.454.CMB.1.raw
  modified_base (494)..(494): a, c, t, g, unknown or other
  misc_feature (494)..(494): n is a, c, g, or t
tcagactactatgtcacgaccggtgctcgatttagtatcactcagtcgcgggaggacgctgaccacacggtacgtgctgttgtactgctcctccgcggctttgtcttggcattatgcacctccacgccgtccacgtaccagttgaacttgacctcagggtcttcgtggctcacgtccaccaccacgcatgtgacctcaggggtccctgagactctcctgtgcagcctctggacttccgccttacaattaacctttcgtggactgacacgtcgggtcccacgaagctaccggaaggggacggggctggtagtttcgggtctcgacgttaattaacagtttgagtggggagtagctacactacgtatcggacggtacctacggtagggaacggtcccgtattaccaacccgtattcccgtaccaaggaacgaaccaaccgtacccaaaggaaacccactaacgttcgtaactacgtacgaacaaaagttcggaacnccgtaacggtaaccgttgaaaaccggacccgtaacggaaccgtacggaccttaggtacgttaactttacgtggacgtaccgggaaagggacccgggggtactacggtaccttaaccgtttacccgtacccgttaaacccgttaccggtccccgtaacggtttacggttacccggaaccgggttttaccgggaccgggggtaaccccgtaacgggggtaacccgtttacccggggg

SEQ ID NO: 204033 - DNA, 676 bp, Homo sapiens
  misc_feature: GYAE6OF02FRWV8.24.85.H08.1.454.CMB.1.raw
  modified_base (359)..(359): a, c, t, g, unknown or other
  misc_feature (359)..(359): n is a, c, g, or t
tcagactactatgtcacgaccggtgctcgatttagtatcactcagtcgcgggggagccccagccctgggattcccagctgtttctgcttgctgatcaggactgcacacagagaactcaccatggagtttgggctgagctgggttttccttgttgcttattttaaaaggtgtccagtgtgaggtgcagctggtggaggtccgggggaggcttagttcagccgtggggggtccctgagactctcctgtgcagcctcgtggattccgccttacaaattaaccttctaggatcgctacgtcgggtacccgccaagcctaccggaggggacggggctgtagtttgggtctcgtacgtattaacngttagagtagggagtagctacactactagtcgacggtactccggtaggaacgggcccgtattcccaactctacctaccgagacgaaccaacgaccaaacgaaaccaccaactagttactcgtacgaacaaagtcgaagacgacgccgtaaggaaccgaccgtaacggaccgtacggtaccttaggttacgttagtttaccgttaggacggtaacggaaacggggtaccgggggacctaccggtaccgttaacgttttaccccgttaacccgtttaacccgttaccgtttaccccggtacgttacggttaacccgggg

SEQ ID NO: 204034 - DNA, 664 bp, Homo sapiens
  misc_feature: GYAE6OF02FU7IX.24.85.H08.1.454.CMB.1.raw
  modified_base (351)..(351): a, c, t, g, unknown or other
  misc_feature (351)..(351): n is a, c, g, or t
tcagactactatgtcacgaccggtgctcgatttagtatcactcagtcgcgggggagccccagccctgggattcccagctgtttctgcttgctgatcaggactgcacacagagaactcaccatggagtttgggctgagctgggttttccttgttgctattttaaaaggtgtccagtgtgaggtgcagctggtggagtccgggggaggcttagttcagccgtggggggtccctgagactctcctgtgcagcctctggattccgccttcaataacttctggatgcacgtgggtcccaccaagcctaccgaggggaacggggctaggtagtttggggtctacgacgttattaacnttgagtgggagtagctcaacacttagtcgacggtactccggtaggaacgggcccgtaattccaacctacgtcctacccgaacggaacgaacccaaaccgacccaaacgaaaccaaccacgtacgttacgttactacgaacctaaagtcgaacgccaacgacctaaggaaacgacccgaaccgaccgtaccggacttcgttagttaacgttacgtaggtacgacgggaaacgggaccgggggaccaacgaccgttaaccgttacccttacccgttaacccgttacccggtacccgtaccgttaaggtacccggg

SEQ ID NO: 204035 - DNA, 785 bp, Homo sapiens
  misc_feature: GYAE6OF02I7WER.24.85.H08.1.454.CMB.1.raw
  modified_base (360)..(360): a, c, t, g, unknown or other
  misc_feature (360)..(360): n is a, c, g, or t
tcagactactatgtcacgaccggtgctcgatttagtatcactcagtcgcgggaggacgctgaccacacggtacgtgctgttgtactgctccctcccgcggctttgtcttggcattatgcacctccacgccgtccacgtaccagttgaacttgacctcagggtcttcgtggctcacgtccaccaccacgcatgtgacctcgaggggtccctgacgactctcctgtcgcacgccttctgggacttccgcctttacaaacttaacctttcgtagggatcgacctacgttcgggtccccgaccgaacgcctaccggaagggggagggtccttggtagtttgggtcctacgtaacgttattaacngttagagtgggatagctacactactagtcggacggtacctccggtaggaacgggtccgtacttacgaacctacgtcctaccgaaggaacgaacccgaaccgaccgaaacggaaaaccctaccgtaacgttacgtaacgttacgtaacggaaactaaacgtcgggaaactaccggtacgtaacccgtaaacggaaaccggcccgaaaccgggaccgtaacggtcgtttagttacgtttaactttacggtcggtaccggaacgggtaaacggggaccggggtaacccaagttacccgttaacttttaaccccgtacccggtttaacccttaacccggttcccgtaccgttaacgggtttacccggtaaccggggttccggggaacccgggggtaacccgggtaaccgggggaccccgttaaccgggg

SEQ ID NO: 204036 - DNA, 653 bp, Homo sapiens
  misc_feature: GYAE6OF02IIH3W.24.85.H08.1.454.CMB.1.raw
  modified_base (403)..(403): a, c, t, g, unknown or other
  misc_feature (403)..(403): n is a, c, g, or t
  modified_base (519)..(519): a, c, t, g, unknown or other
  misc_feature (519)..(519): n is a, c, g, or t
  modified_base (528)..(528): a, c, t, g, unknown or other
  misc_feature (528)..(528): n is a, c, g, or t
  modified_base (583)..(583): a, c, t, g, unknown or other
  misc_feature (583)..(583): n is a, c, g, or t
  modified_base (626)..(626): a, c, t, g, unknown or other
  misc_feature (626)..(626): n is a, c, g, or t
tcagactactatgtcacgaccggtgctcgatttagtatcactcagtcgcgggggagccccagccctgggattcccagctgtttctgcttgctgatcaggactgcacacagagaactcaccatggagtttggctgagcgttgggttttccttgttgtcttaagttttaaaaggtcgtcctagtgtaggaggtgcgagcgtggtggaggtccgggggagtcttaggttcgaggtccggtcgggggtcctgacgtactctacgtgtcgcgtacgtctcgtggtacttcgtaccttacaacttacttcgagtagtcgctacggtcggtcccgaccgaagtccgtacgggacgggaacgggtcttaggtacgtttcggtctacgtagttataactgtgagtggtaganctacactatcgtacggtcgaactcggagtacgccgtataccgacgtactacgtaccgaagaccgaaccgtaccgaacgaaaccgtaacacgtaacgtgtaaccgtagaaggtaacnccaacgtancgtaagacggaacggtcggaaacgtccgtaaggacttactacgtttaagttccgngtacccgaacgtacctaaagtcgtaccaacgcgtttaaccggnggactccgtaactacttaccgattacg

SEQ ID NO: 204037 - DNA, 751 bp, Homo sapiens
  misc_feature: GYAE6OF02H6V8F.24.85.H08.1.454.CMB.1.raw
  modified_base (647)..(647): a, c, t, g, unknown or other
  misc_feature (647)..(647): n is a, c, g, or t
tcagactactatgtcacgaccggtgctcgatttagtatcactcagtcgcgggggagccccagccctgggattcccagctgtttctgcttgctgatcaggactgcacacagagaactcacagtgaggtttggctgtagtcgttcgggtttttcctttgttcgtatttaagtttttaaaaggtcgttaccgtagttggtggaggttcgcgtagtcgttgggtgggtacggtccgggggacgtcttagttcgagtaccgggtcggggtacccgtggacgtacttccgtccgttggtcgcgtacgtccttgtcgggtacgtttccgttaccctttaactaaccttttaactttcggtggtacgttcgaccgttacggttccgggtcccgaccaacgtccgtaccggaggggtacggtcgttagttaggtttcgtcgtacgtaacgttattaaccgtagttacgtaggaggttaacacgtccgtacaactacgtagtcggtacgtactccgggtaagggtccgaccgttacgtacccgtacccttagttccgaacgtaacggaccaaccgtaaccgaccaaaacgtaaccacgttatacgttactcgtagaactacgtacgagaccgttacaccgtaaacgccggaccgaanaccgtcgcgttgtagttacgttagtcggacgacgggtacgggacggacctacggtattaaccggttacctacccgtaccttaccgaccgttaggtcgtaccggg

SEQ ID NO: 204038 - DNA, 692 bp, Homo sapiens
  misc_feature: GYAE6OF02JM4UP.24.85.H08.1.454.CMB.1.raw
  modified_base (232)..(232): a, c, t, g, unknown or other
  misc_feature (232)..(232): n is a, c, g, or t
  modified_base (492)..(492): a, c, t, g, unknown or other
  misc_feature (492)..(492): n is a, c, g, or t
  modified_base (526)..(526): a, c, t, g, unknown or other
  misc_feature (526)..(526): n is a, c, g, or t
tcagactactatgtcacgaccggtgctcgatttagtatcactcagtcgcgggaggacgctgaccacacggtacgtgctgttgtactgctcctcccgcggtctttgtcttggcattatgcacctccacgccgtccacgtaccagttagaacttgacctcgagggttcttcggtggctcacgtccaccaccacgctatgacgacctcgacggtcctgacgactctcgtctgacncgcctgtgtactccgtcctactaatacttcgagatcgacgtcgtcggtccgaccgacgtcgtacggacggggaaggtctacggttgttacggtccacttagtacgttaatgaaactttgggatgcgtacacgctaagcgtacgcgtcgacgtaaccggtcgaacggtcccacgttaccgtaccaacgtcgaactacccggaagtacccaaacgaacccaaagtacctaacgtacgtacctagtaccgtaacgtacgtaanacgtacggactaaggaaccgtccgaaacggaccnccggtaacgtaagttcgtacgtttagacgttacgtacgtaacgggtacgggacgaacgggacgttacgtacctaccgttaaacgttccccggaaatttcccggtcccggtattttacccggggcggtaaccttccggggaaccggtaccggtaccgggtaacccgg

SEQ ID NO: 204039 - DNA, 786 bp, Homo sapiens
  misc_feature: GYAE6OF02JQ9Q6.24.85.H08.1.454.CMB.1.raw
tcagactactatgtcacgaccggtgctcgatttagtatcactcagtcgcgggaggacgctgaccacactgtacgtgctgttgtactgctcctcccgcggctttgtcttggcattatgcacctccacgcccgtccacgtaccagttgaacttgacctcaggtcttcgtggctcacgtccaccaccacgcatgtacgacctcgacggggtccctgagacctcctcctgtcgcacgtcctcgtggtacttccgtccttactaaactaacctttcgtaggagtcgccgtaccgttcggggtaccccaccgaacgcccgtaccgggaagggggtaacggggtccgttagggttacggttttcggggtaccttaccgtaacgttaacgttttaacagtttacggtagttaaggggtagttacgcctacgtaaactacgttacggtcgtaccgggtaccgtccgggtagggaaccgggttaccctaacttacccgaaccgtacttccctaaccgaacggtaaccgaaccgaaccggaacctaaacgaaaccgaacctacgtactacttacgtacgtaacgtaatacggacaccgtaccgtacgtaacggaccgaccgaccgaccggtaacgtacgtagttacgtttaacgtacggtttacgaacggtacgggaaccggtacggggaccctaggtaaccttaccgtaacccgttaccctaaccgtaaccccgttcgtaacccgttaggtacccggttacggtccgggtacggggtaccggaaccgggtacccgg

SEQ ID NO: 204040 - DNA, 712 bp, Homo sapiens
  misc_feature: GYAE6OF02H679A.24.85.H08.1.454.CMB.1.raw
  modified_base (311)..(311): a, c, t, g, unknown or other
  misc_feature (311)..(311): n is a, c, g, or t
  modified_base (565)..(565): a, c, t, g, unknown or other
  misc_feature (565)..(565): n is a, c, g, or t
  modified_base (574)..(574): a, c, t, g, unknown or other
  misc_feature (574)..(574): n is a, c, g, or t
tcagactactatgtcacgaccggtgctcgatttagtatcactcagtcggcgggggagcccagccctgggattcccagctgtttctgcttgctgatcaggactgcacacagagaactcacatggtagtttgggctgagtcgttgggtttttccttgttgcttaatttttaaaaggtcgttaccagttgtggaggtgtcagtcgtggtacggaggtccggggaggtacttagtcacgccgtgggggtccctgacgactctcgtgtcgctacgccttcgaggtcttcgtcctttacaacttaacgttcgtaggntacgtcgtacggttcggtaccgacctaagtccctaccggaaggggtaacggggtcttaggtacggttttcggaccttacgtaacggtttaactaacgttagttaggacggtagggtacgttacgccttacgtactaacgttagtcggtaaccggtacttaccgggtaggaccgggtactaacttaccgtaccctagttcccacgaacggtacgaaccaacgtaccgaaagtaaccctagtactacgttatcganaactacgtnaacgtacaacggtctaaggacgacgtacgactaggtctaggtacttcgttataggaccgaggtaaccgggacgggaccttaggtacctaacgtttacccgtaccgtaccttaccgtacgtaccggttaatcccggggg

SEQ ID NO: 204041 - DNA, 761 bp, Homo sapiens
  misc_feature: GYAE6OF02ITBQ6.24.85.H08.1.454.CMB.1.raw
  modified_base (529)..(529): a, c, t, g, unknown or other
  misc_feature (529)..(529): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtcgacctcgacggggtccctggagtaccttcgtcctggtcgcacgccttcgtggtaccttccgtccttacaattaccgttcgtagatcgctacgtacggggtccaccgaacgtcctaccggaggggacgggtccttaggtcgttttacggggtcctactaacggtttaacttaaacgtagtttacggagggttggggtaacgtacgtaccgttaccaacgttactaggtacggccggttaccgtcggtaacggaccggggtacctttactaccgaccgtattcccgacgtaacggacgaaccaacgaccaaacgaaaccacgtacgttgtaactgtanaacgtaagtcgaagcctaggtaccgtagaaccgtaccggacgaaccgaggttccgttagttacgttaccgtacgtggtaccgtacggtaaggggaccggtacctacgaccgttttaacgttacccgttaaccgttaccccgttaacttccccgggtaaccgttaaggtccgggttaacccgggttacgggtaaccccgggggtaacggaaccggggttaccccgtaccgggg

SEQ ID NO: 204042 - DNA, 749 bp, Homo sapiens
  misc_feature: GYAE6OF02I9WUA.24.85.H08.1.454.CMB.1.raw
  modified_base (272)..(272): a, c, t, g, unknown or other
  misc_feature (272)..(272): n is a, c, g, or t
tcagactactatgtcacgaccggtgctcgatttagtatcactcagtcgcgggggagccccagccctgggattcccagctgtttctgcttgctgatcaggactgcacacagagaactcaccatggagtttgggctgagcttgggtttttccttgttgtcttaattttaaaaggtgtccagtgtgaggtgcagcgtggtgggaggtccgggggaggtcgtttagttcgaggcccggttggggggtccctggacgtacctccttccgtggtcgcncgtcctcgtggtacttccgtccttacaaacttacttcgtggatcgctacgtcgggtacccaccgaagccgtaccggagggggaagggtccgttaggtacgttttcggggtacctacgtaacgttaacttaacgtagtttggaaggtgggtagtacgtaccgtacaacgtacttaggtcggacggtaccgttaccggtagggaaccgggtacctaacttcccgaacgtacctcctaccggaagaaccgtaaaccgaaccgtaccgaaagaaaaccctacgtacgtagttacttacgacaacgtaaagtcgaacgtcgaactaccgtaaggaaacccggacccgtaacggaccgtacggtagttacgttagttaacttcggttagacggtaacggaacggggcggggtacctaacggtaccttaaccgttacccgttacccgttaacgtaccccggtcgttaaccgtgggttacccggg

SEQ ID NO: 204043 - DNA, 585 bp, Homo sapiens
  misc_feature: GYAE6OF02INZG5.24.85.H08.1.454.CMB.1.raw
tcagactactatgtcacgaccggtgctcgatttagtatcactcagtcggcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagacctctcctgtgcagcctctggacttcgccttacaataacttctaggatgcactgggtccacaagcctccgagggagggctgatttgggctcacgttataacatttgactgggagtagctcacactatcggcggtactcgtagaacggcctattcacatcaccagacgacaacgaccagaaacacactgtactcgtagacaaagtgaacgtcaaggccctaagaaacgccgaacgaccgacggcttagttcgtaattacgtagtcgaacggaaacgggacggggtaccaagtcgtaacttaccgtacctaaccttccgtaccgacttaacggtcggacgttccggacggggtaacctacggggacctaacggg

SEQ ID NO: 204044 - DNA, 768 bp, Homo sapiens
  misc_feature: GYAE6OF02F85MG.24.85.H08.1.454.CMB.1.raw
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttcgacctcagggtcttcggtggctcacgtccaccaccacgcatgtgacctcgagggtccctgagactctcctgtgcacgtcctctggattccgccttacaaattaaccttcgtggattcgacctacggttccgggtacccgaccgaacggcctaccggagggggaacggggtcttaggtacgttttcggggtctaccgtaacgttaacttaacgtagtttcggaaggttgggtaacggttacgaccttaccgaactaccgttacggtcggaaccggtccgttacccggtacgggaacggggtacctacgtttaccaaaccgtacgttacctaccggtaacggaacggtaaccccaaaccggtacccgaaagaaaaaccccgcttaaaccgttacggttaaccgttacgttaaccggaacttaaaacggtggaacgaccgtaaggtacccgtaacggaaccggtcccgaacgtacgtaccggtcgtagttaccgttacttacgtaggtacgtaaacggacggtaacggggcaacggtaccttaacgttctaacccttaacgtccgtaccgtatacggtacggtccgtacgggacgggaccggaacgggtacgtacccggg

SEQ ID NO: 204045 - DNA, 870 bp, Homo sapiens
  misc_feature: GYAE6OF02JNS5Q.24.85.H08.1.454.CMB.1.raw
  modified_base (147)..(147): a, c, t, g, unknown or other
  misc_feature (147)..(147): n is a, c, g, or t
  modified_base (160)..(160): a, c, t, g, unknown or other
  misc_feature (160)..(160): n is a, c, g, or t
  modified_base (178)..(178): a, c, t, g, unknown or other
  misc_feature (178)..(178): n is a, c, g, or t
  modified_base (655)..(655): a, c, t, g, unknown or other
  misc_feature (655)..(655): n is a, c, g, or t
tcagactactatgtcacgaccggtgctcgatttagtatcactcagtcgcgggggagcccagccctgggattcccagctgtttctgcttgctgatcaggactgcacacagagaactcaccatggagttggctgagctggtttctgttnctatttaaaggtntccagtgtgaggtgcagngtggtggaggtccggggagtcttagtcgacggtccgtcgggggtccctaggacgtacctcgtcgtgtcgtcacggtcctagtcggtactttccgcccgtttacaaacgttaaccgtttcggtacgggtactttcggaccgtaacccggtttcgggtccccggaacctaaacgggtcccgttaccggaacgggggtaacggggtccttacgggttacgttttcggggtacctaccggttaaacgggtttaactttaacggacgtttcggggaaacgttccgggggtaacgttaacggtcccttaaccggaacccggttacttaaacggttcgggtaccccggttaaacgttacccgggttaacgggaaaccggggttaccctaaccggtttaccccaaaccggttaccttaccccgggttaaaccgaacgggttaaaccaaccccggttaaccgaacccggaaaccggttaaaacccnccgtaaccgtttagttaccgtaacgtcgtaaaccgaaagtccggtaacgacggtacgtaaccgtaggaaaacccgcccggggaacaccggtacccgtgttaacgtagttaaccgtttcagggtttaccgacgggtaaacgggcgggttacccacgttaaccttacccgtacgttaccccttacggaaccccggtttcggacttaccggtacgggg

SEQ ID NO: 204046 - DNA, 755 bp, Homo sapiens
  misc_feature: GYAE6OF02JL5SQ.24.85.H08.1.454.CMB.1.raw
  modified_base (229)..(229): a, c, t, g, unknown or other
  misc_feature (229)..(229): n is a, c, g, or t
  modified_base (568)..(568): a, c, t, g, unknown or other
  misc_feature (568)..(568): n is a, c, g, or t
tcagactactatgtcacgaccggtgctcgatttagtatcactcagtcgcgggggagccccagccctgggattcccagctgtttctgcttgctgatcaggactgcacacagagaactcaccatggagtttggctgagctggtttccttgttgctatttaaaggtgtcagtgtgaggtgcagctggtggacggtccggggaggtcttagttcagtccgtgggggtccctgngactccgtacgtcgtgcagtcctcgtggtcttaccgccctttactaaacgttaaccttcgtacggtactcgtaccgtaccggttcggggtaccccgtaccaaacggtcccgtaccggaggggaaacggggtcttagtacggttttcggggtaccttaccgtaacggttaacttaacgtagttaccggtaaggtcgggtaacgtagtccgtaacctaacgtacctacgtacggaccgggtaccttacccgggtaggtaaccggggtcctacgttacccgaccgtacgttccctacgaacggaccgtaaaccccggtaaccgacccgaaacggtaaacccnttacccgtaacgttaacctcgtaacgttacaaaggttccgagtaccgagtaccgtaacgaccgacccggtacaaaccgccggttatagtacgttacttccggtagtacggacgtaacgggggaccgtcggtaacaccgtttattaaccccgtaccttaccgtaccggcccgttaggtaccttacggg

SEQ ID NO: 204047 - DNA, 722 bp, Homo sapiens
  misc_feature: GYAE6OF02GMTKS.24.85.H08.1.454.CMB.1.raw
  modified_base (539)..(539): a, c, t, g, unknown or other
  misc_feature (539)..(539): n is a, c, g, or t
tcagactactatgtcacgaccggtgctcgatttagtatcactcagtcgcgggaggacgctgaccacacggtacgtgctgttgtactgctccctcccgcggctttgtcttggcatttatgcacctccacgccgtccacgtaccagttagaacttgacctcgagggtcttcgtggctcacgtccaccaccacgcatgtcacctcgacggggtccctggagaccttcctcctgtcgccacgccctgtggtacttccgaccctttataaacttaaccttcgtaggatcggcctacggttccgggacccaccaaggtcccgtacgggaagggggacgggtcttaggtaggttttcgggaccttaccgtaacgtttaagtaaaccgttaggttacggtaaggttagggtaagttaacgtccgtaacctaaccgtataggtccgtaccggtacgttccggaaggaaccgggtcctataccgactacgtcctacgacgaacacgaaccgaccaaacgaaaccactacgtattaaccgtcgaacgaanaagcgacgactcgaccgtaagacccgacgaacctaggacgttgtgtacggttaacttacggtgacggtaacgcgggggtaaccgccttaagtccttaccttacccgtacacccggttctacccggtagttacgtccggggtacgttacgggtacccggggaacggttaaccggcccggtaacg

SEQ ID NO: 204048 - DNA, 797 bp, Homo sapiens
  misc_feature: GYAE6OF02JMJFA.24.85.H08.1.454.CMB.1.raw
  modified_base (634)..(634): a, c, t, g, unknown or other
  misc_feature (634)..(634): n is a, c, g, or t
tcagactactatgtcacgaccggtgctcgatttagtatcactcagtcgcgggggagccccagccctgggattcccagctgtttctgcttgctgatcaggactgcacacagagaactcaccatgggagtttgggctgagcgttgggttttccgttgttgtcttaagttttaaaggtagttccaggtgtgaggtgcgagtcgtgggtggaggtccgggggagtcttaggttcgaggtccggtgggggtccctgacgtacgtctccgtgtagcacgtcctcgtggtacttccgtccttactaacttaacttcgtaggagtcgtcgaccggtcggtaccgtaccgaacgtccggtaccggaaggggaacgggtcgttaggtaggtttcggtaccgtacgtaacggttaacttaaacgtgtttaagggagtaagggtaagtacgtacgtacgtaactacgtagtaccggtacgtaaccgtccggtaaggtaacggtaccgtactaccaccgtaccgtacgtacccgtaagaaccgtaaccgaaccgaccgtaaaacgaacgtacgtaaccgtacgtacgttaaccggtacaacgttaaagcgtaacgaccgaaccggtaacgttaaaccggaacccggnggaaacccgttacggacggttccttaaggtacttaaagttccggttagggtaaccggaacggtaacgggggtacgggtaacccctaaggttacccggttaaacctttcccgtaaccccgttaaccgttccgtaacccggttccggttaagttaaccccggggg

SEQ ID NO: 204049 - DNA, 728 bp, Homo sapiens
  misc_feature: GYAE6OF02GKJID.24.85.H08.1.454.CMB.1.raw
  modified_base (140)..(140): a, c, t, g, unknown or other
  misc_feature (140)..(140): n is a, c, g, or t
  modified_base (184)..(184): a, c, t, g, unknown or other
  misc_feature (184)..(184): n is a, c, g, or t
  modified_base (238)..(238): a, c, t, g, unknown or other
  misc_feature (238)..(238): n is a, c, g, or t
tcagactactatgtcacgaccggtgctcgatttagtatcactcagtccgggggaggcttagttcagcctggggggtccctgagactctcctgtgcagcctctggattcgccttcaataacttctggatgcactgggtccnccaagctccgagggaagggctgatttgggtctcacgtattaacnttgagtgggatagctcacactatggcgactccggtagaacgggccattcaaccntcctcagacacaaccgcagaaacacactgtatctgactaaatgacgcagcctaggaacgccgacgacgacggctgtgtattactgtcgacgaggacggggccagctattacctcctaactactccgactacgtcgtacgtcgtacgggaccgaacgggtaccgtaacgggtcctaacccggtccttacccgtacgaaccgtcccctaccccgaaccgaaaccgggtacccctaacgtttcccggttacccctttaccccccggtcggtaccccttaaccccccgttcccgtaacccgaaaccggtaccgtaccccgtacccgtaccggggttcccgggggtaaccaacccgggtaccgggccccggggtacccggtcgggtaccgtccggttcccggtacggtaaccgaacgggtccccttaaccttacccgaacgttacgttacggttacgttaccggtcggtacgggtcccgggtagtaccggaccgg

SEQ ID NO: 204050 - DNA, 598 bp, Homo sapiens
  misc_feature: GYAE6OF02HHDBI.24.85.H08.1.454.CMB.1.raw
  modified_base (373)..(373): a, c, t, g, unknown or other
  misc_feature (373)..(373): n is a, c, g, or t
  modified_base (426)..(426): a, c, t, g, unknown or other
  misc_feature (426)..(426): n is a, c, g, or t
  modified_base (434)..(434): a, c, t, g, unknown or other
  misc_feature (434)..(434): n is a, c, g, or t
  modified_base (439)..(439): a, c, t, g, unknown or other
  misc_feature (439)..(439): n is a, c, g, or t
  modified_base (444)..(444): a, c, t, g, unknown or other
  misc_feature (444)..(444): n is a, c, g, or t
  modified_base (452)..(452): a, c, t, g, unknown or other
  misc_feature (452)..(452): n is a, c, g, or t
  modified_base (457)..(457): a, c, t, g, unknown or other
  misc_feature (457)..(457): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtcgacctcgaggggtccctgagacctctcctgtgcagcctctggacttccgcctttacaaattacttctaggatcgctacgtcgggtccaccaagctaccggaggggaagggctaggtacgttttcgggtctacgaagttaattaaccgagtttcgaagttcggggatacgctacactagtntcggacgtctcggagaagggtcattcgaccatcctacagacaacacgtacaanaacactancgtancgtanacaatgancgacnctagaacgcgtaccgagcgtactgtactatctaggctaacgggagggccggtaacacggtactaactttccgaacccttacgaccttccgtacgttagaccggtacggtccggtacggggaccgtaaccggcgtaaccggg

SEQ ID NO: 204051 - DNA, 822 bp, Homo sapiens
  misc_feature: GYAE6OF02G9PCN.24.85.H08.1.454.CMB.1.raw
tcagactactatgtcacgaccggtgctcgatttagtatcactcagtcgcgggaggacgctgaccacacggtacgtgctcgttgtactgctcctcccgcggctttgtcttggcattatgcacctccacgccgtccacgtaccagttgaacttgacctcgagggtcttcgtggctcacgtccaccaccacgcatgtgacctcgaggggtccctgagacctctcctagtgcagcctgtggtacttcgccttacaaacttacttcgtggaatcgactacgtcggggttcccgaccaacgtccgttacccggaagggggtaacggggtccttaggtacgtttttcgggaccgttacgaaccggtttaagttaaacgtagtttcggaacgttgggggtaagttacgccttaccgaactaacgttaaggcggtaccggtaccgttaccgggtaggaaaccgggggtccttaacgttacccgaaaccgtattaccccgtaccgaaacggtaaccgaaaacccgtaacccgaccaaaacggaaacctaacgtaaccgttaggtaactcgtagaactaaagtcgacgacctacgaccttaaggaaaccgcccgtaaacgaccggtaacgtcgttaggttacgtagttacggtaggtacgaacggaaacggggtccggggacctaacggtacctttaaccgtttaacccgtttccccgtaaaccgtttacccggttaccccgttaaggtttacccggtacggggtttaccccggttaccggggtaacccggggggtaaacccccggtaaagggggtacccccgttaacggggg

SEQ ID NO: 204052 - DNA, 585 bp, Homo sapiens
  misc_feature: GYAE6OF02IP0BT.24.85.H08.1.454.CMB.1.raw
  modified_base (460)..(460): a, c, t, g, unknown or other
  misc_feature (460)..(460): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtgctcacgtccaccacacgcatgtgacctcgaggggtccctgacgactctcctgtgcagcctctggattcgccttcaatacttctgatgcactcgggtccgccaagctccgaggggaagggctggtatttggggtcctcgtacgttattaacgtatttaggagtggggatacgctcactactagtgcggtacctccggtaggaacgggccgtatcacctatcaccagacgacaacgccaagaacactactgtatctagactaaagtgacgacacgcagaacgccgacacgcgtntgtacgtattcgtgtcgaggaacggacgggactagactagttaccctaacgttaccgttaccgtccggttacttacgtcgggtacttccgggacgggggtaaccaaccggggtaccgtaccgggg

SEQ ID NO: 204053 - DNA, 761 bp, Homo sapiens
  misc_feature: GYAE6OF02IBPHC.24.85.H08.1.454.CMB.1.raw
tcagactactatgtcacgaccggtgctcgatttagtatcactcagtcgcgggaggacgctgaccacacggtacgtgctgttgtactgctcctcccgcggctttgtcttggcattatgcaccctccacgccgtccacgtaccagttgaacttgacctcagggtcttcgtggctcacgtccaccaccacgcatgtgacctcgacggggttccctggacgaccttccgttcctggtcgccacgtcctcgtggactttccgcctttactaaacgttaaccttcgtgggtacttcggccaccggttcggggtccccgaccgaacggtccgtaccggaaagggggacgggggtccttaggttaggtttttacgggggtcccttacgtaaccggtttaactttaaacgtgtttacggagttagggggacgtttaacggaccttcaacgtaactcgtcggtaccggtaccgttccggtagggaaaccgggtcctatttccgaaccgtactccgtacgaaggtaccaacctaaccggaccaaacgaaacctaccgtacgttacgattacgagtaacaaagtcgaagcgacgttaccgaaggaaacccggccgaacggtaacgacggtacgttaggttagttacgttaacgtggtaacgacgggaaacggggtacgggaccaggtacctaactttacccgtcttaccgttaccgccggtactacgggtcggtaccggtcgggttaccggaccggtaacgggaccggtacgg

SEQ ID NO: 204054 - DNA, 721 bp, Homo sapiens
  misc_feature: GYAE6OF02I510A.24.85.H08.1.454.CMB.1.raw
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcgaggggtccctgagactctcctgtgcagcctctggattccgccttcaataacttctggatgcacgtcgggtccaccaagcctccgaggggaagggctggtatttgggtctcgacgtattaacattgatgggagtagctacactactagtcggaccgtactccggtaggaacgggtcctaacttccgacctattccctaccgaacggaacgtaacccgaacgacccgtaaagaaaacccacctaacgttagtaactaccgtagaacgtaaaatcggaacgccaacggtacccgttaaggaaaccgcccggaaaccgtaaccgccgggtacgttacggttacgtttaactttccgttagtaccggacggtaaacggggacgggggaccacgggtaccttaaccgtttacccgttaaccccgttaaccttaacccggttcccgtacgtttaacggtaccgggttaccccgggttagggtacccggggggtaaccccgtaaacggggggtccccgttaacccggggg

SEQ ID NO: 204055 - DNA, 651 bp, Homo sapiens
  misc_feature: GYAE6OF02JZ97K.24.85.H08.1.454.CMB.1.raw
  modified_base (182)..(182): a, c, t, g, unknown or other
  misc_feature (182)..(182): n is a, c, g, or t
  modified_base (363)..(363): a, c, t, g, unknown or other
  misc_feature (363)..(363): n is a, c, g, or t
  modified_base (376)..(376): a, c, t, g, unknown or other
  misc_feature (376)..(376): n is a, c, g, or t
  modified_base (454)..(454): a, c, t, g, unknown or other
  misc_feature (454)..(454): n is a, c, g, or t
  modified_base (515)..(515): a, c, t, g, unknown or other
  misc_feature (515)..(515): n is a, c, g, or t
  modified_base (575)..(575): a, c, t, g, unknown or other
  misc_feature (575)..(575): n is a, c, g, or t
  modified_base (583)..(583): a, c, t, g, unknown or other
  misc_feature (583)..(583): n is a, c, g, or t
  modified_base (641)..(641): a, c, t, g, unknown or other
  misc_feature (641)..(641): n is a, c, g, or t
tcagactactatgtcacgaccggtgctcgatttagtatcactcagtcggcgggggagccccagccctgggattcccagctgtttctgcttgctgatcaggactcgcacacagacgaactcaccagtggtaggtttgggctgagtcgttgggtttttccttgttgcttaagttttaaaaggtnttccaggtgttgaggtgcagctggtggagtccgggggagtcgttagttcgacggtcggtcgggggtccctggacgtctccttcctgtcgcgacgcctgtggtacttccggtcccttataacttaacttcgagggtctcgccctaggtcggtccggaccacgtccgacggacggggtaaggntcgtagtttcggntacgtgtacttaagtgttagaggttcggagtcgtccgtacactaatgtaggtaccgtacgtacgtacggaggtacctntacgccctatctacgagaacgacgaacgacgaaactaaccgtactaacgtaggtaccttanagaagaacgttgacggactcgaagaaccggagaacccgtaacgcgtaccgtaactaggtnttaacgtnaggtacgcggaagggacgtcgaccgttagtaccttacgtcctaccgtctaccgttagnggtaccccgg

SEQ ID NO: 204056 - DNA, 939 bp, Homo sapiens
  misc_feature: GYAE6OF02HZWOG.24.85.H08.1.454.CMB.1.raw
  modified_base (276)..(276): a, c, t, g, unknown or other
  misc_feature (276)..(276): n is a, c, g, or t
tcagactactatgtcacgaccggtgctcgatttagtatcactcagtcgcgggggagccccagccctgggattcccagctgtttctgcttgctgatcaggactgcacacagagaactcaccatggagtttggctgagcgttgggtttttccttgtttgtcttaagtttttaaaaggtcgtaccaggttgtggtaggtgcagcgtgggtggacgggtccgggggaggtcgtttagtcgacgtccgggtgggggtccctagacgtactctcgtgtgacncgcctgtcggtacttccgtaccttactaaacttaacgttcgtagagtcgtccgtaccggttccgggtacccaaccgtaacgtacccgtaccggaacggggggtaacggggtccgtaggtttcggttttacggtaccttaaccgtaacggttttaaactttaaacgttgtttaaggagggttaaggggtaacgttaccggaccgtttaaccaaacccgtaaggtttaacgggtacgggtaccccgggttaaaccggtttcccgggggaacgggtaaaccgggggtaccccgttaaccgtttacccgtaaaacccgtcctttaacccgttaaccgaaaacgggtaacccggaaaacccggaaacccggtaaacccgtaaaaaccggaaaaccctaaccggttaaccttaacggttaacccttaacgttaacgtaacgtaaaacgtacggaaacgggctaacggtaacccgttaaaggaaccccgggtaaccgaaccgggtaacccggtacggtacgtttacggtaacggttttaaccgttacggttcgggtaaccgggtacgggaaacggggtaccgggggtacctaaaccggttaaccgttaaccgtttacccttaacccggttaaccctttacccggtaccgttaccggtacgttacccgggg

SEQ ID NO: 204057 - DNA, 786 bp, Homo sapiens
  misc_feature: GYAE6OF02HZUE5.24.85.H08.1.454.CMB.1.raw
  modified_base (175)..(175): a, c, t, g, unknown or other
  misc_feature (175)..(175): n is a, c, g, or t
tcagactactatgtcacgaccggtgctcgatttagtatcactcagtcgcgggggagccccagccctgggattcccagctgtttctgcttgctgatcaggactgcacacagagaactcaccatggagtttgggctgagtcgttgggttttccttgttgcttaatttttaaaaggtntccagtgtgagtgcagctggtggaggtccggggagtcttagttcgacgccgtggggggtccctgagtactctcctgtgcacgcctcgtggtacttcgccttactaaattaaccttcgtagatcgctacgttcgggacccgtaccgaagtccgtaccgaagggggtaacggggtcttaggttagttttcgggtaccttaccgtaacgttactttaaaccgttagtttggaaagttgggaagttacggtacctacgtaacctacttacgtacgcccgggtaacgttccggtaacgggaacgggtacccgttacttacccgaaccgtaacctttcccgtaacgaaggtaaccgaaacccggtaaccgacccgaaaacgaaacctacgtaccttagtaacgttctaagtaacaacgtagaaccgcaaccgtacgaacgaaccggcccgaacggtaaccgcggttaacgtcggttaacgtttagttaccgtaaggttccggaaagggggtaaccggggcggggtaaaccctaggttaaacccctttaggtttaacccccttaaccgtttaaaccccgttaacccggtacctttaccggtaacgggtttaccccggg

SEQ ID NO: 204058 - DNA, 698 bp, Homo sapiens
  misc_feature: GYAE6OF02ILV9R.24.85.H08.1.454.CMB.1.raw
  modified_base (273)..(273): a, c, t, g, unknown or other
  misc_feature (273)..(273): n is a, c, g, or t
tcagactactatgtcacgaccggtgctcgatttagtatcactcagtcgcgggggagccccagccctgggattcccagctgtttctgcttgctgatcaggactgcacacagagaactcaccatggagtttgggctgagctggttttccttgttgcttattttaaaaggtgtccagtgtgaggtgcagctgggtggaggtccgggggaggcttagttcagccgtgggggtccctgacgactctcctgtgcagcctcgtggtattccgccctttanaataaccttctggatgctacgtgggtccgcccaaagccgtaccgaaggggaacggggtctggtacgttttggggtcctacgaacgttaattaacctaatttgagttagggagtacgacgtacacgtaacttagtacggcggaaccgttccggtaggaaacggggcctaacgttaccaaccctacttaccgtaccgtaacgaacggtaaccgaaaccgaccgaaagaaaacccactaaacgttagtaacctacgtagaactaaaagtcgaacgacgacgtccgtaaggaaccgtacccgaacgaacgacgtacgtagtacgttacgttactggtagaaccgtaaggggaacgggggctaacgggtaccttaaccgtttaccttacccgttaacgtacccgttaacccgtaccgttaagtaccgggg

SEQ ID NO: 204059 - DNA, 574 bp, Homo sapiens
  misc_feature: GYAE6OF02JA580.24.85.H08.1.454.CMB.1.raw
  modified_base (266)..(266): a, c, t, g, unknown or other
  misc_feature (266)..(266): n is a, c, g, or t
  modified_base (274)..(274): a, c, t, g, unknown or other
  misc_feature (274)..(274): n is a, c, g, or t
  modified_base (278)..(278): a, c, t, g, unknown or other
  misc_feature (278)..(278): n is a, c, g, or t
tcagactactatgtcacgaccggtgctcgatttagtatcactcagtcgcgggggagccccagccctgggattcccagctgtttctgcttgctgatcaggactgcacacagagaactcaccatggagtttgggctgagctgggttttccttgttgctattttaaaaggtgtccagtgtgaggtgcagctggtggaggtccgggggaggcttagttcagccgtggggggtccctgagactctcctgtgcagcctgtggattcgccttnaatacttntggntcgcacgtgggccgcaagcctaccgaggggagggctggtagtttggtctcgacgtattaacagttgagtgggagtagctacacactagtcgacggactcggtaggaacgggtcgacttccactactctaccgagacgaaccgacgaccgaaacaaacacaaccgtatactgtacgactaaagtgagacaacgcgtagaacgaccgaccgaacgacggtactgtacgtaattacgtggtagacggaagggtacggggcagctagttacctacctacgtaccgcgtacgttagtacgg

SEQ ID NO: 204060 - DNA, 853 bp, Homo sapiens
  misc_feature: GYAE6OF02F8LJV.24.85.H08.1.454.CMB.1.raw
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcgagggtccctgagactctctgtgcagcctctggattcgccttcaactaacttctggatgactacgtcgggtaccgccaaagtccccgttaccgaaggggggaacgggggtccttagggtaacgtttttcgggggtaccttaccgtaaccgggtttaaacttttaaaacccgaggtttttaggaaggttttcggggggaaacgtttaacgtaccccgttacctaaaccggtaactttacggttacggggtacccggttaaacccgtttccccgggttaaaggggtaaaccggggggacccctttaaacgtttacccaaacccccggtaactttaaccccgtttaacccccggaaagggtaaacccggaaaaccccgtaaacccgtaccccgaaaacggaaaaacccgtaaaccgtaaacccgttaagtttaaacgttaccgtaccggtaacgtaaaacgttacgtaaacgaccgtaaccgtaaccgttaacgaaacggtcccgaacgtaccgaccgtacgtacgtagttacttacttaggtacgacggtaaggaccggggactacggacttacgtaaccgttaaccgttaacttaccgtaccgtacgttacgtacggtaccgttccggacgggtacggtaaccggacggtaccggg

SEQ ID NO: 204061 - DNA, 836 bp, Homo sapiens
  misc_feature: GYAE6OF02HA723.24.85.H08.1.454.CMB.1.raw
  modified_base (330)..(330): a, c, t, g, unknown or other
  misc_feature (330)..(330): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgtacctcgaggggtccctgagactctcctgtgcagcctctggtacttcgccttacaaataacttctggatgcacgtgggtaccgcaagcctccgaggggaagggctggtacgtttgggtcctcgtacgttaattaacntttgacgttggggtactacgctaccgaactacgtacgtcggaccggtaccgtaccgttagggaaaccgggtccgtaactttaccaaccgtaacgttcccgttacccgaaacggtaaccgaaaccgaaacccggtaaccccgaaaaggaaaaccctaccgaaaccgttttacgggttaaccttccggtaaacggaaaccttaaaacgttacgggaaccgtaccggttaaccggtacccgttaaacgggaaaaccggcccccgggaaagttaaccccggaaccgggttctttacgggtttaacgtttacgtttaaaccgttgggttaaccggaaaccggaaaggggtacccgggggtaccaacggttacccgtaaacctttttaccccgtaaccccgttttacctacccggtttaccccggtaacgtttaccgggttacggggttaaccccgtttccggggtaacccgggggtaacccgttaaacggggggcccccgtttaacggggg

SEQ ID NO: 204062 - DNA, 787 bp, Homo sapiens
  misc_feature: GYAE6OF02I8AAP.24.85.H08.1.454.CMB.1.raw
tcagactactatgtcacgaccggtgctcgatttagtatcactcagtcgcgggggagccccagccctgggattcccagctgtttctgcttgctgatcaggactgcacacagagaactcaccatggagtttgggctgagctgggttttccttgttgctattttaaaaggtgtccagtgtgaggtgcagctgggtgggaggtccgggggaggtcgttagttcagccggtcggggggtccctgacgactcctccgtgtgcacgtcctcgtggtacttccgcctttacaattaaccttcgtggtatgacctacggttcgggtcccgacctaacggccgtacccggaaggggtaacgggggtctgggtacgttttcggggtaccttcgtaacgttaactttaacgtagtttacggaagttggggtaagttacggaccgttacaaccgttactaacggtcgggaccgggtaccgtaccgggtaagggtaaaccggggtcccggtaacgtttacccaaccgtacgtttacccgaccgtaaacgggaaccgaaccgtaaacccgacccgtaaacggaaacctaccgtacgtaagttaccttacgttacgaaacttaaagtcggtaacgaccgtaacgtacggtaaccggaaacggtccccggaaacgtaccggtacggttacttacggttagttaactttaccggtaggtacggaacggtaacggggacgggtccacggtaacttaaccgtttcctaacccgttacgttacccgtccggtacgttaggtacccggg

SEQ ID NO: 204063 - DNA, 811 bp, Homo sapiens
  misc_feature: GYAE6OF02I426D.24.85.H08.1.454.CMB.1.raw
  modified_base (282)..(282): a, c, t, g, unknown or other
  misc_feature (282)..(282): n is a, c, g, or t
  modified_base (344)..(344): a, c, t, g, unknown or other
  misc_feature (344)..(344): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctcgtggtattccgccttacaaacttaacttcgtagggatgacacgtcgggtcccnccgaacgcctaccggaaggggaaggggctagttagtttgggtcctacgacgttaattaacgngttagagtggggagtagcctacaactactagtcggccggtaaccgttccggtagggaaccgggtacctagtttacccaaccgttaactccctaccgaacgggtaacggtaaacccgaaccggaccgtaaaacgaaaaccgtaacctaaccgttacggtaacttaaccgtaacggtaaactaaaggtacggtaaacggccgtaaaccgtaacccggtaaacgggaaaacccgggtacccgggaaacccggtaaccgggaaccggttacgttacgggtttatttaaaccgtttacgtacgggttacgggaacggaaacggggtacccgggggtaactaaccgggtaaccttaccggtttaaccctacccttaacccgtttaccccgtaccgtacgttaccgggttaccgggtacgggtttcccggggtaaccggggtaacccgggaacggggtacccggtaacccgggg

SEQ ID NO: 204064 - DNA, 846 bp, Homo sapiens
  misc_feature: GYAE6OF02GQ2O7.24.85.H08.1.454.CMB.1.raw
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcgagggtcttcgtggctcacgtccaccaccacgcatgtcgacctcgacggggtccctgacgtacctctccgttggtcgccgacgtccttccgtgggtactttccggtcccttacgtaaacgtttaacctttcgtaggtacttcggacctaccggttcggggtacccgaccaacggtccgttacccgggaagggggtaacggggtccttaggttacggttttcgggtccgttacgtaaccggtttaactttaaaaccgttgtttacggtacggttacggggtaacgttacgtaccttaccgtaacgtaaccgttagtccggtacccggtacgttaccggtaggggaaaccgggttcccgttaaacttcccggtaaacctacgttacccgtaaccggtaacgaaccggtaaacccgaaccgggacccaaaacgttaaacccaccgtaaccggttttacgtaaccgtttaccggaacgtaaacgtaaacggtcgggacgaccgtaaccggtccggtaaaacgaaccggcccgtaacgggaccgtaccgggtcttaacggtacttaacgtttcggacggttacgaacgggttacggacgggtctaggtccttaacgtaccttcctaccgttaccgacgttacgtaggtacccggttacgtccgggtaccgggaccgtaaccgggtcgtacccggg

SEQ ID NO: 204065 - DNA, 639 bp, Homo sapiens
  misc_feature: GYAE6OF02GR5IS.24.85.H08.1.454.CMB.1.raw
  modified_base (56)..(56): a, c, t, g, unknown or other
  misc_feature (56)..(56): n is a, c, g, or t
  modified_base (559)..(559): a, c, t, g, unknown or other
  misc_feature (559)..(559): n is a, c, g, or t
  modified_base (616)..(616): a, c, t, g, unknown or other
  misc_feature (616)..(616): n is a, c, g, or t
  modified_base (627)..(627): a, c, t, g, unknown or other
  misc_feature (627)..(627): n is a, c, g, or t
tcagactactatgtcacgaccggtgctcgatttagtatcactcagtcgcggggganccccagccctgggattcccagctgtttctgcttgctgatcaggactgcacacagagaactcaccatggagtttgggctgagctgggttttccttgttgctattttaaaacggtagtccagtgtgaggtgcagcgtggtgggacggtccgggggagggcttagttcgagccgtcggggggtcccgtgacggactcctcctgtgcagtcctctggattcgccttcaattaaccttctggatgactacgtgggtcccgacaagccctccggaagggaaggggcctggtacgtttggggtcctcacggttacttaactattgaagtggggatagcctacacattatcggacggtacctcggtaggaaccgggtcctacttaccgacctatacccgtaccgagaacgaacgaacccgaccgaaacgaaaccactaccgtagtacctacgtagtaacaaatggaccacgaccggtcctagaaacgcccgagaaccgccgggtctaggtnttaacttcgtggtacgacggagggaccgggccaagtctaacgttacctccgttaacncccttaccggnttaggtaccggg

SEQ ID NO: 204066 - DNA, 821 bp, Homo sapiens
  misc_feature: GYAE6OF02FU89H.24.85.H08.1.454.CMB.1.raw
  modified_base (623)..(623): a, c, t, g, unknown or other
  misc_feature (623)..(623): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccggtccacgtaccagttgaacttgacctcagggtcttcgtggctcacgtccaccaccacgcatgtcgacctcgaggggtccctgagactctcctgtgcagtctcgtgacttcgccttacaaacttaacttcgtggatcgcacgtcgggtcccacaacgccgttaccggagggggaacgggtctaggttagtttcggggtacctcgtaacggttattaaacgtgttaggtacgtgggggtaacgttacgtccttacgaaccttacgttaacggtcggaccggtaccgttaccgggtaagggtaccgggtaccgtacgtttacccgaacctacgtccctaaccggaaggtaccgtaacccggaaacccgaccgtaaaacggaaaacccacccgtaaacgtttacgtaacttaccgtaaggtaacctaaaacggtggaacctacggaaccggaaccgttaacgggaaaccgacccggtaacggtaaccgtaccgggtnttaccggttagttacctttacgggtacgttaccggaaggaaaccgggtaccggggaccctacggtaccgtttaacctaaccggtttccctaaccggtttacccttacccggtacgtttaacgggtaccggggtttacccgggttacgggtaaccccgggggttacccggggtaaaccggggtcccgttaacccggggg

SEQ ID NO: 204067 - DNA, 714 bp, Homo sapiens
  misc_feature: GYAE6OF02FOCQ1.24.85.H08.1.454.CMB.1.raw
  modified_base (228)..(228): a, c, t, g, unknown or other
  misc_feature (228)..(228): n is a, c, g, or t
  modified_base (268)..(268): a, c, t, g, unknown or other
  misc_feature (268)..(268): n is a, c, g, or t
  modified_base (368)..(368): a, c, t, g, unknown or other
  misc_feature (368)..(368): n is a, c, g, or t
tcagactactatgtcacgaccggtgctcgatttagtatcactcagtcgcgggaggacgctgaccacacggtacgtgctgttgtactgcctcctcccgcggctttgtcttggcattatgcacctccacgccgtccacgtaccagttgaacttgacctcgagggttcttcggtgctcaccgtccaccaccacgcagtgtcgacctggacgggtcctgagctctctgtgcncgtcctcgtaggtacttcgtccttacaaacgttacttcgngtatgacctaggtcggcccacgaagccgtacggaggggtacgggtctggttagttcggtcctacggtaacgttataagttagttaggaggtggacgtacncgtaccataactggcgaccggtacgtcggtaggcggtctactaccgacgtctacgacgaagaccaaccgagaccgaacaaacctctaacgttacgtacgtacgtacaacgtaagaccgaacgtacggaaccgttaccgaacgtaaccggacccgtaaacggaccgtacggttaccgtaggttacgttacggttaacgtgggtaaccggtaacggaacgggggtaccggtaaccgtacgttaccggttaacctaccccgttacgtaacccgttcccgtcggttaacgtcggtcgggtacccgggtacgggttacccggggaacgtacccggggtacggtacccccgg

SEQ ID NO: 204068 - DNA, 903 bp, Homo sapiens
  misc_feature: GYAE6OF02H8CNK.24.85.H08.1.454.CMB.1.raw
tcagactactatgtcacgaccggtgctcgatttagtatcactcagtcgcgggggagccccagccctgggattcccagctgtttctgcttgctgatcaggactgcacacagagaactcaccagtggtaggtttgggctgacgtcgttgggtttttccttgttagtacttaagtttttaaaaggtgtccaagttgtgaggtgcagctggtggaggtccgggggagtcgtttagttcgacggtccggttcgggggttccctaggacgtccttcgtccgttggtacgctacgtcctcgttggtacgttttccggtaccccttttaataaaacgtttaaacgttttccgtaggggtaacttccggtaccgtaacgggtccgggttacccgacccgtaaaggtccccggtaccggaaggggggtaacggggtaccttagggttacgttttcggggtccttaccgtaacgtttaaagttaaccttagtttaggtacggtagggacgttagcccgttagaccttaacgtaacgttcggaccggtaacgttcccgggtaaggtaaacgggtccctagtttaacccgaccttagttaccgtacccgaggtaaaccgtaccgtaaaccggaccctaaaggaaaccctacgaacgttttacgaacgttaccgtaaagtaaccgtaaagttacgaacggaaccaacgttaccgggaaagaaaccggtacccgggtacgaacccgtaggttaccggttaggtaaaccggttttacaacggtttgggaaccgttaaccggggaacgggtaaccgggggtaaccctacggttaaccctttaaacgtttaccctttaaccccggttaaacccgttttaaccccgttaacccgggtttacgttaaccggttaacccggggg

SEQ ID NO: 204069 - DNA, 842 bp, Homo sapiens
  misc_feature: GYAE6OF02HXA3U.24.85.H08.1.454.CMB.1.raw
  modified_base (267)..(267): a, c, t, g, unknown or other
  misc_feature (267)..(267): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgcagtccacgtaccagttgaacttgacctcgagggtcttcgtggctcacgtccaccacacgcatgtcgacctcgacggggtccctggagacttctcctggtcgcagcctcgtggtacttccgtccttacaattaacttcgnggatgctaccgtgggtcccgacaacgtccgtaccggaaggggacggggtctaggtgtttcgggtccttacgacggttaattaaacgtagttacggagtaggggacgtacgtctacgaacctacgttacggtacggccggtaaccgttccggtagggaacgggtacccgtacttacccgaactacgttcctacgaacggtacggaaccaaaccgggaccaaacgtaaaccaacctaacgttacgttactacgttaacggaaactaaacgaggtaaccgacgtacgtaacccggttaaggggaaaacccgaccgggaaaccgggaaaaccggttccggggttaaccgtttagggttttaaacgtttaacgttttacccgggtggttaaaccggggaacgggtaaacgggggaacccggggggtacctaacggttccgtaaaacggtttttaaccccctaaccgtttaaaccccggtttaaccctacccgggtttaagttaccggggttacggggtttaccccggttaccgggggtacccgggggggtaacccgggtaaaccggggtaaccccggggg

SEQ ID NO: 204070 - DNA, 769 bp, Homo sapiens
  misc_feature: GYAE6OF02IIJ4D.24.85.H08.1.454.CMB.1.raw
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcgaggggtccctgacgactctcctgtgcacgtcctctggtacttccgtccttacaaattaaccttcgtaggtatcgccacgtcgggtccccgaccaagtcctccggaggggaagggcctggtagtttcgggtctacgaacgttattaacgtagtttcgagtgggtagtacgctacgaactacttagcggtccggtacgtaccggtagggaaccggggtcctaacgttccaaccgtactccgtaaccgaggaacgaaccgaaaccgaccaaacggaaaccctactaacgttagtacttacgtaacgaaccaaagttcggacgacgtaaccggtacctaacgggaaacccgaccccgggtaaacgaacccggtacgggtcccgtttaagggttacgttaactttccggttaggtacggaacggaacggggaccggggacctaacgggtacgttaacctttacccgtaaccccgttaaccttaccccgtaccggttaccttaacgggttaccgggtacccgggtttcgggtacccggggggtaaccctaaacccgggggtccgtaaccccggggg

SEQ ID NO: 204071 - DNA, 714 bp, Homo sapiens
  misc_feature: GYAE6OF02HYP7N.24.85.H08.1.454.CMB.1.raw
tcagactactatgtcacgaccggtgctcgatttagtatcactcagtcgcgggggagccccagccctgggattcccagctgtttctgcttgctgatcaggactgcacacagagaactcaccatggagtttgggctgagctgggttttccttgttgctaattttaaaaggtgtccagtgtgaggtgacagctggtggaggtccgggggaggcttagttcagccgtgggggtccctgacgactctcctgtgcacgccttctggtattccgccttcaaaattaacttcgtaggattgaccgacgttcggggtcccgaccaacggccttacccggaagggggtaaacggggtcctagggttaagttttcggggaccttacgaacgttaacgtttaaactagtttacggaagttagggtaagtaacgtcctaccgaactaacttagtacggaccggtaacgtccggtaggaaacgggtcccgtaaatttacccgacccgtaacttccgtaacccgtaaggaaccgtaaccaaaccgaccaaagaaaacccacgtaacgtaggtaacttccgtacgaacgtaaagtacgacgacgaacgtaccgtaagaaccgaccgtaacgacgacggtctagttaagtacttacgtagtcgaacgtaagggacggggtacacgtacctaacttacctacctaaccgttaccgtccgtatacgtaccggg

SEQ ID NO: 204072 - DNA, 851 bp, Homo sapiens
  misc_feature: GYAE6OF02HT556.24.85.H08.1.454.CMB.1.raw
  modified_base (265)..(265): a, c, t, g, unknown or other
  misc_feature (265)..(265): n is a, c, g, or t
tcagactactatgtcacgaccggtgctcgatttagtatcactcagtcgcgggggagccccagccctgggattcccagctgtttctgcttgctgatcaggactgcacacagagaactcacagtggtagttgggctgagtcttgggttttccttgttgcttaagtttaaaaggtgtccagtgtgaggtgcagtcgtgggtggacggtccggggagtcttagttcgacggtccggtcgggggtcctggacgtactcgtcgtgtcgacncgtcctcgtggtactccgtaccttacgaaaattaccgttgtaggactacggtaccgtaaccggttcggggtaaccccgaccgtaacggtacccgttaccgggaaacgggggtaacggggtccttagggttacgttttcgggtaccttacggtaacgtttaaacgttaacgtagttaggaacggtagggttaacgtacgcttaaccgacgttaacgtacggttacggacgtaaccggtccggtaacgggaaacggtcccgtaacttacccgaaccgtacgtttccgaacgacggtaaaaccgtaacccgaaccgaaccgtaaagaaaacccctgtaaccggttaagtaaccttccgtaacgaaacttaaacgtacgaaccgtaccgaacggtaaccgtaaaccgggaaacgtacccggtaaccgaaccgggttaaccggttaggtaaacgttaacttacggtacggtaccgaacgggttaaccggggcgggaacccttagtaaaccccgtttaaacgtttcccgttaaccccgtacccgtttaacccggtaacccggtggttttaaccgggacccgttaaccggggg

SEQ ID NO: 204073 - DNA, 985 bp, Homo sapiens
  misc_feature: GYAE6OF02GWXZW.24.85.H08.1.454.CMB.1.raw
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcgacggggtccctgagactctcctgtgcacgcctctggacttccgcctttacaaattaacctttcgtaggattcgacctacgtcggggtccccgaccgaacggccttacccggaagggggtaacggggtccttaggtaagtttttcggggaccttacgtaacggttaactttaaacgtagttttaggaacgttgggggaactttacggtaccttaccgaaaccgtaaccgttaaggttaccgggacccgggtaacccttaccccggggttaaggggaaaccccggggggtacccctttaaacgtttaccccgaaaccccgttaacgtttaccccgttaacccgaaagggtaaccgtaaaacccaaacccgggaccccaaaacgggaaaaaccctaacccggttaaacgttacggtttaaaccgtcccgtaaacggtaaaccttaaaacgtcgggaaccggtaaccgtaaacggtacccgttaaaagggaaaacccggcccgggtaaaacccggtaaccgggtaaccgggttacgtttacggggtttaccgttttaaaccgtttaaccggttacgggtacgggaaacccgggttaaaggggggaacccgggggtacccctaaagggttaccccgttaaaccgtttttaaccccgttaaccccggttaaacccgtttaccccggttaccccggtaacgttttaaccgggttaccggggttacccgggtttaccggggttaacccggggggaaaccccgggtaaccgggggttacccggtaaccccggggg

SEQ ID NO: 204074 - DNA, 733 bp, Homo sapiens
  misc_feature: GYAE6OF02G5L09.24.85.H08.1.454.CMB.1.raw
  modified_base (208)..(208): a, c, t, g, unknown or other
  misc_feature (208)..(208): n is a, c, g, or t
tcagactactatgtcacgaccggtgctcgatttagtatcactcagtcgcgggggagccccagccctgggattcccagctgtttctgcttgctgatcaggactgcacacagagaaactcaccatggagtttgggctgagtcgtggtttctgtaggctatttaaagtgtcagtgtgagtgcagctggtggacggtcggggagtctagtcngcgtcggggtccctggactacgtctcgtgtacgcacgtcctgtggtactttcgaccttactaaattaccttgagtcgttcgacctcggtcggtcctaccgtaagcccgttaacggggagggaacgggtcttgggttaacgtttccggtactaccgtaacggttatttaaacgtgttaggtacggtaggtaataacgtcctaactacgacgttgaccgtcgtaaccggttcgtagggaaaccgccggtttaacaccggttaccacttacccgtacggaacgtaaaccggtaacccaacccgagtaaaaccgaaaccgtaccgtaaaccgtttcggtaaattccggtaaacgtaaacgttaacgaacggtacctaccgggtaccgaaaccggtaaccggaaaccggtaccgacgtaacgaccgttcgtacgttacgttagaccggtttcaacggtagtaacggggtaccgacggtaccacggtttactacggtcccttaccttaccgtaacgtcccgtaaggtccgg

SEQ ID NO: 204075 - DNA, 794 bp, Homo sapiens
  misc_feature: GYAE6OF02IVNOS.24.85.H08.1.454.CMB.1.raw
  modified_base (193)..(193): a, c, t, g, unknown or other
  misc_feature (193)..(193): n is a, c, g, or t
  modified_base (256)..(256): a, c, t, g, unknown or other
  misc_feature (256)..(256): n is a, c, g, or t
tcagactactatgtcacgaccggtgctcgatttagtatcactcagtcgcgggggagcccagccctgggattcccagctgtttctgcttgctgatcaggactgcacacagagaactcaccatggagtttgggctgagctgggttttccttgttgcttaatttaaaggtgtccagtgtgagtgcagcgtggtggngtccggggagtcttagttcaggccgtgggggtccctgacgactcctccgtgtcgcacgtcctntgtacttcgaccttacaagtaacttcgtcggtatcggacctacgtcgggtaccgaccgtaacgtccgtccggaaggggtaaccgggtccttaggttacggttttacggggtcccttaaccgtaacggttaacgttaacgagttggtaacgtcggggtaagtaaccgtcgtaaccgaactaacgtaacgtcggaccggtaccggttaccggttaacgggtaacccggggaccttaacggtttaccctaaccgttaactcccgtaacccggtaagaacccggtaaacctaacccggaaccgttaaaacgaaacccgtagtaacccttagggttaacctccgtaacgtaacctaaaggtacggtaccgtacaacgggtaccgtaacgaaccgggtacccgtaaccggaacgggtacccgtaacggttcggtaaagtttacccgtacggttacggaccgtacggtaaacgggtccggaacccgtgtaacccttacttaccccgtaccttaccgaacccgttccgtaaggtaccgttaccggg

SEQ ID NO: 204076 - DNA, 765 bp, Homo sapiens
  misc_feature: GYAE6OF02GKLLO.24.85.H08.1.454.CMB.1.raw
tcagactactatgtcacgaccggtgctcgatttagtatcactcagtcgcgggggagccccagccctgggattcccagctgtttctgcttgctgatcaggactgcacacagagaactcaccatggagtttgggctgagcttgggttttccttgttgcttattttaaaaggtgtccagtgtggaggtgcagctgggtggaggtccgggggaggtcttagttcagccggtggggggtccctgagactctcctggtgcagcctcgtggtacttccgtcctttacaaatttaaccgtttcgtagggtatcgacctacggttccggggtaccccgaccaacggtcccgtaccggaagggggtaacggggtccgttaggttacggttttcgggtccttaccgtaacggtttaactttaacgtaagtttacggtaaggttacgggggaacgttacggcttacaacctacgttagtcggaccggtaccgttaccggggtaggaaaccggggtccctaactttacccgaaccttacgtaccctaccgaagacgaaccaaaccggaccaaagaaacacctaacgtagtacttacgacgaacgtaaatcggaacaccgacggaccgtaaacggaaccgacccgaacggaaccgaccggttacgtacggttagtttaaccgttagttacggacgggtacggaaggggtacggggaccgtacgtacctaacgtttacccgtaccttaccggttacccgccgtttacgtaggttaccggg

SEQ ID NO: 204077 - DNA, 784 bp, Homo sapiens
  misc_feature: GYAE6OF02G6Q1P.24.85.H08.1.454.CMB.1.raw
  modified_base (284)..(284): a, c, t, g, unknown or other
  misc_feature (284)..(284): n is a, c, g, or t
  modified_base (328)..(328): a, c, t, g, unknown or other
  misc_feature (328)..(328): n is a, c, g, or t
tcagactactatgtcacgaccggtgctcgatttagtatcactcagtcggcgggggagccccagccctgggattcccagctgtttctgcttgctgatcaggactgcacacagagaactcaccatggtagtttgggctgagcgttgggttttccttgttgtcttaattttaaaaggtgtccgagtgtggacggtgcagcgttgggtggacgggtcccggggggagtcgtttaggttccgaggtcccggttggggggtcccctggacgtacctcctccgtgtcgacngtcccttgtcgtacttccgtaccttacaacttaaccttcgtggntcgctacggtcgggtccaccgacgtccgacggaggggtacgggtctaggttagtttcggccttacgaacgtttataactagttgtaggtgggactcgctacgactagtacgtcggtccggtacgttcgtaaggaccgggtctacttacccgacctaactccgaccgaaggaacaacccgaacgaccgaaacgaaacctactacggttcgtaacttctacgaaactaagtcgacgactacccgtacggtaaccggaaccgtcccggaaacgacccgtacgggttacctttagtaaccggttttacgtaccggtttacgggtacggtaaacccgggaacggggggaacccgggttaccctaggggtttaaccccttaaccggtttaaacccccgtttacccgttaaacccgggtttaccctaccccggggtttaggttaacccgggttaaccccgggg

SEQ ID NO: 204078 - DNA, 871 bp, Homo sapiens
  misc_feature: GYAE6OF02HGY32.24.85.H08.1.454.CMB.1.raw
tcagactactatgtcacgaccggtgctcgatttagtatcactcagtcgcgggggagccccagccctgggattcccagctgtttctgcttgctgatcaggactgcacacagagaactcaccatggagtttgggctgagcttgggttttccttgttgcttaagttttaaaggtgtccagtgtgaggtgcagcgtggtggaggtccgggggagcttagtcagccgtgggggtcctgacgtactctcgtgtgcacgtcctcgtgtacttccgtcctttactaaacttaaccgtttcgttaggtacgtacggtcgtaccggttccgggggttaccccgaccccgaacggccccggttaccgggaaaggggggtaaacggggggtcctttacggggtttaacggttttccggggttacctttaccgtaaaccggttttaaactttaaacttaggtttaggtaacgggttaggggtaacggttaacggttacccgttacgaaccgtaacgttaacggtcgggtaccggttaacccggttacccgggtaaggggtaaaccgggtacccgttaccgtttacccaacccgtttaacgttccccgtaacccggtaaaacggaaccggaaaaccgaaacccgtaaaccccgaaaacgaaaacccttacccggtaacttttaccgggtacttacccgttaggaaactaaacgttccggaaaccggtaaccgtacgaccgttaaacgggaacccgggtacccggtaaccgaaccggtaccgttccgtttaggtaacgtttaggtactgggacgtaacggacgggtacggactaacgtaccgttacgttaccttaccgacgttccctacggttatacggtaccggg

SEQ ID NO: 204079 - DNA, 807 bp, Homo sapiens
  misc_feature: GYAE6OF02I0SH9.24.85.H08.1.454.CMB.1.raw
tcagactactatgtcacgaccggtgctcgatttagtatcactcagtcgcgggaggacgctgaccacacggtacgtgctgttgtactgctcctcccgcggctttgtcttggcattatgcacctccacgccggtccacgtaccagttgaacttgacctcagggtcttcgtgctcacgtccaccacacgctatcgtagacctcgacggggtccctagagtaccttcgtcctggtcgcacggtccttacgtgggactttcccgtacctttactaaacttaacctttcgtaggatcgtacacgtcgggtaccacaagtccgtacgaggggtaagggctagtagtttcgggtacctacgtacggttaattaaaccgtgttaggtacggttaggggtaacgttagtaccgtaccgaacgtaccgttaagtacggtaccggtaaccgttacccgggtaacgggtaaaccgggtccgtaacgttacccgaaacccgtactttaccgtaacccaagggtaaaccgaaacccgaacccgaccgtaaacgaaacccgtaacgtaacttacggtacttacgtacgtaaactaaagcgtacggaaccttacgaccgttacgaaaccgtacccgaacgaaccgtaggtccgttaaggttacgtttaacgttaaccgttggtaaccggtaaccgaacggggttaccgggaactaccggtacttaacggttttaccctaaccggtttaccctaccgtaccggtacgtacggttacggtaccggtacgggttaccgggaaccggttaacgggccccggttaacgg

SEQ ID NO: 204080 - DNA, 721 bp, Homo sapiens
  misc_feature: GYAE6OF02HLGU1.24.85.H08.1.454.CMB.1.raw
tcagactactatgtcacgaccggtgctcgatttagtatcactcagtcgcgggggagccccagccctgggattcccagctgtttctgcttgctgatcaggactgcacacagagaactcaccatggagtttgggctgagcttggttttccttgttgctatttaaaggtgtccagtgtgaggtgcagctggtggaggtccgggggagcgttagttcagccgtgggggtcctgagactcctccgtgtgacgacgcctcgtggtattcgtccgttactaacttaacttctgagtgctacgtcggtccgaccgaacgacgtaccggacgggtaacgggacgtggtacgtttggtacgtacgtacgttaacttaacgtagttacccccgtagtagggtagtacgtacgtactaacctaacgtacgtagacggtaccgttaccggtacggtaacgggtaccggtacgttaccgtacctactaccgtaccgaacgaaccgtaacgaaaccgtaaccgaacgaaaccgtaactaacgtacgtacgttacgtacgaacgtaacgtagacgacgacgtaccgtaacgaaccgaaccgaaccgtaacgaccgtacgtacgttaacgttacgttacgtaggttacgtacggtaacgggtaacgggaccggaacgtacgtaaccgtttaccgtaccgttaaccgttacccgtaccgtaccgttacggttaacccgg

SEQ ID NO: 204081 - DNA, 914 bp, Homo sapiens
  misc_feature: GYAE6OF02JKARO.24.85.H08.1.454.CMB.1.raw
tcagactactatgtcacgaccggtgctcgatttagtatcactcagtcgcgggaggacgctgaccacacggtacgtgctgtttacgtcgtcgtcctcccgtccggcgtttgtttcgttcggttcgattaattgcaccctacccaccgccggtcccgtaccgtaaccgtacgttaggttaacttacgtaccgtcgtacgggtcggtttcgttcggcgtcctacgtacccgacccacccaccgcgtactagtcgaccgtaccgtcgggtaccggttccaggactccttccgtcgtgacacgccgtctcggtacgttccgtacccttaccttaaactaaactttcgttcggtagtacgtccgtaaccggttcggggtccccggtacccaaacggtcgttccccggaagggggtaaacgggggtccgttgttacggttttacggggtttcccggttaacctacgtttaaaaccggtttaaagtacgtttagtaggggtaacggggttacggttaactccctaaccacccgttaagttacggttccggaccgggtaccgttaccccgggttaacggggaaacgggtccgtaaccgttttaccaccctacgttaccgtcccgaaacgggaacgtaaaccgaaccccgaccaaagaaacctaaccgtaacgttcgtaacgttactaacgtaaagtaacgtacgacccgtaccgtaacgtaaggtaaacccgacccgggtacaacgtaccgggttactgtttaccgtttaattacccgtagaacgggtacgaaaccggggtacgggtaccgtacgaactttccgtttacccgtacccgtccgttaaacccgtcgttacgtaaccggaggtttaccggccggttacgggaaccggaccggtaaccggtaccggccctttaaccg

SEQ ID NO: 204082 - DNA, 1047 bp, Homo sapiens
  misc_feature: GYAE6OF02FVWBK.24.85.H08.1.454.CMB.1.raw
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtcgacctcgacggggtccctggacgactcctcctggtgcagccctcgtggtacttccgcctttacaaacttaacttcgtggatcggcctacggtcggggtccacccgaaggtcctaccggaagggggaacggggtccttaggtacgttttcgggggtccttacgaaccggtttaattaaaccgtgtttacgggaggttacgggggaacgttacgtaccgttaccgaaccgttacgttaacggtcgggacccgggttaacccgttcccggggtaacggggtaaaaccgggggtcccctttaacgttttaccccgaaaacccgtaccgtttaccccggttacccggaaaacggggaaacccgaaacccccgtaaaacccgggacccgtaaaaaccggtaaaaacccctacccgttaaaccgggttttaacgttaaaccgttcccggttaaaccggtaaaacccttaaaaagggtttcgggaaaacccggtacccgggtaaacccggttaaacccccgggttaaagggaaaaaccccggggtaccccccgggtaaaacggaaaccccgggttacccgggggttaaccttttaggggtttaaacccgtttttaaacggttttaacccgggtacggggtttaaacccgggaaccggggtttaaacggggggaacccgggggggtacccttaaagggttaccccttaaaccggtttttaccccgttaaccccgttaaacccggttttaaccccgtcccggttaaccggtttaccgggttaccggggttacccggtttaaccccgggggggtaacggggtacccccgggttaaaaaccgggggtcccggttaaaccccggggg

SEQ ID NO: 204083 - DNA, 816 bp, Homo sapiens
  misc_feature: GYAE6OF02HH5PR.24.85.H08.1.454.CMB.1.raw
tcagactactatgtcacgaccggtgctcgatttagtatcactcagtcggcgggggagccccagccctgggattcccagctgtttctgcttgctgatcaggactgcacacagagaactcaccatggtagtttgggctgagtcgttgggttttccttgttgtacttaagttttaaaaggtgtcctaggttggtgaggtgcagcgtgggtgggacgggtccgggggtaggtctttaggttcgacggtcccggttcggggggtccctggtaacgtacttccgttccgtggtcgccgacggtccttcgtggtacgttcccgtaccctttaacgtaaacgttaaccttcggttaggtacgttacgccgtacggttccgggtccccacccgtaacggtccgttaccgggaagggggtaacggggtcttacgggttacgttttcgggtccttaccgttaacgtttaagttaacttagttacggaggttaggggtagttacgtaccttacgaacttacgttacgtaccgggaccgtaccgttccgggtaacggtaaccgggtccttaacgttaccgacccgttactacccgtaccgaaacgggtaaccgaacccaaaccgacccgaaaacgtaaaccctacgttacgttaaggttacctaaccgtaggaactaaacggtggaactccgaaacgtacccgtaaaggaaccgacccggtaacgtacgacgtaccgtttagtattaacgttcgacgtcggaacggaacggggtccggacaacggttacctacgttacccgacttaccgtcgttcctagttacggtcgg

SEQ ID NO: 204084 - DNA, 746 bp, Homo sapiens
  misc_feature: GYAE6OF02GT38O.24.85.H08.1.454.CMB.1.raw
  modified_base (261)..(261): a, c, t, g, unknown or other
  misc_feature (261)..(261): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcgacggggtcctggagactctcctggtacgcagcctcgtggacttcgccttacaataacttcgnggatcggcacgtcgggtccgccgaaagctcccgaagggaaggggctaggtagttttcggggcttcaacggtttaattaaaccgtagtttacggagttacggggtaagtaacggtcctacgtaactacggttatacgggaccggtaccgttaccggtaagggaaccggggtaccgtagtttacccgaacctacgttacctacccgtaggaacaaccgaacgtaaccgaacggaaaaacctcgtaacgtaagttaacgtacttaacggactaaaacgtacgaacgtacaacgtcccgtaaggaacccggaaccgacgtaacggaacccggtcgttgttacgttaacgtttaagtcgtacgtaaccggaagggtaacgggaccacgtaccgaacgttttaaccgtcctaacgttaccgtaccgtacgttaacgtacgggttaccggttaccggtaacgggtaacccggaacggtaacccggtaaccgg

SEQ ID NO: 204085 - DNA, 732 bp, Homo sapiens
  misc_feature: GYAE6OF02GVJK5.24.85.H08.1.454.CMB.1.raw
  modified_base (318)..(318): a, c, t, g, unknown or other
  misc_feature (318)..(318): n is a, c, g, or t
  modified_base (438)..(438): a, c, t, g, unknown or other
  misc_feature (438)..(438): n is a, c, g, or t
tcagactactatgtcacgaccggtgctcgatttagtatcactcagtcgcgggggagccccagccctgggattcccagctgtttctgcttgctgatcaggactgcacacagagaactcaccatggagtttgggctgagctgggttttccttgttgctaagttttaaaaggtgtccagtgtgaggtgcagctggtggaggtccgggggaggtcgttagttcgacggccgtcggggggtccctggagtacctcgtcctgtgcagcctcgtggtacttccgccttacaattaacttcgtaggactgcctacgtcgggtcccnccaagccgtaccggaggggaacggggtctggtaagtttcgggtctacgtaacgttaattaactagttagagtgggatagctacacactatcggcgtaccgtcggtaggaacgggaccgtnttcccgaactctacctaccgagaacgaaccaaccgaccgaaacgaaaccactaacttcgtacttactacgaactaaagtacgacgtacgacgtaccgttaacggaacgaccggaaaccggacgtaccggtaccgttaggttacgttacgttacggttacggtacggtaacgggtaacgggggtaaccgggggaaccgtaacgggtaacccgtttaacgtttaaccccgtttaaccccgttaacccgttttaaccccggttacccggttaacccggtttaagggttaccccgggg

SEQ ID NO: 204086 - DNA, 733 bp, Homo sapiens
  misc_feature: GYAE6OF02I2SAQ.24.85.H08.1.454.CMB.1.raw
  modified_base (512)..(512): a, c, t, g, unknown or other
  misc_feature (512)..(512): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcgaggggtccctgagacctctcctgtcgcacgcccttcgtcgggtactttccgaccctttacaaacttaacttcttcgggaattcgcctacgtcggggtaccacctaacgcctaccggaagggggaacgggtctaggttacgtttcgggtacctcgtaacggtttaacttaactagtttaggacggttaggggtaacggtactcctactacgaacttaacgttcggaccggtaccttccgggtacggaacgggttaccgtactttaccgaacctacttccgaccgtaagacgaaccgaacgacgaacgaaaaccnctaacgttactcaacggtacaaagtgaacgtccgaagtacccgaaagaaccgccgaaaacggcgtaccgtgttaacggtacttaacgtttagcggttacgaacgggtaagggcgggtaaccaggtcttaccggttaccttaacccggtactaccggtacgtactaggtccggaccggttacggtaccggggaaccctaaacgggccgttaaccggtcccgg

SEQ ID NO: 204087 - DNA, 760 bp, Homo sapiens
  misc_feature: GYAE6OF02I69NQ.24.85.H08.1.454.CMB.1.raw
  modified_base (226)..(226): a, c, t, g, unknown or other
  misc_feature (226)..(226): n is a, c, g, or t
  modified_base (228)..(228): a, c, t, g, unknown or other
  misc_feature (228)..(228): n is a, c, g, or t
  modified_base (336)..(336): a, c, t, g, unknown or other
  misc_feature (336)..(336): n is a, c, g, or t
  modified_base (380)..(380): a, c, t, g, unknown or other
  misc_feature (380)..(380): n is a, c, g, or t
  modified_base (389)..(389): a, c, t, g, unknown or other
  misc_feature (389)..(389): n is a, c, g, or t
tcagactactatgtcacgaccggtgctcgatttagtatcactcagtcgcgggaggacgctgaccacacggtacgtgctgttgtactgctcctccgcggtctttgtcttggcattatgcacctccacgccgtccacgtaccagttgaacttgacctcgaggtcttcgtggctcacgtccaccaccacgcatgtcgaccgtcgacgggtacctgagactctcgtgtcncncgtcctcgtggtacttccgtccttactaaagttaaccttcggtaggtactcgaccgtaccggtcgggtacccgaccgaagtccgtaccgggaaagggggaccggggtnttacggttagtttcggggtacctacgtaacgttattaaccgttntggtaaggngggtaatcgcgttacaaccgtagtacgtacggacggtaccgttccgggaagggtaccggcgtttaaacctcggaacctacgttccgaaaccggtagaaccgggtaaacaccggtaaccgaaacggtaaacccaacgtacgttacgtaacttcgtaacgtaacgtaagtcggacgtacgacgtacgtaacggaaccggcccgaacggtaccgcggtacgtttacggtacgtacgttacgtacgtacggaaccggaagggtaccgggacctaagttcctaaccgtttaacccgtccgttaaacctccgtaacgttccgtaacggttcggtaaccggtcggttaacgggacccggtaccggtcggtaacccggg

SEQ ID NO: 204088 - DNA, 905 bp, Homo sapiens
  misc_feature: GYAE6OF02IDR5J.24.85.H08.1.454.CMB.1.raw
  modified_base (314)..(314): a, c, t, g, unknown or other
  misc_feature (314)..(314): n is a, c, g, or t
tcagactactatgtcacgaccggtgctcgatttagtatcactcagtcgcgggggagccccagccctgggacttcccagctgtttctgcttgctgatcaggactgcacacagagaactcaccatggagtttgggctgagtcgttgggtttttccttgttgtacttaagttttaaaaggtcgttacctagttggttgagggtcgcgtaggtcgtggggtgggtagggtcccgggggggtaggtacgtttaggttccgacgggtcccgggttcgggggggttcccctaggaacgtaccttccgtccgttggtcgccncgtccttcggtcggttaccgtttccgtaaccctttacgtaaaactttaaccgttcggtacggtacttcggtccgtaccgggttccgggtccccgacccgtaacggtccccgtaaccggggtaaggggggtaacggggtaccgttagggtttacggttttccggggttacgttaaccgtttaaccggtttaaacgtttaaaacgttcggttttaaggacgggtttacggggtaaacgtacggttccctaaccgtacctaacgtacgtcgggaccggttaccgttaccgggtaacgggtaccggtacccgttattacccgtaaccctacgttacccgcggtaaacggaccgtaaaccgaacccggtaacaaacgaaacgtccgtaaacgtttcgtaactacgttaacgaagtaaccgtcgtaacgcctaacggccggtaaacgaacgaccccgtaacgaacccgtcgggttacgttaacttcggttaaacgttccggtagtaacgggacgggtaaacgggccggtacctacgggtaaccctttacttacccggttacccttacgttaccccacgggttacgtacgttccgggg

SEQ ID NO: 204089 - DNA, 670 bp, Homo sapiens
  misc_feature: GYAE6OF02GFJ9Z.24.85.H08.1.454.CMB.1.raw
  modified_base (607)..(607): a, c, t, g, unknown or other
  misc_feature (607)..(607): n is a, c, g, or t
tcagactactatgtcacgaccggtgctcgatttagtatcactcagtcggcgggggagccccagccctgggattcccagctgtttctgcttgctgatcaggactgcacacagagaactcaccatggagtttgggctgagctgggttttccttgttgctattttaaaaggtgtccagtgtgaggtgcagctggtggaggtccgggggaggcttagttcagccgtggggggtccctgacgactctcctgtcgcagtcctcgtggacttcgccttcaaattaacttcgtggatcggaccacgtcgggtcccgaccgaaggcctaccgaagggggaaggggccttaggtagttttggggtacctaccgtaacgttaactttaaccgagtttacgaggttggggacgttacggtaccttacaccgtaacgtagtacggtaccgggtaccgtaccggttagggaaacgggtcccgtaactttaccgaccctaactccgtacccgaagaacggaacccaacggacccaaagaaaccctacactgtactcctagacctaaatcgagctaacgccgtaaggaaccgccgaacaacggacgtctagttagtattacgngtagacgtaagggacgggccaagtcctagttacctccgtaacttcctaccgtgtacgtacggg

SEQ ID NO: 204090 - DNA, 730 bp, Homo sapiens
  misc_feature: GYAE6OF02FZZSF.24.85.H08.1.454.CMB.1.raw
tcagactactatgtcacgaccggtgctcgatttagtatcactcagtcgcgggaggacgctgaccacacggtacgtgctgttgtactgctctcccgcggctttgtcttggcattatgcacctccacgccgtccacgtaccagttgaacttgacctcaggtcttcgtggctcacgtccaccaccacgcagtgtgacctcgacggggtccctgacgactcctcctgtgcacgcctcgtgtacttccgccttacaacgttaacctttccgtaggtacttcggacctacggttcggggtaccccgaccaaacggtcccgttacccggaagggggaaacgggggtcccttaggtacggtttttcggggttcccttacgtaacggttaactttaaaccgtagtttacggtaaggtaggggtaaacttacgaccgttacaaccgtaacgttaacggtcggtacccggaacctttcccgggaagggtaacgggtacccgtattacccggactaatcccgtacgaacgagtacccaaccgacaacgtaaacactaccttgtactgacgaataagtcggtacagaccgaccgttacgaaccgaccgtaccgaccgtcgtacgttagtggtttaacttcggtagtacgtaacgaccgggacggggaacgtacgtacgtacttaccgtactaccgtactcgtacgtgtcgtacggtcggtacggacggtacggccggtaccgg

SEQ ID NO: 204091 - DNA, 934 bp, Homo sapiens
  misc_feature: GYAE6OF02JACZD.24.85.H08.1.454.CMB.1.raw
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcgaggggtccctgagacctctccgtgtgcacgtcctcgtggtacttccgtaccttacaattaccttcgtggatgcctacgtcgggtacccgaccgaacgccgtaccggaagggggtaacggggcgttaggttacgttttcgggggtaccttaccgtaacggtttaactttaaaccgtagtttacgggtaaggttacggggtaacgttaacggtccttaaccgtaacctaacgttacgtacgggtacccgggttaaccgttacccggggtaagggaaccggggttacccgtaacgtttacccgaacccgttacgttacccgttaccccgaacggtaaccgtaaacccgaaacccggacccgaaaaggtaaaacccctaacccgttaaaccgtttaaccgtttaaccttaaccggttaacggtaaaccgttaaaaaggttccggaaaccgttaccggaacccggttacccggttaaacgggaaaaccccggtaacccgggaaccggtaaacccggtaccggggttactttacgggtttaacgtttaaccgtttaccgttacggggtacggtaaacccgggaaacgggggtaccggggaacctaacggtaccctttaaccgtttaccccgttaacccttaacgttaccccggttaccgttacgtttacgggtaccggggttacccgttaccggggtaaccgggggtaacccggtaaccggggtaaccccggttaccgggg

SEQ ID NO: 204092 - DNA, 785 bp, Homo sapiens
  misc_feature: GYAE6OF02IYW74.24.85.H08.1.454.CMB.1.raw
  modified_base (661)..(661): a, c, t, g, unknown or other
  misc_feature (661)..(661): n is a, c, g, or t
  modified_base (721)..(721): a, c, t, g, unknown or other
  misc_feature (721)..(721): n is a, c, g, or t
tcagactactatgtcacgaccggtgctcgatttagtatcactcagtcgcgggaggacgctgaccacacggtacgtgctgttgtactgctcctccgcggtctttgtcttggctattatgcacctccacgccgtccacgtacctagttgaacttcgacctcgtagggttcttcgtggctcaccgtccaccaccacgctatcgtacgccgtcgacgggtccctagactacctctccgtgtcgccacgtcctcgtcggtacttccgtaccttaactaaacttaaccgttcgttacggtacttcggtacctaacggttccgggttaccccgaacgtaaccggtcccggtacccggaagggggtaacggggtctacggttagttttcgggtaccgtacgtaacgttaacttaacgtagttacggtaggtgggtaaactacgcgtacctaactgtacgtcggtacggtacgtccggtaggaacggtctacgtactaccgtaacgtcctaaccgaacggtaaaccgaaccgtaaaccgacccgtaaaacgaaacctacggttaaaccgttcggttaactaccgtgttaaaccaacggtgaaaccggtcctaacggtaccgttaaaggaaccgtacccgaacgtaccggtacgtaacgttcgttaacgtntttacgtacgtacgaacggaacggtcggaactacgtcgttaacttaccgtacgttaaccncgttaacctcggttaacggtagtcccgggtagggtaccggaaccggtacggtaccggtacccgg

SEQ ID NO: 204093 - DNA, 753 bp, Homo sapiens
  misc_feature: GYAE6OF02HODJR.24.85.H08.1.454.CMB.1.raw
  modified_base (350)..(350): a, c, t, g, unknown or other
  misc_feature (350)..(350): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcgacggggtccctggagacctctcctgtgcagcctctggacttccgccttcaattaaccttctggatcgctacgtgggtcccgaccaaggcctaccggaacggggaaggggctaggtacggttttggggtccctcgtaacgttaattaacctntttaggaagttggggagtagcctcaacactagtcggacggtacctcggtaggaaccgggtccgtacttaccgaaccttcgtaccctaccgaggaacgaaccgaaccggtaaccaaacgaaaccacgtaacttaggtacttacgtagaactaaagtccggaacgcgtaacggaccctacgggaaaccgcccggtaaccggaacccgtacgggaccgttaggttacgttaacgtttaccgtgggtacgaccggtaaacgggccgggggtaccacgggtacctttaaccgtttaccccgttaccctaacccgtttaacccggcccgttaacggttaccggtacgggttaccccggttaccgggtccgggggaaacccccgttaagggggacccccggtaaccgggg

SEQ ID NO: 204094 - DNA, 847 bp, Homo sapiens
  misc_feature: GYAE6OF02F6942.24.85.H08.1.454.CMB.1.raw
tcagactactatgtcacgaccggtgctcgatttagtatcactcagtcgcgggaaggacgctgaccacacggtacgtgctgttgtactgctcctcccgcggctttgtcttggaattatgcacctccacgccgtccacgtaccagttgaacttgacctcgaggtcttcgtggctcacgtccaccaccacgcatgtgacctcgaggggtccctgagactctcctgtcgcacgccttcgtggtacttccgcctttacaaactttaacctttcgtgggtacttcgaccgtaacggttcggggttccccgaccgtaaacgtccgttaccgggaaacggggggtaaacgggggtccttagggttaacggtttttcgggggtacccttaccggtaaaccggtttaaactttaaacgttacgttttaggaaggttacgggggtaacgttacggtacccttacgtaaaccgttacttaacggtcgggacccggtaccgtttaccgggtaacggggaaaccggggtaccggttaacgtttaccccgaaacgtaccgttaccgtaccgaaaccgggtaacgaaacccgtaaaacccgaacccgtaaaggaaaaccctacgtacgttacgtacgttacgtacaaccgtaaagtcggaacgacgtacggtaccctaagaaccgtaccgacgaacggtaccggtcttaggttacttacgttacgttggtacggacggaagggacgggacctagtaccgttactttaccgtacccgtaccttaaccgtccgttaacgtacgttaccgggacggttttcccgggaacgggtacccgggtaacgggtaacccggtagggttcccc

SEQ ID NO: 204095 - DNA, 767 bp, Homo sapiens
  misc_feature: GYAE6OF02H3BHG.24.85.H08.1.454.CMB.1.raw
tcagactactatgtcacgaccggtgctcgatttagtatcactcagtcgcgggaggacgctgaccacacggtacgtgctgttggtactgctcctcccgcggctttgtcttggcatatgcacctccacgccgtcacgtaccagttgacttgacctcagggtcttcgtggctcacgtccacaccacgcatgtgacctcacggggtccctgagactcgtcctgtgctagcctctggacttcgcctttcgaagttaacttctggattcgacacgtggtaccgccaaggccttacaagggggtaaacggggccttaaggtagtttcggggtcctactaaccggttaattaaaactcgtttaggaattcggggaagtttagccgttacaaccgacttacgtaggccgtaacctcggtcggaaagggccgttaaattccgaaccgtatccgtacccgaaaggtaccgaaacgaaccggaccgaataaaaccggtccaacgttagggtaactaccggtagaacgtaaacgttacggaacgacccgttaacggacctaagggaaaaccgccgaacctaaaccgggacgtaccgtagttaggtactttcgtaacgggttagcggtaaaacggggtacgggggccctaaaggtccctaaagttttacccgtaaaccggttaaccctttaaccgtaccccggttaacccgtaggttaaccgggtaacccggtttccggggaagggttacccgggaaacgggtacccggttaaaaccgggg

SEQ ID NO: 204096 - DNA, 906 bp, Homo sapiens
  misc_feature: GYAE6OF02IYX2H.24.85.H08.1.454.CMB.1.raw
  modified_base (852)..(852): a, c, t, g, unknown or other
  misc_feature (852)..(852): n is a, c, g, or t
tcagactactatgtcacgaccggtgctcgatttagtatcactcagtcgcgggaggacgctgacccacacggtacgtgctgttgtactgcctcctcccgcggctttgtcttggcattatgcacctccacgccgtccacgtaccagttgaacttgtacctcgagggtcttcgtggcttcacgtccacaccacgctatgtcgaccgtcgtacggggttccctggacgtactcctccgttggtcggtccacggtcccttcgtcgggttactttccggtacccggtttaaccaaacgtttaacctttccggttgggtaacttcggacctaccggtttcgggggtacccctaacccgtaaacggtcccgttacccggaaggggggtaacggggtccgtttagggttacggtttttacggggtacccttccgtaaaccggggtttaactttaaaaccggtagttttaggaaccgggtttacgggggttaaacgtaccgtacgtaactaccgttaaacgttacggtacggggtacccggtaaccgttaacccgggtaacgggaacgggtaccggtttaactaccgtaaacccgtaactttacccgtaaccgaaggtaaacccggtaaccgaacccgtaacggaaaaccaaaaccgtacccgtaaaccgtggttttaaccaccggtacgtaaacgttaaactaacgggacctacggaaaccttccggtaaacgaaacggtacccgaaacccgacggtacccgttacgtacggtttacttaaacgtttacgtacggtaacgaaccgggtaaagggccgggttacacgttaacctacggtttacccttaaccggaccttaacnccgtagtaacgtcggtaacggttccggacgggtaacgtaccggacccggtacgg

SEQ ID NO: 204097 - DNA, 1122 bp, Homo sapiens
  misc_feature: GYAE6OF02GV8NZ.24.85.H08.1.454.CMB.1.raw
  modified_base (243)..(243): a, c, t, g, unknown or other
  misc_feature (243)..(243): n is a, c, g, or t
tcagactactatgtcacgaccggtgctcgatttagtatcactcagtcgcgggaggacgctgaccacacggtacgtgctgttgtactgctcctcccgcggtctttgtcttggcattatgcacctccacgccgtaccacgtaccagttgaacttgacctacgagggttcttcggtggctaccacgtcccaccaccacgcatggtcgaccgtcgtacggggtccctgacgtaccttctccgtgtanacgaccgtccgttgtacggtacgtttcccgtacctttactaaacgtttaaccgtttccggtaggtacgtccgaaccgtacccgggtttcccggggaccccgaaccgtaaacggtccccgttaaccgggggaaagggggggtaaaccgggggtccttaggggttttaccggggttttggggttcccctttaacggtaaaccgggtttttaacctttaaaggtacgttttaagggtaacgggtttagggggtaacgtttaaaccgcccgttaaaccgtaactaaccggttttaggacccgggtaccggttaaaacccgggttccggggtaaaaccgggggtaccggggtaaccctttaaactttaccccggaaccgttaaccggtttccccaaaacccggtaaaggggaaaaccccgttaaacccggaaaacccccgaacccggtaaaaacccaaaacccctttacggttaccggttacgtttttaaaacgtaccgtaacgggttaaaaaccaacggtccgggggtaaactacccggaaaccggtttaaaccgggttaaaaccgggaacccgggaaccccgtaacggtaaccgggttaccccggtttaaggttagggtttttaaaaccttcgggtttaaaaccgtttccgggggaaacccggttaaaaaccgggggggtcgggtaaacccgggggttaccctaaaggttttacccgttttaaccccttttaacccggttaacccccggaacggttttaaccccccgggttaagttttaaccgggtcggggtttaaaccccggggttcgggtttaaccccccggggggtaaagggggaaccccccggggttaacggggttaaccccgggggttttcccccgg

SEQ ID NO: 204098 - DNA, 748 bp, Homo sapiens
  misc_feature: GYAE6OF02IEEU4.24.85.H08.1.454.CMB.1.raw
  modified_base (167)..(167): a, c, t, g, unknown or other
  misc_feature (167)..(167): n is a, c, g, or t
  modified_base (228)..(228): a, c, t, g, unknown or other
  misc_feature (228)..(228): n is a, c, g, or t
  modified_base (479)..(479): a, c, t, g, unknown or other
  misc_feature (479)..(479): n is a, c, g, or t
  modified_base (552)..(552): a, c, t, g, unknown or other
  misc_feature (552)..(552): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtcacgtaccagttgaacttgacctcgagggtcttcgnggctcacgtccaccaccacgcatgtcgacctcgacggggtccctgagactctccgtgtgcncgcttcgtggtacttccgaccttacaaattaccttgtaggtactcgacctacggtcgggtcccacgaagccgttacggaagggggtagggccttaggtacggttttcgggtcctacgtacgttaattaacgtagttcgagtgggaatcgctacacgtactagtacgaccggtacgtccgagggaacggctattaccactctacctacgaacgagaaccaaccgacaaagaaacctacgtactagtaccgtntacgaacgtaaactggtaccaacgttaccggacctaaagggaaacccggtacccgaaacggaaccggtacggngtttaaccgtgtttaaccgttaccggttgaaaccgggtcgaaacgggggacccgggttacaaaccggttccgtttaaccgtttaaccccggtctttaaaaccggtcccttaccccggaagttttccgggttaccggggacccgtttccgggggtaacccgggggtaacccctaagggggtaccccgttaaccgggg

SEQ ID NO: 204099 - DNA, 810 bp, Homo sapiens
  misc_feature: GYAE6OF02GY4KA.24.85.H08.1.454.CMB.1.raw
  modified_base (294)..(294): a, c, t, g, unknown or other
  misc_feature (294)..(294): n is a, c, g, or t
tcagactactatgtcacgaccggtgctcgatttagtatcactcagtcgcgggacggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctgacggggtccctgagactctcctgtagcacgtcctcgtggtacttccgtccctttacaacttaaccgtttcgtggtatcgctacgtcgggtacccncgaagcctacggaaggggtacgggtcttaggtacgtttcgggactacgtacgtattaacgtagtttacggaggttaggggagttacgggaccttcgaaccgtacgttaagtcggtaccggtaaccgttcccgggttaagggtaaccggggtacccgtacgttacccggaacctacttaaccccgtccgtaaaacgggtacgaaacccgtaaccggaaccccaaaccggggaaaacccttcggtaaacccgttaagggtacctttaccggaacggaaacctaaacgttcggacgtaacgtaccggaccttaaccgggaaaccgcccgggaaacgcccgttaacgggacccttgggtttactaaacgtttcgggtcgtaacggggaccgaaaggggaccgggacctagtcccgttaaacctttcccggtaacccttagtaaccccctcggttaacctaggtaccggggtaccggtttaccgggaaccgggtaccggaaccggggttcccggtaacggg

SEQ ID NO: 204100 - DNA, 738 bp, Homo sapiens
  misc_feature: GYAE6OF02G8A9O.24.85.H08.1.454.CMB.1.raw
  modified_base (143)..(143): a, c, t, g, unknown or other
  misc_feature (143)..(143): n is a, c, g, or t
  modified_base (260)..(260): a, c, t, g, unknown or other
  misc_feature (260)..(260): n is a, c, g, or t
  modified_base (277)..(277): a, c, t, g, unknown or other
  misc_feature (277)..(277): n is a, c, g, or t
tcagactactatgtcacgaccggtgctcgatttagtatcactcagtcggcgggaggacgctgaccacacggtacgtgctgttgtactcgctcctcccgcggctttgtcttggcattatgcacctccacgccgtccacgtaccngtttgaacttgacctcagggtcttcgtggctcacgtccaccaccacgcatgtcgaccgtcgacggggtccctgagacctctcctggtgcagcctctggtattccgcttcaatacttntgatgctacgtgggccncaagctaccgagggacgggctgtacgtttcggctacgtaacgttacttaacgtagttggacgttgggattagccttacgactacgtacgtcggaccggtacgttccggaggtaaccgggtccgtattccacctagtcctacgaacggacgtaccgaacgacctaaacgaaacctacctacgtacgttaactccgtaagtaacctaaagttcggaacgtccgaacgtccgttaaacggaaacccgtaccggaaccgtaccgtaaccggtcgtttaacggttacgttaacgtttacggtcggtaccgtaacggaaacggggtacggggaccctacgtaccgttaaccttaacccgttacccgttaaccttacccgtcccggttaaccgttagggtacccgggttacccggttaccgggtacccgggggtaaacccgtaaaccggggtcccgttaaccccgggg

SEQ ID NO: 204101 - DNA, 833 bp, Homo sapiens
  misc_feature: GYAE6OF02GOKHH.24.85.H08.1.454.CMB.1.raw
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgtcatgtgacctcgacggggtccctgacgactctcctgtcgcagcctctggacttcgccttacaattaacttctggatcgctacgtcgggtccgacaagcctccggaggggaacgggtctaggtagtttcgggtctaccgaacggttacttaaacgtacgttggaagttcggggtaagttacggtccttaccgtaaccgtaagttacgtcggacccgggtaccttacccgggtaagggaaaccggggtcccgttaacgttaccctaacccggacttttacccggaccccgtaagggttaaaccggaaacccgaaacccggaccgtaaaaccggaaaaacccgaaccgttaaacccgttaggtttaaaccttaccggttaacgggaacccttaaaagtaccggaacggtaacgtaaccgtaccgtaacggaaaaacccggcccgggtaaaccgaaccgggtaccggtaccggttacgggttaacgtttaacgtttaccggtccggttaagggaccgaaaaggggttccgggggaacctcgggttactaacgttttacccgtcccgttaaaccgtttcccgaccgtttaaccgttagtaccgggttaccgtaccgggttcgggaaccccggtagggtaccccgtacggg

SEQ ID NO: 204102 - DNA, 714 bp, Homo sapiens
  misc_feature: GYAE6OF02JJV8R.24.85.H08.1.454.CMB.1.raw
  modified_base (221)..(221): a, c, t, g, unknown or other
  misc_feature (221)..(221): n is a, c, g, or t
  modified_base (229)..(229): a, c, t, g, unknown or other
  misc_feature (229)..(229): n is a, c, g, or t
tcagactactatgtcacgaccggtgctcgatttagtatcactcagtcgcggggaggacgctgaccacacggtacgtgctgttgtactgctcctcccgcggctttgtcttggcattatgcacctccacgccgtcacgtaccagttgaacttgacctcagggtcttcgtggctcacgtccaccaccacgcatgtgacctcaggggtccctgagactctcctgngcagcctntggattccgcctttacaaacttaacttctggaatgacctaacgtcgggtccaccgaaacggtaccgtacgggaaggggacggtcgtagtacggttcggactaacgtaacttaataactagtagtaggtaggtactacgactacaactacgtacgcgtacggtacgtacggtaacggtaacggtactaactaccgaactactacccgtaacgaaagaccgaaacgaaccgaacctaaaacgaaacctaactaacggtacgtaacgtaacgtaaacgtaaactaacgagaacgaacgaacgtaaccgaaacggaacccggaaccggaaaccggaacggtaacggtacgttaacgttaacgttaacgttacgtaaggtaacggaaacggtaaacggggaaccggtacacgtaaccttaaccgtacctaacgtaacaccgtacgtaagtacggtacggaaccggtacgggacggaacgtaccgggtacg

SEQ ID NO: 204103 - DNA, 718 bp, Homo sapiens
  misc_feature: GYAE6OF02GBQW6.24.85.H08.1.454.CMB.1.raw
  modified_base (611)..(611): a, c, t, g, unknown or other
  misc_feature (611)..(611): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtacctgttgaactcgaccttgagggttcttcgtggcctctaccgtccaccaccacgctatcggtcgacctcgacggggtcctgacgtacgtctccgtgtgctacgcctcgtggattccgccttactaagttaacttctagatcgaccgtacgtcggtccgactaacgtcgtacggaacggggagggtcttcggtagtttcggggtctaccgtacgttaattaacgtagttggtaacggtggtaacggtcgtacctcgtaactacgtacgtcggtacgtaccggtacgtacgggaacggaccgtttacgtacgtacctacctcgtaccgtaagaccggtaaccaacgaaccggtaaactaaaacgcccttaacgtacggttacctacggttacgaacgtaaacgtaggtaccgtaactaccgaacgtacggtaaccggaccgacgtaccgaacggtctacgttacgtacgtttacnggtaacgacggtaacgggacgccgtacgtacgtacgttaccgttcctaacgttactaccggtcgtacgtacggtccgagggtccggaacgtaccggacggttaccgg

SEQ ID NO: 204104 - DNA, 834 bp, Homo sapiens
  misc_feature: GYAE6OF02I96T9.24.85.H08.1.454.CMB.1.raw
tcagactactatgtcacgaccggtgctcgatttagtatcactcagtcgcgggaggacgctgaccacacggtacgtgctgttgtactgctcctcccgcggctttgtcttggcattatgcacctccacgccgttcacgtaccagttgaacttgacctcgagggttcttcggtggctcacgtccaccaccacgcatgtcgacctcgacggggtccctggacgactctcctgtgcacgccttcgtcggtacttccgtccttactaaacttaacctttcgtaggattggccgtaccggtcggggtcccgaaccgaacgtcccgttacccggaaggggggtaacgggggcttagggttacggttttcgggggttacccttaccggtaaccggtttaactttaaaccgttacgttttaaggtaaggttacgggggtaagttacgcgttaaccgaaccgtaactttacgaccgggtccggtaccgttccggggtaaacggggtaaccggggtacccgttactttacccgtaaacccttaccggtacctaccggaaggtaaccgaaccgtaaccggaaccaaaccgtaaacccacgtttaacgtaacgttaacctcggttaacaacgtaaacggtcgaactacggacccgtaacgtaacggaaaccggcccgaaacggtacgaccgggtagttacgttacggttactttacgggtactaaggtagggaacgggtacgggacgtacgtaccgttccgttaaccctcccgttaacctaccgtccgtacgtaggtacccggttcggtaccgggttaacgggaccgggtaaccgggtcccggtacgg

SEQ ID NO: 204105 - DNA, 716 bp, Homo sapiens
  misc_feature: GYAE6OF02HYYME.24.85.H08.1.454.CMB.1.raw
  modified_base (393)..(393): a, c, t, g, unknown or other
  misc_feature (393)..(393): n is a, c, g, or t
  modified_base (597)..(597): a, c, t, g, unknown or other
  misc_feature (597)..(597): n is a, c, g, or t
tcagactactatgtcacgaccggtgctcgatttagtatcactcagtcgcgggaggacgctgaccacacggtacgtgctgttgtactgctcctcccgcggtcttgtcttggcattatgcacctccaccgcgtccacgtaccagttcgaacttgacctcgtaggtccttcgtggctcacgtcaccaccacgctatggtgacctcgacgggttcccctgaagtcctcttccgtgtcggccgacgtccttcgtaggttacttccgcctttacaaacttaactttcggtagtactcgacttaaccgtcgggtaccctaccgaacgccgtaacccggaggggtacggtcttaggtaagttcggtactacgacgttaagtaactagtttcgagtagggtntacgtcgtacactattagtcgacgtccgtacgtaggacggtctactacacgtactctacacggactaacgaccggtaacccgaagtaaaccaacgtaccgttagttaacctacgttacgaaactaaagtcggaacgtcgtaacgtaccgttaacgaaacggcccgtaaacgccggtacgtaccttacggtactttaacttacgngtaaccgtcggaacggacgggttcaacggtctaaacgttcgttaacccttacctaccggacgttagtaggtaaccggtttaccggcgttaaccggggtacgtacgggtaccctaccggg

SEQ ID NO: 204106 - DNA, 866 bp, Homo sapiens
  misc_feature: GYAE6OF02GARM7.24.85.H08.1.454.CMB.1.raw
  modified_base (243)..(243): a, c, t, g, unknown or other
  misc_feature (243)..(243): n is a, c, g, or t
tcagactactatgtcacgaccggtgctcgatttagtatcactcagtcgcgggggagccccagccctgggattcccagctgttctgcttgctgatcaggactgcacacagagaactcaccagtggtagtttgggctgagtcttgggttttccttgttgcttaagttttaaaaggtgtcctagtgtggaggtgcagcgtgggtcggacggtccggggagtcgttagtcaggccggtggggtcccngagactcgtcctgtgcacgtcctcgtggtacttaccgtccttaacgtaaacttaaccgtttcgtacggtagtcgaccgtacggttcgggtaccccgacccgaacgtcccgttaaccggaacggggtaagggtcgttacggttagttttccgggtacttaccgtaacgttaaacgtttaaacgtagttacggttaaggtacgggtaacgtacggtacccttaccgaaccgtaacgttaacggtccggtaaccggtaccgttaccgggaacgggttaaccggggaccttaaccgtaaccgtaccgtacccgttaacgtaacccggaggtaaaacccgaaccgaaaccggtaacccgaaaccggaaaaccgtaaccgttaaccggtacgttaacgttaaccgtaagtaaacccgtaaaggtaccggtaaacggaaccgtaaccgggtaacccgttaacggaaaccgggtaccccgaaccggtaacgggaaccgtttaccgtacgttaacgttaaccgttacggtacgtaacggtaacgggaaaccgggtacgggacctaacggaccctttaaacgtcccgttaacccgttaacgtacccggttcccttacggtagtaaccccgggg

SEQ ID NO: 204107 - DNA, 592 bp, Homo sapiens
  misc_feature: GYAE6OF02GQ5PP.24.85.H08.1.454.CMB.1.raw
  modified_base (280)..(280): a, c, t, g, unknown or other
  misc_feature (280)..(280): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcacgcctcgtggtacttccgccttacaacttaacttcgtggatgctacgtcgggcccnccaagcctccgaggggaacgggtctgagtttgggctacacgttaattactagttgagtgggtatagctacacgatagtcgcgtactcggtaggacggctactcacctatccacgagacgaaccgaaccgacaacgaacacactagtactctagacaaagcgacgctacgacgtaagaaccgccgaacgacgacgtcgtagtcgttagttcgagtcgaacggaagggacgggaccagtactacgttaccgtcctactccgtccgtactacggtcggtaccggtcggaccgggaccgtacggacccggtaccgg

SEQ ID NO: 204108 - DNA, 694 bp, Homo sapiens
  misc_feature: GYAE6OF02GV1T9.24.85.H08.1.454.CMB.1.raw
  modified_base (526)..(526): a, c, t, g, unknown or other
  misc_feature (526)..(526): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcgagggtcttcgtggcctcacgtccaccaccgacgcatgtacgacctcgacggggtccctagagtacctccgtcctgtgcagtccctgtggtattccgtccttactaaacttaccttcgtacggattcgaccctaacggtttccggggacccaaccgtaacgtaccgtaccgggtaagggggaacgggtccttaggttaaggttttcgggaccttacgacgtttaattaactgttacggtagtgggtacgtacgtctcgtaactaagtgtcggcccggtactccgggaaggtacggtaccgtatccaacctgtccaaccgagtaaccgaaccgaccgaccgaaactaaacgctaactcgtactaccgtaanaacgtaagtcgaacgtacacggtaacttaacggaacctacccggaactaaccggccgtactacgttagtattcggtagcgtaacggaggtacgggataccggctaacgttcctaactactcctacggtactggtacggccgttaggacccggagaccggcggtaaccg

SEQ ID NO: 204109 - DNA, 776 bp, Homo sapiens
  misc_feature: GYAE6OF02JBG7X.24.85.H08.1.454.CMB.1.raw
  modified_base (213)..(213): a, c, t, g, unknown or other
  misc_feature (213)..(213): n is a, c, g, or t
  modified_base (256)..(256): a, c, t, g, unknown or other
  misc_feature (256)..(256): n is a, c, g, or t
  modified_base (515)..(515): a, c, t, g, unknown or other
  misc_feature (515)..(515): n is a, c, g, or t
  modified_base (522)..(522): a, c, t, g, unknown or other
  misc_feature (522)..(522): n is a, c, g, or t
  modified_base (621)..(621): a, c, t, g, unknown or other
  misc_feature (621)..(621): n is a, c, g, or t
  modified_base (660)..(660): a, c, t, g, unknown or other
  misc_feature (660)..(660): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcgagggtcttcgtgctcacgtccaccaccacgcagtgtacgacctcgacggggtcccngacgactcctcctgtgctacgcctctggaacttccgcctttanaaattacttcgtggactgacctcgtcgggcccaccaagccgtaccggaaggggaacgggtctggttacgtttcgggtcctacgttaacggttaacttaacgtagtttggaacgttggggaacgttctctaccaacgtacttagcggtaccggtaccgtccgtagggaaccggtccttaacgttaccaaccgttacgtacctaccgaagaaccgtacgaaaccggtccaaaagaaaacccctagtaccggtaatttaacncggttanaaaaccgtttaaagaacggacggaacctaccggttaacgtaaacggaaaccgtccggaacaaccgggtcgttaacgttcggttaacgtttacgttaacnggggttaaccgaaacgggtaacggggtaccccgggtaanaccgttacgttaaccgtaacccgttaaccggttacctacccggtacccgtacggttacggttacccgggtacggtccggtaacccggggaaacgtacccgggttacccggtaccgg

SEQ ID NO: 204110 - DNA, 903 bp, Homo sapiens
  misc_feature: GYAE6OF02F0VC7.24.85.H08.1.454.CMB.1.raw
tcagactactatgtcacgaccggtgctcgatttagtatcactcagtcgcgggggagccccagccctgggattcccagctgtttctgcttgctgatcaggactgcacacagagaactcaccatggtagtttgggctgagcgttgggttttcttgttgtacttaattttaaaaggtgtccgagtgtggaggtgcgagtcgtgggtggagggtccgggggaggtcgtttagttcgacggtccggttcgggggtccctaggacgacctctccgtgtacgcgacgtccgtcgtggtacgttccgtacctttactaaacttaaccgtttcgtaggtacgttcgtaccgtacggttccgggttaccccgaccgaaacgtcccgtaccgggaaggggggtaaccgggtcgtttaggttacggtttcgggttacccttacgttaaccgtttaactttaacgttacggtttaggtaaggttaggggtaacttacgtaccgttaccgtaaacttaaccggttaagtaccgggtaccggttaacccggtttaccgggtacgggaaaccggggttacccgttaaaccgttaccccgaaccgttacctttaccgaacccgaaacggtaaccgaaaaccccgtaaccgaaacccgaaacgaaaaaccgtaccgttacgtacgtttaaccgtacgttaaccgaaacgtaaacgtacgggaaccgtaacgaccgtaccgtaaccggaaaccgggtacccgaacggtaccggtaacggttaccgttacgttaacggtttaaccggtacgttacgggtaaccggaggggtaaaccgggacggggtaacctacggttaacctttacccgttaccggtttacccctaaccgttacccgttaccgttaggttacggttacccggg

SEQ ID NO: 204111 - DNA, 809 bp, Homo sapiens
  misc_feature: GYAE6OF02HB7RP.24.85.H08.1.454.CMB.1.raw
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcgaggggtccctgagactctccgtgtgcacgcctctgggtacttccgtcccttacaacttaaccttcgtggatcggcctacgtcgggtcccgacctaacgccgtaccggagggggaagggtcctaggtacgttttcggggtccttaccgtaacgttaacgtttaaccgtagtttacggaaggtaggggtaacgttagacccgttactaaccgtaacgttaacgtcgggtaccggtaaccgtccgggtttagggaaccggggtacccgtacgttacctaccctacgttaccctacccgaaagggaccgtaaacccgaaccggaacccgtaaagaaacccgtaacgtaccttagttactaccgtagaacgtaaagtcgaaacgcgtaaacgaccgtaaggaaaccgtccggaaaccgtacgacggtccgtttaggttacggttaacttccggttaggtaaccgggtacggtaaacggggacggggaccccgtaagtaccgttaacctttacccgtacccgtttaaccgtacccggttacccgttacgtaaccgggttcggtaacccgggttgggtaacccggggtaaccgtaacccgggggacgttaacccggg

SEQ ID NO: 204112 - DNA, 824 bp, Homo sapiens
  misc_feature: GYAE6OF02HJ16H.24.85.H08.1.454.CMB.1.raw
  modified_base (600)..(600): a, c, t, g, unknown or other
  misc_feature (600)..(600): n is a, c, g, or t
tcagactactatgtcacgaccggtgctcgatttagtatcactcagtcgcgggaggacgctgaccacacggtacgtgctgttgtactgctcctcccggcggtctttgtcttggcattatgcacctccacgccgtccacgtaccagttgaacttgacctcagggttctcgtgctcacgtccaccacacgcatgtcgacctcgacggggtccctgagaccttctccgtgtcgcctacggcctcgttgggtaacttccgtcctttacaaattaccgtttcgtggtactcgtacctacggtacggggtccccgaccccgtaaggtacccgttaacccgggaaggggggtaacgggggtcttacgggtagttttccgggggtcctaccggtaacgtttaacgttaaaaccgttagtttacgggaaggttacggggtaacgttacggtcccttaaccggtaacctaaccgttacggtcggaacccggttaccgtccgggtaacgggaacggtacccgtacttaccgccttaacgtaccctaaccgaggtaaacgtaccgtaaacgacccgtaaacggaaaccctaacgtactaacgtactaccgtanaccgtaaaagcgtacggctaaccggacgttaacggaaaccggacccaaacggtaccgacgtcgttaagtcgttaacgttaacggtgtacgtaacgaacgggaccgggtaacgtacgtaccgttaacgttcccgtaaccgtaccgtaaccgttccgtaaccgtttaagggtaccgggtaccgttacgggtacccgggaaccgggtaacggtaccccggtaacggg

SEQ ID NO: 204113 - DNA, 833 bp, Homo sapiens
  misc_feature: GYAE6OF02H6UIZ.24.85.H08.1.454.CMB.1.raw
tcagactactatgtcacgaccggtgctcgatttagtatcactcagtcgcgggggagccccagccctgggattcccagctgtttctgcttgctgatcaggactgcacacagagaactcaccagtggtagtttgggctgaggtcgtttgggtttttccttgttgtactttaaagttttaaaggtgtcctagtggtgaggtgcagtcgtgggtggacgggtcgggggagtgttacgtcgacggtccgggtcgggggtcctaggacgtaccttccgtccgtggtgacacgtacctcgttaggtcttccgtaccttactaacttaacgttgtagtacgtcgtcgacggtcggtaccgaaccgaacgtcccgtaacgggaacgggtacgggtcgtagtttacggtttcggaccgttacgtaacgttaacgtaaacgttgttaggtacgggttaggttaccgtacggtacccttgaaccgtaacgttacggtaccggacccggtttaccggttaccgggtaaggtaacccgggtcccgttaactacccgtaaacccgttcgttacccgtaacgaaaccggtaacccggtaaaccccaaaccggtaaaccgtaaaaccgaaaccgtaaccctaggttaaccgttaccttacccgaaggttaaacgtaaccggttaacgaccgtaaccgggttaacgaaccccgggttaaaggaacccggttacccggaaccgttaaccggtagttacggtacgttacgttaacttcggacgggtacgggtaacggacgggtaaccgctaacgtaccttcgtaccctacgtacctacgtctacggtggccgg

SEQ ID NO: 204114 - DNA, 732 bp, Homo sapiens
  misc_feature: GYAE6OF02G8FYZ.24.85.H08.1.454.CMB.1.raw
  modified_base (656)..(656): a, c, t, g, unknown or other
  misc_feature (656)..(656): n is a, c, g, or t
  modified_base (670)..(670): a, c, t, g, unknown or other
  misc_feature (670)..(670): n is a, c, g, or t
  modified_base (723)..(723): a, c, t, g, unknown or other
  misc_feature (723)..(723): n is a, c, g, or t
tcagactactatgtcacgaccggtgctcgatttagtatcactcagtcgcgggggagccccagccctgggattcccagctgtttctgcttgctgatcaggactgcacacagacgaactcaccatggtagtttgggctgagtcttgggttttccttgttgtcttaagttttaaaggtgtccagtggtgaggtgcagcgtgggtggaggtccggggggagtcttaggttccgaggtccggtggggggtccctggacgtacctctccgtgtcgctacgcctgtcggtacttccgtccttactaaacgttacctttcgtaggaacttgacctacggtcgggtacccgaccgaaggtcccgtaccggaagggggtacggggtacgtcggttaggttttcggggtcctaaccgtacggtttaaacttaaacgttagttacggtaggttacgggagttacgcctactaactacgtacgtcggtaccggtaccgtaccgggtacgaaaccggggtccttaccgttacctaaccgtactttccccgaacgtaaggaacccgaaaccgaaccgtaccctaaaacgaacctaccgtactcgttactacgtacgaactaaaggtcgaacgtacgcgtaaccgtaacgacggtaccacggtaacgcgttntacggttatacgtnttgacgacgggacgggacggacacgttactacgtccttactactaccgtcgtntacggtcgg

SEQ ID NO: 204115 - DNA, 883 bp, Homo sapiens
  misc_feature: GYAE6OF02I385W.24.85.H08.1.454.CMB.1.raw
tcagactactatgtcacgaccggtgctcgatttagtatcactcagtcgcgggggagccccagccctgggattcccagctgtttctgcttgctgatcaggactgcacacagagaactcaccatggagtttgggctgagcttgggttttccttgttgcttaattttaaaaggtgtccagtgtggaggtgcagtcgtgggtggacggtccggggagtcgttagttcgagtccggtcgggggtccctggtacgaccttccgtccgtgtgccacgtcccgtcgtaggtactttccggtaccttaccgtaaattaaccgttccgtagggtacttcggccgtaaccggttcggggtaccccgaccctaaacggtccgttacccggggtaaaggggggtaacggggtcgttagggtaacggttttcgggggtcccttaccggtaaacccgttttaaagtttaaaacccgttagtttacgggtaaggtagggggtaaaccgtttacggtacccttacccggtaaacctaacccggttaacggtccggtaacccggggtaacccgttcccgggggtaacgggtaaacccgggggtacccgttacctttacccgaaacccgttacgttccgtaacccggtaacggaaaccgaaaccgaaaccgtaacccgaaacgaaacccgaacgtaaccgttacgttacgtacgtacgtacaaacgtcgtaacgacgaaccgaccggtaacgaaacccggaccgtaacgaccggtaccggacgttagttaacgttacttacgttacgtcggaacggtaacggtacggggacctacggtacctaaccgttaacccgttacccgttaacccgtacggttacccgtaccgttacggtaacccggg

SEQ ID NO: 204116 - DNA, 766 bp, Homo sapiens
  misc_feature: GYAE6OF02GSPN0.24.85.H08.1.454.CMB.1.raw
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtcgacctcgacggggtccctggacgtacctcctcctgtcgccacgtccctcgtggtacttccgtcctttacaaacttacgtttcgtaggtactcgcctacggtcgggtcccgaccaaacgtccgtaccggaagggggtacgggtcgtaggttacggtttcggggtccttacggtaaaccggtttaacttaaacgtagtttcggaaggttggggaagtacggtcctaccgtaactaccgtaggtacggtaccggtaccgtccggtaagggtaacggggtaccgtacttaccgaaccgtactccctaaccgtaacggaacgaacccgtaaacgaccgtaaacgaaacctacgtacctagtacctagtagaactaaagtcgaacgtaccgaacgtacccggtaaggaaaccggtccgaaccgaaccgggacgtttggtacggttttagttaccgtttaccggtcggtaacgggaacgacggggaaccgggacctacggtacttaccgtaccttacccgtaactaccgtccttagtagtcgggtccgtacggacgggacccggacgggtaccgtaccgg

SEQ ID NO: 204117 - DNA, 677 bp, Homo sapiens
  misc_feature: GYAE6OF02H68RH.24.85.H08.1.454.CMB.1.raw
  modified_base (242)..(242): a, c, t, g, unknown or other
  misc_feature (242)..(242): n is a, c, g, or t
  modified_base (258)..(258): a, c, t, g, unknown or other
  misc_feature (258)..(258): n is a, c, g, or t
tcagactactatgtcacgaccggtgctcgatttagtatcactcagtcgcgggaggacgctgaccacacggtaccgtgctgttgtactgctcctcccgcggctttgtcttggcattatgcacctcacgccgtccacgtaccagttgaacttgacctcagggtcttcgtggctcacgtccaccacacgcatgtgacctcgaggggtccctgagactctcctgtgcagcctctggattcgccttnaatacttctggatgcnctcgggtccgccaagctccgagggggaagggtctgtagtttggggtcctaccgtaagttaacttaactgtttgaggtcgggaagtacgcttcgacacgttatggccggtacctcggtaggaacgggtccgtattccaaccgtatcctaccgaggaacgtaaccaaccgaccaaacgaaaccgacctaacgttcgtaatcgagtacaaatgacgcgacgacgtacgaaacggccgaacgtaaccgacggccgttagtgttaacgttaccgtggtaacggaccgaagggaaccgggggtacacgtacgtaacgtttaaccctcccttaaccgttaccgtacccggtacgttaacggttacgggtaccggttccgggttaccggggaaccggttaacccggggggtacccgtaacccggggg

SEQ ID NO: 204118 - DNA, 808 bp, Homo sapiens
  misc_feature: GYAE6OF02HDVOI.24.85.H08.1.454.CMB.1.raw
tcagactactatgtcacgaccggtgctcgatttagtatcactcagtcgcgggggagccccagccctgggattcccagctgtttctgcttgctgatcaggactgcacacagagtaactcaccagtggtagtttgggctgagtcgttgggttttacccttgttagtctttaaagttttaaaaggtcgtacctaggttgcggtaaggtgcgtagtcgtagggtagggtcggtaccgggggtagtctttagttccgaggtcccgggttggggtcccctaggtacgtacccttccgttcgtcggtcgactaccgttccgttacgtacggttaccttccgtaccgtttaaccgtaaacgttttaaccgttcggttagggaaccttgtaacccgttccgggttacgggtaccccaaccggtaaacgtcccggttaacgggacggggtaaggtacccgttggttacggtttcgtacccgtaacgtaaacggtttaacttaagtacgtttaggaaggttacgggtacctcggtaccttaaccggaactttacggtaacggtcccggaccggttaccgtaccgggtagggaaccggtacccttactcccgaacttacctaacgtcgaaccgtaaacgaccaaaccgtaccaaacgtaaccgactacgttagtacagtacaacgaatacgactacgacaggtaaccgaccgaacgccgtacacgtcgtattatccgtaagtccgtaagaaccggcggaacgacggtaccaacggtttacacccgttactaccctaccggtacgccgtacgttaaccggg

SEQ ID NO: 204119 - DNA, 686 bp, Homo sapiens
  misc_feature: GYAE6OF02G1HFM.24.85.H08.1.454.CMB.1.raw
  modified_base (382)..(382): a, c, t, g, unknown or other
  misc_feature (382)..(382): n is a, c, g, or t
  modified_base (485)..(485): a, c, t, g, unknown or other
  misc_feature (485)..(485): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagtgaacttgacctcagggttcttggtggtctcacgtccaccaccacgcatgtgacctcgaggggtccctgagactctctgtgcagctctggattccgccttacaacttaacgtcgtaggactgacgtacgtcgggtccggacctaagctacggagggggaacgggtcgtaggtagtttcgggtctacggacgttaagttaacgtattaggtacgtaggggagttacgctacaactagtacnggaccggtacgtaccggtaggaaccggggtactacggttaccactactacctacgacgacgacctaaaccgaccaaagaaaccactacgtacgtataccgtanacgaaagtcgagactacgaccgttaacggaaacggaccctaacgggactaccggaggttaacgttaggtttaaactacggtggtacgtaaaggacggggtaaacggggacagtacgtaaccgttactcccgttaacctcggtaacctacgtaacggtttcgggacgttaccggtcggggaacccgagggtaccggtaccgg

SEQ ID NO: 204120 - DNA, 704 bp, Homo sapiens
  misc_feature: GYAE6OF02F83AA.24.85.H08.1.454.CMB.1.raw
  modified_base (186)..(186): a, c, t, g, unknown or other
  misc_feature (186)..(186): n is a, c, g, or t
  modified_base (376)..(376): a, c, t, g, unknown or other
  misc_feature (376)..(376): n is a, c, g, or t
  modified_base (632)..(632): a, c, t, g, unknown or other
  misc_feature (632)..(632): n is a, c, g, or t
  modified_base (691)..(691): a, c, t, g, unknown or other
  misc_feature (691)..(691): n is a, c, g, or t
tcagactactatgtcacgaccggtgctcgatttagtatcactcagtcgcgggggagccccagccctgggattcccagctgtttctgcttgctgatcaggactgcacacagagaactcaccatggagtttgggctgagcttgggttttccttgttgctaattttaaaaggtgtccagtgtgaggtgnagcgtggtggagtccggggagcttagttcagccgtgggggtcctgacgactctcctgtgcacgccgtcgtaggtattccgccttacaataccttctggtatcgactacggtcgggtcccaccgaacgtcctaccgggaaggggacgggtcttggtaggttttcgggtactccgtaacgttaatttaacgngtttaggagttacggggagttacgctaccaacgtacgttagtggacccggtacgtaccggtaggaaaccgggtccgtaacttacccgaaccttctacccaccgtaaggaacgtaaccgtaaaccgtaccgaaacgaaacctacgtaactacgttacgtaccgtagaaccgtaaaagtcggaacgaccgaacggtaccgtaacggaaacccggtacccggaacgaaccggtaccggtgtacgtttagtacttacggngtaccgaaggaacggggcggtaccagttaccgtacttcctaccgtaccgtacctaccgngttaacgtccggg

SEQ ID NO: 204121 - DNA, 887 bp, Homo sapiens
  misc_feature: GYAE6OF02GO1ZA.24.85.H08.1.454.CMB.1.raw
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggttcttcgtggctcacgtccaccaccacgcatgtgacctcgacggggtccctgagacctctcctgtcgcacgcctcgtggattccgccttacaattaacttcgtggtattgacctacgtcggttcccgaccgaacgccgtaccggaacggggtaagggtccgttaggttaacgtttcggggtacctacggttaaacggttaactttaacgtagttttaaggaggtttacggggaacgttaggtaccttaacgaacccgtaacgtaacggttcggaacccggttaccggttacccggttaacggggaaaaccgggtcccggttaactttacccgaaccgttacttacccgtaccgaacggaaccgaaaccgaaccgtaaccgaaaccgaaaccacgtaacctttagttaaccgttaccaagtaaacccgtaaaggttcggaaaccgtacggtaaccgtacccgggtaaaacggtaaacccggaccgtaaacccggtaaccggtaccgggtcgttaacggtttaacgtttaaccggttttaacggttaacggacgggttaaacccggaacggggttaacccgggggacctaacgggtacctttaccgtttaaacccgggttaccctttaacccgttacccggttacccgtaccgtttaaccgggcggtttaacccgggtaccgggttacgggggaaaccccggttacccggggtaacccggttacccggg

SEQ ID NO: 204122 - DNA, 802 bp, Homo sapiens
  misc_feature: GYAE6OF02IIE7O.24.85.H08.1.454.CMB.1.raw
  modified_base (440)..(440): a, c, t, g, unknown or other
  misc_feature (440)..(440): n is a, c, g, or t
  modified_base (683)..(683): a, c, t, g, unknown or other
  misc_feature (683)..(683): n is a, c, g, or t
  modified_base (746)..(746): a, c, t, g, unknown or other
  misc_feature (746)..(746): n is a, c, g, or t
  modified_base (755)..(755): a, c, t, g, unknown or other
  misc_feature (755)..(755): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttagaacttcgaccctcgtagggttcttcgtcggctccacgtcccaccaccacgcatgtcgacctcgacggggtccctagacgtacctctccgtgtcgccaccgtccttcgtagggtacttccgtacctttacctaaagttaacctttcgtacgggtactcggtaccgtaccggttccggggtaccccgtaccgtaacggtacccggtcccgggtaaaggggggaacgggggttccttagggttacgggtttccggttaccgttaaccgttaacgttaaacttaacgtaggtttaggngggtaagggtataccggtcctacctacgttactcggtacggtcggtaccggtacggtaaggggaccggtccgttaacctaccgactaccgtaaccgcgtaaacgggacccaaccgaacccgtacgaaactaaacctacccgtaattacggtaactttacgaaccgaacgttaacgtaacgaccgggtattaaacccggtacgaaaggggaaacccctacgaaccgggaccgtcggtaccgttntacgggttactggtagacggtaacgggacgacgggacagtacttacctccgtacgtccgtacnccggttaanccggttcggaccggtcgggtaaccgggacggtcccggtacggtcccg

SEQ ID NO: 204123 - DNA, 793 bp, Homo sapiens
  misc_feature: GYAE6OF02I4JUY.24.85.H08.1.454.CMB.1.raw
  modified_base (525)..(525): a, c, t, g, unknown or other
  misc_feature (525)..(525): n is a, c, g, or t
tcagactactatgtcacgaccggtgctcgatttagtatcactcagtcgcgggggagccccagccctgggattcccagctgtttctgcttgctgatcaggactgcacacagagaactcaccatgggagtttgggctgagcgttgggttttccttgttgcttaagttttaaaggtgtcctagtgtgaggtgcagctgggtggtacggtccgggggtagtcgttacggtcgacggtccggtcggggggtccctgggacgtaccgttccgtcccgtggtcgccgtacgtcctcgtggtacttccgccttacaattacttcgtgtagtcgtccgtagtccgggtcccgtaccgaacggtcccgtaccggaagggggtaacggggtccgtagggttacggttttacgggtccgttaccggtaaccgtttacttaacgtaggttacgtaggtagggtagtacgtccgtacgaacctacgtagtacgaccggtacgtaccgtagggtaaccggtacccgtcgtaccgtaaccnctttaccccgtagtaacgtaacgaaacccgaaccacccgtaaaagaaacccctagacccgttatacgtacgtacgtaacaaacggtactaaccgacgaacccgtacgtaacgggaaaccccgtacggaacggtacccggacgttccggtagttaccgtaacgttcgtacggtacggtaaccgggaacggggtacgggaaccctaaggtacccttacttcccgttaaacccccttggacccccggtttacaccggtttaccggtccggg

SEQ ID NO: 204124 - DNA, 857 bp, Homo sapiens
  misc_feature: GYAE6OF02G0YN3.24.85.H08.1.454.CMB.1.raw
tcagactactatgtcacgaccggtgctcgatttagtatcactcagtcgcgggaggacgctgaccacacggtacgtgctgttgtactgctccctcccgcggtctttgtcttggcattatgcacctccaccgccgtccacgtaccagttgaacttgacctgtaggtcttcgtggctcacgtccaccaccacgcatgtcaccgttcgaccgggtcctggacgacttctccgtgtcgcgtacgtcccgtacgtacggttctccgtccttaacgtaacttaacttcgtcggacttcggaccgtacggttccgggtaccgacccgtacgcccgtaaccgggaagggggtacgggtacgttagggtttacggttttccgggtaccttaccggtaaacggtttaaacgttttaaacggtacgttttaggggacggttacgggttaaagtacggtacctaccgttaaacgtacgttacgtaccggtaaccggtacccggttacggaacgggtaacccgggttacctaacgttaacccgaccttacgtacccgtaaccgaggtaaaccgaaccaaccgtaaccgaaacgtaaacccgtaaccgtacgtacgttacgtaaccggttaacgtaccgtaaaggtacgaacccgtacggaaccgtaaccggtaaacggaacccggacccgtaaccggaccggttacgtacgtagtttacgttacgtacggtaggttaccggacgggtacggaaccgggtaccgacgtcgtttaccgtaaccgttaccttaccgtacccgttccggttacggttacggtcccggttacgggtcccggtaaccgggtaccggtacgggtacccgtaccccggg

SEQ ID NO: 204125 - DNA, 731 bp, Homo sapiens
  misc_feature: GYAE6OF02I7VMP.24.85.H08.1.454.CMB.1.raw
  modified_base (275)..(275): a, c, t, g, unknown or other
  misc_feature (275)..(275): n is a, c, g, or t
  modified_base (487)..(487): a, c, t, g, unknown or other
  misc_feature (487)..(487): n is a, c, g, or t
  modified_base (623)..(623): a, c, t, g, unknown or other
  misc_feature (623)..(623): n is a, c, g, or t
  modified_base (653)..(653): a, c, t, g, unknown or other
  misc_feature (653)..(653): n is a, c, g, or t
  modified_base (666)..(666): a, c, t, g, unknown or other
  misc_feature (666)..(666): n is a, c, g, or t
  modified_base (672)..(672): a, c, t, g, unknown or other
  misc_feature (672)..(672): n is a, c, g, or t
tcagactactatgtcacgaccggtgctcgatttagtatcactcagtcgcgggggagccccagccctgggacttcccagctgtttctgcttgctgatcaggctgcacacagagactcgaccatggtagtttgggctgagcgtttgggttttccttgttagtctttaaagtttttaaaaggtcgtccgtaggttgtggtaggttcgcgacgtcggttgggtggacgggttcccggggggagtcctttaggtcgtacggtccggttgggggtaccccnggttacggacttccgtcgttcgagccgtacgtccgtccggttggtacctttcccggtcctttaaccgtaaaacgtttccttcggttaggtaacgtcgtccgtacggttccggggtacccgaccgtacgtcccgaaccgggtaggggacggttccgtaggtcgtttacggcctttacgtaacgtacttacgtaggttcgaggttgacggtacncgtacactacgtaggcgtacgtcgttacggtaggtaccgggacttacgttaccgacgtcttaccggtcaacggtacgaaaccggtaccgaaccgtaagtaaacctacggtaccttagacctacgtcgtaacgtacncgtaagcctagcgacgtacgaccgtcgacncggtctagttcgnttccgngttacggcggacggtacgcacgtcgtagccttacgccgttgaccgtactcggtaaccgg

SEQ ID NO: 204126 - DNA, 806 bp, Homo sapiens
  misc_feature: GYAE6OF02HBZC9.24.85.H08.1.454.CMB.1.raw
  modified_base (167)..(167): a, c, t, g, unknown or other
  misc_feature (167)..(167): n is a, c, g, or t
tcagactactatgtcacgaccggtgctcgatttagtatcactcagtcggcgggaggacgctgaccacacggtacgtgctgttgtactgctcctcccgcggtcttgtcttggcattatgcacctccacgccgtccacgtaccagttgacttgacctcagggtcttcgngctcacgtccaccaccacgtcatgtcgacctcgacggggtccctgacgtacctctccgtgtgccacgtccctagtgggtacttccgtacccttataaacttaaccttcgtaggaacgtcgaccgtaccggtacggggtccccgaacctaagccccgtacccggggtaaggggggtacggggcttacggttaaggttttccgggggttacctacggtaaccgttaattaacctaaggtttggtaaggtaggggtaacgtacgactaccgtaacctaagtacggtacggtacccggtaaccgtcggtaacgggtaaccggtcccttaagttacccaccgttactcccggaacctaggaaccgaaccgaacccgaaccgaaaccggtaaaccaaacgtaacttaacgtaacgtccgtaaccgtaaagtaaggtaaccgacggtaacaccggtacgtaaccggaacccgggtaaccgaccggtaacccggtacggtcggttacgttacggtttaaccgttacggtacggaccggtaacggaaaggggtaccggacgtactacgttaacttaccgtacctaccgttacccgacgttagagtcccggtagtaccgggaacggaccggttaaccggccggtaccgg

SEQ ID NO: 204127 - DNA, 888 bp, Homo sapiens
  misc_feature: GYAE6OF02JCQEE.24.85.H08.1.454.CMB.1.raw
tcagactactatgtcacgaccggtgctcgatttagtatcactcagtcgcgggaggacgctgaccacacggtacgtgctgttgtactgctcctcccgcggctttgtcttggcattatgcacctccacgcccgtccacgtaccagttgaacttgacctcgagggtcttcggtggctcaccgtccaaccaccacgcatgtagaccctcgacggggtccctggacgacctctcctgtcgaccacgtccttcgtggtacttccgtacctttacaaattacctttcgtaggattcgccacggttcgggtcccaaccgaacgtcccttaaccgggaagggggtacgggtcgttacggttaacggttttcgggtacccttaacgttaccggttaaatttaaccggtagtttacggaacggttaccgggggtaaggttaacgtcccgtttaccgaaacgttaaccgttacggtaccggtacccgggttaccgttaccccggggttaaggggtaaacccggggtaacccgtttaactttaaccccgaaacccgttaccgtttaacccgtaccccggtaaacgggaaaccggtaaaaccccgaaaacccgaccctaaaaaccgggtaaaacccaccgtaaacgtttaaggtaaccctttagtaaacgaaacgttaaaagtccggaaagttaaccgaccgggtaacccgttaaacgggaaccgaacccggtacgaaccgtccgggtagttgtaaccgttttagtaccgtcgtaacggtaacggacggggccgggaactaccgtacgttaaccgttccgttaacctaccgtccctacgtacgtaccggttacgggtcggtaaccgggtccgggaaaacccggggtagtcccggtacccggg

SEQ ID NO: 204128 - DNA, 713 bp, Homo sapiens
  misc_feature: GYAE6OF02JODQG.24.85.H08.1.454.CMB.1.raw
  modified_base (225)..(225): a, c, t, g, unknown or other
  misc_feature (225)..(225): n is a, c, g, or t
  modified_base (298)..(298): a, c, t, g, unknown or other
  misc_feature (298)..(298): n is a, c, g, or t
  modified_base (404)..(404): a, c, t, g, unknown or other
  misc_feature (404)..(404): n is a, c, g, or t
  modified_base (422)..(422): a, c, t, g, unknown or other
  misc_feature (422)..(422): n is a, c, g, or t
tcagactactatgtcacgaccggtgctcgatttagtatcactcagtcggcgggggagccccagccctgggacttcccagctgtttctgcttgctgatcaggactgcacacagagaactcaccagtggtagttggctgagtcgttggttttccgttgtgtcgttaagtttaaagtgtccgagtgtgaggtgcagtgtggtggacgggtcggggagtcgttagtcgnggccggttcggggtacctgacgtcttccgtcgtagtgctcgtaccgtgttaggtaccgttcgttacccttaanaactttaaccgtgtaggtattcgacgtccggtcggaccctaccgaacgtcgacggaaccggggtgtacgttaggtcggttcggtacaccgttattacgtaaacgtnttacggagttaggtaacncgtactacgtgtaacgtcggtcgtacggtcccgtagggtacggaccggttaccgtcgtacccgttaacgtacgttacccgacgtaacgtaacggaaccgtaaccgtaccgaaaagtacctaacggtactacggttacactagtaacaacgagcgacgacctacgacgtacgaccgtaccgtagtaccgagttcacgtttgacgttacgacgtacgggaacgggtaccgtaccgtagtaccccttaagttccccgtaaccgttaccgtaccgtacgttacggttaccgtcgg

SEQ ID NO: 204129 - DNA, 1043 bp, Homo sapiens
  misc_feature: GYAE6OF02G8NIF.24.85.H08.1.454.CMB.1.raw
tcagactactatgtcacgaccggtgctcgatttagtatcactcagtcgcgggaggacgctgaccacacggtacgtgctgttgtactgcctcctcccgcggctttgtcttggcattatgcacctccacgccgtccacgtaccagttgacttgacctcagggtcttcgtggctcacgtccaccaccacgcatgtcgaccctcgacggggtccctgacgactcctccgtggtgccacgtcccttcgtgggtacttccggtccctttacaaacttaaccgtttcgtgggacttcggcctacggttcggggtccccgaccgaacggtcccgtaccggaaggggggaacggggtcttaggttacggtttttcggggtccttaccgtaacggtttaattaaaccgtagtttcgggtaaggtacggggtaagtacggcctaccgaaccgtaacgttagcggtacccggtaccgttacgggtagggaaccggggtcccttaagttacccgaaccctacgttacccgtacccgaaaggtaacccggaaaccctaaacccgggacccaaaaaacgggtaaaaccccctaaccgtttaaacccgttttacgggtttaaaccgttttaccccgggtaaaacggtaaaacccttaaaaaacggggttacccgggaacggacccggtaaaaacccgggttacccccgtttaaaaaggggaaaaccccggggaaaccccccgggtaacccggtaaaaccgggtccccggggggtttacttttaacggggggtttttaaacccttttaaacccgttttttaggggaacgggggtttaacccgggaaaaccggggaaaaacgggggggttcccgggggaaaccccttaggggtaaccctttttaaaacccgtttccccggttttaaaccccccgttaaaccgtccccggttacccgggttaaccgtttaacggggttacccgggggttttaccccggttaccgggggtaccgggggtaaaaccccgggggtaaaccgggggttaccccgttaacccggggg

SEQ ID NO: 204130 - DNA, 751 bp, Homo sapiens
  misc_feature: GYAE6OF02IWVHA.24.85.H08.1.454.CMB.1.raw
  modified_base (402)..(402): a, c, t, g, unknown or other
  misc_feature (402)..(402): n is a, c, g, or t
  modified_base (474)..(474): a, c, t, g, unknown or other
  misc_feature (474)..(474): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgcgtccacgtaccagttgaacttgacctcgagggtcttcgtggctcacgtccaccaccacgcatgtcgacctcgtacggggtccctggacgtaccttcctccgtagtcggaccacggtccctgttcgggtacttccgtcccttacgaaacttaaccttcgtacggtattcggcctacggttcgggtaccccgacctaagcccgtacggaggggaacggggtctggtacgtttcgggctacgtacgttaactaacgtagttggagttgggaacgtcncctacactacgttagcggtaccgtacctcgggtaaggaaccgggtcctagttccaccgtatccacgaacganacccgaaacgccgtaaacgaaaccacgtaacttgtaacttcgtaataacgtaacgtcgaacgtctaacggtacgtaaccgaaccggacccgtaaacggacccgttacggtaccgttacggttagtttacgttacggtacggaccgaacgggtaacgggaaccggcttaacggtacctaaccgtttaacccgtaccttacccgttacgtacccgttacgttacgtacgggttaccggtccggtacccgggaacccgggtaccgggtacccgtaccggg

SEQ ID NO: 204131 - DNA, 806 bp, Homo sapiens
  misc_feature: GYAE6OF02JF3XV.24.85.H08.1.454.CMB.1.raw
  modified_base (346)..(346): a, c, t, g, unknown or other
  misc_feature (346)..(346): n is a, c, g, or t
  modified_base (383)..(383): a, c, t, g, unknown or other
  misc_feature (383)..(383): n is a, c, g, or t
tcagactactatgtcacgaccggtgctcgatttagtatcactcagtcgcgggaggacgctgacacacggtacgtgctgttgtactgctcctcccgcggcttgtcttggcatatgcacctccacgccgtccacgtaccagtgactgcctcaggtctcgtggctcacgtccaccaccacgccatgcgtacctcgtacgggtccctgacggaccttctcccgtgtcgcacggtcctcgtcggtattccgcccctttcgaacttaaccgttctggatgccacgtcggtccgaccagcctcgaaggggaacgggtctagtaggtttcggtcgtactacggtaactaacgtnttaggaggtggaacggttagccttaccgactaacgtntacggccggtaatccgggtaacggacggggccttaacgttaccgaaccctgttacccgtaccggaaagtaccggaaccgtaaacccggacccaaaccggtaaacctaaccgaacccttaccgggtaacgtttaccgtaaccgtaaccgttaaacgtaaccggaacggtacccgttacggaaccccgttaacgggaaaccggaaccccggttaaccgacgtaaccgggtaccttccgggttaaagtttacccgtttagacccgggtttacgtaaaccggggtaacgggaccggggggtaacccacggtaccgttaaccgttttaccgtaacccgttacctttaacccggttcgtaaccgttagttaccgggtaccggttaccgggttaccggggtaaccggtaccggggaacccgttcccgggg

SEQ ID NO: 204132 - DNA, 803 bp, Homo sapiens
  misc_feature: GYAE6OF02GE9VC.24.85.H08.1.454.CMB.1.raw
tcagactactatgtcacgaccggtgctcgatttagtatcactcagtcggcgggaggacgctgaccacacggtacgtgctgttgtactgctcctcccgcggtctttgtcttggctattatcgcacctccacgccgtcccacgtaccagttcgaacttcgacctcgagggtcttcgtggctcacgtccaccaccacgcatgtacgacctcgacggggtccctagacgaccttccgtcctgtcgcacgtccgttcgtacggtacttccgtaccttacaaagttaacctttcgtacggtatcgaccgtacggttccggtacccgaccaacggtccgtaaccgggaagggggtaaccgggtgttaggttacggtttcgggttccctaacgttacgtttaaacttaacgtgtttagggtaaggttacgggtacgttacgtaccgttaccaaacgttaccgttacgccgggtaaccggtccgtaaccggggtacgggtaaccgggtaccgtaacttacccgaaacctaccggtaccctaaccgaacggaaccgtaaccgaacccgacgtaaaacgaacctacgttacgtattaacctgaaacgttaacgaagtcggaccgaacttacggaaccgaaacggggtaaccgcccgtaaaccgacggtacggttcgtagttacgttaacgttacgagggtccaaagggaccgggaccggtaccacgttaccctagtaccccgtcaaccctttcggacccgttagtacggtcggtaccccggtaggtaccgggaaccggtacgggtctacccggg

SEQ ID NO: 204133 - DNA, 388 bp, Homo sapiens
  misc_feature: GYAE6OF02GSAMA.24.85.H08.1.454.CMB.1.raw
  modified_base (185)..(185): a, c, t, g, unknown or other
  misc_feature (185)..(185): n is a, c, g, or t
  modified_base (226)..(226): a, c, t, g, unknown or other
  misc_feature (226)..(226): n is a, c, g, or t
  modified_base (231)..(231): a, c, t, g, unknown or other
  misc_feature (231)..(231): n is a, c, g, or t
  modified_base (318)..(388): a, c, t, g, unknown or other
  misc_feature (318)..(388): n is a, c, g, or t
tcagactactatgtcacgaccggtgctcgatttagtatcactcagtcgcgggaggacgctgaccacacggtacgtgctgttgtactgctcctcccgcggctttgtcttggcattatgcaccctccacgccgtccacgtaccagttgaacttgacctcagggtcttcgtgctcacgtccaccaccncgcatgtgacctcgaggggtccctgagactctcctgtgcancctcnggacttcgccttacaaatacttctaggatcgacacgttgggtccgtaccgaacgtctcccggaaggggaacgggggtcttaacgggnnnnnnnnnnnnnnnnnnnnnnnnnnnnnnnnnnnnnnnnnnnnnnnnnnnnnnnnnnnnnnnnnnnnnnn

SEQ ID NO: 204134 - DNA, 1002 bp, Homo sapiens
  misc_feature: GYAE6OF02I0Y14.24.85.H08.1.454.CMB.1.raw
  modified_base (282)..(282): a, c, t, g, unknown or other
  misc_feature (282)..(282): n is a, c, g, or t
  modified_base (302)..(302): a, c, t, g, unknown or other
  misc_feature (302)..(302): n is a, c, g, or t
tcagactactatgtcacgaccggtgctcgatttagtatcactcagtcggcgggggagccccagccctgggattcccagctgtttctgcttgctgatcaggactgcacacagagaactcaccatggagtttgggctgagcgttgggttttccttgttgcttaagttttaaaaggtgtccagtgtgagtgcagcgtggtggaggtcgggggagtcgttagttcgagccggtgggggtccctgagtctcctcctgtgctacgcctcgtggtcctttccgccttanaaacttaccgttcgttaggnttcgaccgtaccggtccggggtcccgaccgtaacggtccgtacccggggaacggggggtaacgggggtccgttagggtttacggtttacgggggtttacccttacttaaaccgggtttaaaccttttaaaccgttaagtttagggttaacgggttaaggggggttaacggttacgtaccccggttaactaaaccccggttaaactttaccgggttaccgggtacccgggttaacccggtttacccgggggtaaacggggtaaacccggggtcccggttaaaccgtttacccaaaccccgttacctttacccgaaccgttaaacgggaacccggtaaaccccgtaaacccgggaacccaaaaaaccgggtaaaaaccctaaacccggttacggtttaaaccttaaccgttaacccgtttacgttaaaaaccgtaaacggttacggggaaaccgaacccggttacggaacccgggttaaaaacgggaaacccccgggtaacccgggaaacccgtaaacccggtacggggtttccggtaaggtttaacccgtttaacctttaaccggggtgggttaaacggtaacccggggaacggggggtaaccggggtaaccctaagggttacccctttaaacggtttacccctttaacccggttaccccggttaaccctttccgggtaccggttacgggttaaccccggg

SEQ ID NO: 204135 - DNA, 683 bp, Homo sapiens
  misc_feature: GYAE6OF02G7K5W.24.85.H08.1.454.CMB.1.raw
tcagactactatgtcacgaccggtgctcgatttagtatcactcagtcgcgggggagccccagccctgggattcccagctgtttctgcttgctgatcaggactgcacacagagaactcaccatggagtttgggctgagctgggttttccttgttgctattttaaaaggtgtccagtgtgaggtgcagctggtggaggtccgggggagcttagtcagccgtgggggtccctgagactctcctgtcgcagcctcgtggacttccgccttacaattaacttcgtggatcgcgacgtcgggtcccgacaacgccgtacgaggggaagggctagtagtttgggtctcgaacgtattaactgttagagtgggtagtacgtcctacgactactagtcggacggtaccttcggaggaacgggaccgtacttaccacctatccgtaccaagtaccgaacaaccggaccaaacgaaaccacgtaaccgtgttaactcgtagtaactaaagtcgaacgacctacgtacccggtaaggaaaccggtacccgaacgggaacccgacgggttacctggtttaacgttacttaccggtaggtacggaacggtaacggggaaccggggtacctaacggtacgttaaccgtttacccgtaacccgttaccttaaccgtcccggttacttaggtacccgggg

SEQ ID NO: 204136 - DNA, 756 bp, Homo sapiens
  misc_feature: GYAE6OF02ITZ2B.24.85.H08.1.454.CMB.1.raw
  modified_base (265)..(265): a, c, t, g, unknown or other
  misc_feature (265)..(265): n is a, c, g, or t
tcagactactatgtcacgaccggtgctcgatttagtatcactcagtcgcgggaggacgctgaccacacggtacgtgctgttgtactgcctcctcccgcggtctttgtcttggcattatgcacctccacgccgtaccacgtacctagttgacttgacctcgagggtcttcgtgctcacgtccaccaccacgcatgtcaccgtcgacggggtcctgagcctctctgtgcacgtcctgtggtacttccgccttactaacttaccgttntggactcgtacctacggttcgggcccaccgtaacgccgtacgggaaggggacgggtcttaacggttggtttccgggtcttaaccgaacgtttaagtaaaccttgtttacggaagggtgggtaacttacggcttaccgaacgtacgttcggcggaccggttaaccgtacgggttaacgggaaccgggaccctttaactacccggaaccttaccgtaccgtacccggaagaaaccggaccaaacgggaccctaaaacggaaaccctacgtaaacgttcgtactttaacgtacggaaactaaacggcgaacgaccgtaccgtacgtaagaacccggacgaccgaacggtacgtcgttattagtacttacgtacgacgacggtaagggcgtaacctcgtacttaacggtccttaacccgtacctacgtttaccacggtttaacggtccgttacggttaccggacggggtaacccgtacgggaccgttaacccggg

SEQ ID NO: 204137 - DNA, 904 bp, Homo sapiens
  misc_feature: GYAE6OF02IVH7Z.24.85.H08.1.454.CMB.1.raw
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctgagggttccttcgtgctcacgtccaccaccacgcatgcgacctcgaggggtccctgagacctcctcctgtcgtcacgccttacgtcggtacttccggtaccttacaaacgttaacctttcgaggggtaacttcggtacctaacggtcgggtccccgaaccgtacggtcccgttaaccggaaggggggaacggggttctcgggtttaacgttttcggggttaccctacggttaaacccgttaaagttttaaccgtaggtttaggtaacggttacggggtaacgttacggtacttacccgtaaacttaaccgtagtaccgggccggttaacctaccgggttacgggaaccgggttcccgtaacttaccgtaccgtaaactttcccgaacgaacgggtacaaacccgggtaacgaaccgaaacgaaaccgtaacgtaaccgtttaagttaccgtaacgtaacgaaaccggttaaacgtaccgaaacggaccgttaaccgacccggttaacgaaacccggtacccggaaaccggtaccggtaacccggttacgtttaaccggttacgtttaccggttaacgttacggtaacgggaaaccggtaaacgggcccgggggtaaacacggtaccgttaaccgtttaacccggttaccgtaacccgttacccggttacgttaacccgttacggttaccgggttaccggtttaccgggaaccgggtttaacccgggaaacgggttcccggtaaaccggg

SEQ ID NO: 204138 - DNA, 749 bp, Homo sapiens
  misc_feature: GYAE6OF02H0YEJ.24.85.H08.1.454.CMB.1.raw
  modified_base (291)..(291): a, c, t, g, unknown or other
  misc_feature (291)..(291): n is a, c, g, or t
  modified_base (309)..(309): a, c, t, g, unknown or other
  misc_feature (309)..(309): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtacgacctcgaggggtccctgagtactctcctgtgcagtcctcgtggacttcgcctttacaattaacctttctaggactcgctacgtcgggccacgaacnccgtacgaggggacggtntggtacgttggctcgtaagtactactagttcgagttacggatagcctacgaacctgtactcggacgtaccgttcggtaacggaaccgggtccttaacgtaccaaccgtacgtttcccaaactacggaacctaacgaacccgtaaccaaagaaaccgtactaaccgttagtactacgactaacgaaacgtcggaacaccgtaccggtaaccgtaaaggaacccgtaaacggaccggaaaccgtaccggttacggttaacgtttaacgttaacggttttaccgtaggggtaccgaaacggttacggggaacccggggttctaacgggaccttaccggtttaacccgtacccgtttaaaccgccgttaaccggtccgttaaggttcccgggaaccggttacccgggtaagggggtaaccccacggggtaccccggttaacggg

SEQ ID NO: 204139 - DNA, 681 bp, Homo sapiens
  misc_feature: GYAE6OF02GFJP4.24.85.H08.1.454.CMB.1.raw
  modified_base (215)..(215): a, c, t, g, unknown or other
  misc_feature (215)..(215): n is a, c, g, or t
  modified_base (251)..(251): a, c, t, g, unknown or other
  misc_feature (251)..(251): n is a, c, g, or t
  modified_base (264)..(264): a, c, t, g, unknown or other
  misc_feature (264)..(264): n is a, c, g, or t
  modified_base (336)..(336): a, c, t, g, unknown or other
  misc_feature (336)..(336): n is a, c, g, or t
  modified_base (535)..(535): a, c, t, g, unknown or other
  misc_feature (535)..(535): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcgagggtcttcgtggctcacgtccaccaccacgcatgtcgacctcgaggggtccctgganactctcctgtagcagcctctggacttccgtccttanaattaactttcgnggatgccacggtcggtcccgacaagcctacgaggggacggtctgtagtttgggcctacgacgttattaactnttggtagtgggaatacgctacacgacttagtcgccggtactccgggtaggaaccgggcctattacgacctagtccgtaccaagaacggtaacccaacgggccaaagaaaaccgccctaagttcgtaacttctacggaaactaaagtcggacgaaccgtaggtaccgttaacgaaaccggcccgaacctaacggccggtnttaggttacgtttaactcggtgtacgaacggtaaaggggccggactagtaccttaacgtttacccgtccttaaccgtaccgttccgaacgttgtaccgggtaccggttacggttcggggaaacccgacgggtcccggttaaccggg

SEQ ID NO: 204140 - DNA, 683 bp, Homo sapiens
  misc_feature: GYAE6OF02GYMX7.24.85.H08.1.454.CMB.1.raw
tcagactactatgtcacgaccggtgctcgatttagtatcactcagtcgcgggggagccccagccctgggattcccagctgtttctgcttgctgatcaggactgcacacagagaactcaccatggagtttgggctgagctgggttttccttgttgctattttaaaggtgtccagtgtgaggtgcagctggtggaggtccgggggagcttagttcagccgtgggggtccctgacgactctcctgtgcacgcctcgtggtacttccgtccttactaacttaacttcgtggtagtcgccgtaccgtcgggtcccgaccgaacgtccgtaccggaggggaacggggcgtggtagtttcgggttccgtacgtaacgttaattaactagttagtatggggggggggggtatagtcctaccactactacgtcgtacggtaccgtaccggtacggtaacgggaccgtacgttaccaccgtactccgtaccgacgaacgaaccgaaccgaccgaaacgaaaccaactactacgtacttacgtacgacaaagtagagacgacgaccgtacgaaccgaccgaacgaccgaccggtacgtacgtagtacgttacgtagtacggtacggaacgggacgggtaccgaacgacgtaacgttaccttacctaccgttacccgtacgtacgtacgtaccgg

SEQ ID NO: 204141 - DNA, 806 bp, Homo sapiens
  misc_feature: GYAE6OF02IU37M.24.85.H08.1.454.CMB.1.raw
  modified_base (191)..(191): a, c, t, g, unknown or other
  misc_feature (191)..(191): n is a, c, g, or t
  modified_base (261)..(261): a, c, t, g, unknown or other
  misc_feature (261)..(261): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgactgacctcgaggtcttcgtggcctcacgtccaccacacgcatgtnaccgtcgacggggtccctgacgtacctctccgtgtcgccacggtccctcgtggtacttccgtacccttanaaactaaccgttcggatcgtcgaccttcggtccggaccaacgacgtcccgaacggggacgggtactaggtcgttttcggtccgtacgtacgttaacgttaacttacgtggtaggtacgggagtacgtccgtacgtaccaacgttcgtaacggccgtaccgtaccggtcggtaacgggacccggttactaccgtaccgtactacgttacccgaaggaccgtaaacgtaaccccgacgtaacggaaaccctacgtaaccgttacgttataaccgcgtaaagaaaccgtataccgggacctaacggtaccctaaaaggaacccggaacccgacggtacccgtaacggttcgttaacggttcgtttaaaccgtttacgcgggtttaacgaccggggttaaacgggaccggggttaaccgcgttaaacccggttactttaaacccgttcccgtttaaactcccggttaacccgtacggttacgtacccggttacgggttaccccggaggggtaacccggtaaacggggtcccccggaaggtttacccccg

SEQ ID NO: 204142 - DNA, 946 bp, Homo sapiens
  misc_feature: GYAE6OF02FVA3F.24.85.H08.1.454.CMB.1.raw
tcagactactatgtcacgaccggtgctcgatttagtatcactcagtcggcgggggagccccagccctgggattcccagctgtttctgcttgctgatcgacggactgcacacagagactcacctagtggtagtttgggctggagtcgttcgggtttttcttggttgtacttaagttttaaaacggtgtcctacgtggtgtaggtgtcagtcgtgggtggtacggtccgggggtagtcgttacgtcacggtccggtcgggggtacctaggacgtacgttccgtaccgttgtcgacgtaccgtccttacgtgggtacttccggtaccttaactaacgttaacttcgaggtacgtacggtacccgtaacgggttcgggtaccccggaaccctaagtccccgggtaaccgggtaacggggggtaccgggttacgttagggttacggttttcggtacctaaccgttaacggttactttaaaccgtaggtttaagggtaccggttagggaacgttaacggtcctaaccgtaaacggtaccgtttaagggtccggtaaaccgggttccgttaccggggtaacggggtacccggttaacccggtaactttaccccgaaccgtaacttcccgtaaacctaaacgggtaaccgtaaaccccggtaaaccggtaaacccaaaccggtaaaccgtaaccgttaaaccgtaacggttaacgttaccgttacgtaaaacggtaaccgttaggtaaactaccggtacggttaaccgtaacgggtaacccggtaacccggtaaccggtacgggttaccgtacgttaccgggttaattacccggttacgttcggtaaccgggtaacgggtaaccgggaaccgggtacggtaaacccgttacgttaacccggttacccttaaccggtacccgttacccggtacgttaccggtaccgttaccgggg

SEQ ID NO: 204143 - DNA, 801 bp, Homo sapiens
  misc_feature: GYAE6OF02I4ZSK.24.85.H08.1.454.CMB.1.raw
  modified_base (554)..(554): a, c, t, g, unknown or other
  misc_feature (554)..(554): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcgaggggtccctggagtacctctcccgtgtacgcgacgccttcgtcggactttccggtaccctttacaaacttaactttccgtaggattcggacctaccggtcgggtccccgacgaacggtccgtacccggaagggggacggggtccgtgttaacggttttgggggtaccttacgtaacggttaactttaactagtttacggaaggtggggtaattaacggccttactaaccgacttacgtcggtaccggtacgtaccggtaacggtacggggtacctacgtttaccaaccgttctacgtacccgaaggtaacaaccgaacgtaccaacgaaaccgaacctattacgtaatccgtanaccgtaagtacggaacgaccgaacgtacccgtaacgaaccggacccgaaacggaccgtacggtctacggtttattaaccgttcgtacgtacggacggtaaacgggacggggtaccacgtaccttaacgtttaccgttaacccccggttaccttaacgtcccggtttaccgttaacgggtacccgggttaaccggtccggggtaacccggggtaacccggttaaaccgggacccgggtttaacccggg

SEQ ID NO: 204144 - DNA, 745 bp, Homo sapiens
  misc_feature: GYAE6OF02I3N9T.24.85.H08.1.454.CMB.1.raw
  modified_base (227)..(227): a, c, t, g, unknown or other
  misc_feature (227)..(227): n is a, c, g, or t
  modified_base (597)..(597): a, c, t, g, unknown or other
  misc_feature (597)..(597): n is a, c, g, or t
tcagactactatgtcacgaccggtgctcgatttagtatcactcaggtcgcgggaggacgctgaccacacggtacgtgctgttgtactgctcctcccgcggtcttgtcttggcattatgcacctccacgtccgtccacgtaccagttgacttgacctcaggtcttcgtggctcacgtccaccaccacgcatgtcgactcgacggggtccctgacgtactctcctgtcncgacgcctctggtacttcgtccttcaacttaccttctaggtactgaccgtacgtcggtccgacctacgtcctccggaaggggaacggggtctacgggttagtttcggggtccttaccgtaacggttaacgttaaccgtgtttacgaagttcgggaagttacgctaacgactaacgtagtccggaccggttaacgtcccgggttaggaaccgggtcctacgtttacccgaccgtacttaccgtccgaaacggtaacgaccgtaaccgaccgaaacgtaaccctactaacgttacgttactccgagtaactaagtcgaacggtacaccggtacgtaaacggaaccgccgtaccaacggtcgtaccggtttancggttttaacctacggttcggaacgtaaccgggaacggtaccggggactaacgtcgttaacggttccctaccggtaacctcgtaacccgtcgttacgtaccggtaccggttcgggaaaccgggccctaaggggtcccttaaacccggg

SEQ ID NO: 204145 - DNA, 726 bp, Homo sapiens
  misc_feature: GYAE6OF02IZAJW.24.85.H08.1.454.CMB.1.raw
  modified_base (164)..(164): a, c, t, g, unknown or other
  misc_feature (164)..(164): n is a, c, g, or t
  modified_base (172)..(172): a, c, t, g, unknown or other
  misc_feature (172)..(172): n is a, c, g, or t
  modified_base (191)..(191): a, c, t, g, unknown or other
  misc_feature (191)..(191): n is a, c, g, or t
  modified_base (193)..(193): a, c, t, g, unknown or other
  misc_feature (193)..(193): n is a, c, g, or t
  modified_base (437)..(437): a, c, t, g, unknown or other
  misc_feature (437)..(437): n is a, c, g, or t
  modified_base (499)..(499): a, c, t, g, unknown or other
  misc_feature (499)..(499): n is a, c, g, or t
tcagactactatgtcacgaccggtgctcgatttagtatcactcagtcgcgggaggacgctgaccacacggtacgtgctgttgtactgctccctcccgcggtctttgtcttggctattatgcacctccaccgccgtaccacgtaccagttagaacttgacctcgnggtcttgngctccacgtccaccgaccncnctatgtcgaccttcggacggggtcctggaactctcctctgtacgccacgtcctcgtaggtacttccgtccttacgtaaacttaactttcgtagtatccggactaccggtcgggtaccctaccgacgtaccgaacggggacggggaacggggtctggttaagtttccgggtaacttcgtaacgtttaaataaacgtgttaacgggtaggttgggtaactaggtcctacgtaaccctaagttacgngggtaccgttaccggtacgggtaacggtacgggtactacttaccgactacgtacgaccgaanacggaacacccgaacgaaactaactacacgttagtacctagtaacgtacaaagtcggacgaccgaacgtacgtaaaccggaccgtaacgaggaacgttacggtgttacgggttataacgttcggagtacgaagggaacgcgggacacgttcgtaacgtacccttaggaccctaagtcgtaacgtcggttacggacggttaccggccggaccggtaggtcccgtaacg

SEQ ID NO: 204146 - DNA, 582 bp, Homo sapiens
  misc_feature: GYAE6OF02JAM3V.24.85.H08.1.454.CMB.1.raw
  modified_base (382)..(382): a, c, t, g, unknown or other
  misc_feature (382)..(382): n is a, c, g, or t
tcagactactatgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcaggggtccctgagactctcctgtgcagcctctgggacttcgccctttacaactaactttctggatcgcacgtggggtcccgccaagcctccgaggggaaggggctgagttttgggtctcacgttattaacattggactggggatagctcacactatgcggactcgtagacggcattcactatcncagacacaacgccaagaaacacactagtatactcgacaaagtgagacagcctaaggaacgaccgaccgacgacggcttagtagttactttacgtgtagacggaaggaacggggcagtactacttacctacccttaacgtacctccgtactacgttcggtaacgttcgggttacggggaccgtaacggggcgtaaccgggg

SEQ ID NO: 204147 - DNA, 548 bp, Homo sapiens
  misc_feature: GYAE6OF01AHT7R.39.74.G08.1.454.CMB.1.raw
  modified_base (340)..(340): a, c, t, g, unknown or other
  misc_feature (340)..(340): n is a, c, g, or t
  modified_base (347)..(347): a, c, t, g, unknown or other
  misc_feature (347)..(347): n is a, c, g, or t
  modified_base (382)..(382): a, c, t, g, unknown or other
  misc_feature (382)..(382): n is a, c, g, or t
  modified_base (515)..(515): a, c, t, g, unknown or other
  misc_feature (515)..(515): n is a, c, g, or t
tcagtcgcactagtcacgaccggtgctcgatttagtagctctatcagggggcagaagtctctctcagtcaggacacagcatggacatgagggtccctgctcagctcctgggactcctgctgctctggctcccagatgccggatgtgacatccagatgacccagtctccatcctcctggctgtatctgtaggagacagagtcaccatccacttggcgggcagtcaggactattagctaatttatttagccttggtactcgagccagacgacctggactaaacgttccaagcctcctgactcaatcgctgccgtccgacttacaatcgaggttcgtcccgtntcggttnaggtgcaggcggtatcgtagggactagtactttcnctctacactatcagcacgtcctgcacgtcctaggacgttattttcggaactttgtacgtcgtacaagttacttattacgtacggtcgtaccctaggtaaccgttcggacccgaaggggtaccctaggggtaanaaacgtaccgaaacggtaatcggtggcgtacgg

SEQ ID NO: 204148 - DNA, 489 bp, Homo sapiens
  misc_feature: GYAE6OF01AV1RD.39.74.G08.1.454.CMB.1.raw
tcagtcgcactagtcacgaccggtgctcgatttagtagctctatcagggggcagaagtctctctcagtcaggacacagcatggacatgagggtccctgctcagctcctgggactcctgctgctctggctcccagatgccggatgtgacatccagatgacccagtctccatcctccctggctgtatctgtaggagacagagtcaccatcacttgtcgggcgagtcaggacattagcaattattagcctggtatcagcagagacctggcaaagttcctaagctcctgatcaatgctgcgtccgccttacaatcaggtcgtcccgtctcggttcaggtggcaggcggatcgtgggacagtatttctctctcaccatcagcagcctgcagcctgagtattttggaacttattactgtacaagtactattatgtggccctagacgttcggaccgagggccgagggtaggaaactacgaaacgtatgtggctacg

SEQ ID NO: 204149 - DNA, 865 bp, Homo sapiens
  misc_feature: GYAE6OF01BQTHO.39.74.G08.1.454.CMB.1.raw
  modified_base (197)..(197): a, c, t, g, unknown or other
  misc_feature (197)..(197): n is a, c, g, or t
tcagtcgcactagtcacgaccggtgctcgatttagtagctctatcagggggcagaagtctctctcagtcaggacacagcatggacatgagggtccctgctcagctcctgggactcctgctgctctggcctcccagatgccggatgtgacatccagatcgacccagtctccatcctcctggctgtactctgtaagganacagacgtccaccatcctacgttggtccgggctagtcaaggactaagttacgacttaaatttagttacgccgttaggtatcgagtacaggacgaccgtgggaaccttaaacggttcctaagtcccttacctaggacttacgaattcggaccgttacgcccggttaccgaacctttaacaacgttcgtaacggggttcccgttcccccggttacgtttaccgggttagaaccggggtttcggggcccgtaaacgggttcccgggtaaagtttccccgggtaagggggttaacccttaacggtttaccttttaccccggttacccttaccggttaaccccaaaccccgttagttaccccgaaacgggtccctaaacggttccccgttacggaccctaacggggttacccctttaaggggtaaccgggttttacgttttttaaacgggtaacctttttaacgttaccggttacgttaaaccgttaaaacggtacttttaacgtaacgggtttacccggttaccggtaccccggtttaaacgggttaaccccggtttccggggtaaacccggtaacgggggtaaaccccgttaaagggggttaaaaccggtaaaccgttaaacccgggttaaaaccgtaacgggtttacggggtaccgttccggtaaaccgg

SEQ ID NO: 204150 - DNA, 689 bp, Homo sapiens
  misc_feature: GYAE6OF01BL43G.39.74.G08.1.454.CMB.1.raw
tcagtcgcactagtcacgaccggtgctcgatttagtagctctatcaggggcagaagtctctctcagtcaggacacagcagtggacagtgacgggtccctgctcagtctccgtgggactcctgctcgctcgtggcctcccgagtactcggccggtattggtcgaaccagtcccaaggactcggaccccagttcctccattcccgtccctgggcttagtactcgtggtaaggacacagtacgtccaaccgatccgtagtttcggccgggactaggtcaaggtactagtacgacttaatttagttacgctggtactcgagacgagacgtaccgtagactaaaacgttcctaagccttacgtagactacgaatcggtcctaggccttaccgtacttaacaacttcgtaacggttccgtcccgtgttacggtcaggttcgacgaggtacggtctgggtacggactacggttactttccgtacgttaccacgtaacctacgtaccgtaacgacgtccgtacctcgtacgacgtacgtaggtaacggtttacgtttaacgttaacgtttactttacgtacgtaactaacgtacttaagttaacgtacgtcggttaccctacggttaccggtacgtacgggaacggtaccggagggtaaataaccgttaacgaaacgttaggtcgtaagtcgtaacg

SEQ ID NO: 204151 - DNA, 565 bp, Homo sapiens
  misc_feature: GYAE6OF02I2CAO.39.74.G08.1.454.CMB.1.raw
  modified_base (193)..(193): a, c, t, g, unknown or other
  misc_feature (193)..(193): n is a, c, g, or t
  modified_base (397)..(397): a, c, t, g, unknown or other
  misc_feature (397)..(397): n is a, c, g, or t
  modified_base (456)..(456): a, c, t, g, unknown or other
  misc_feature (456)..(456): n is a, c, g, or t
tcagtcgcactagtcacgaccggtgctcgatttagtagctctatcagggggcagaagtctctctcagtcaggacacagcatggacatgagggtccctgctcagctcctgggactcctgctgctctggctcccagatgccggatgtgacatccagatgacccagtctccatcctcctggctgtatctgtagganacagatcaccatcacttggtcggcgagtcaggacattagctaattattagccgtagtatcaagcaagacgaccgtggactaaacgtttccaaaggctacctgactacaattgctcgcgtaccgaccttacagtccaggtcgtccctgtcggttcaggtcggactaggccgtatccgtgggactatactttctcctactcaaccnttcgaagtctacgcgtagacctagcctaggagttagtttacgtaactttagttaccgtntaaccgtaatacgttaattagtacgttcgacccgttggtaaaccgtcggtaaccgtaacgggtaccgtacgggtaagtaacgtacgaaacgtacgtggtcgtacgtacg

SEQ ID NO: 204152 - DNA, 577 bp, Homo sapiens
  misc_feature: GYAE6OF02IRXP0.39.74.G08.1.454.CMB.1.raw
  modified_base (410)..(410): a, c, t, g, unknown or other
  misc_feature (410)..(410): n is a, c, g, or t
tcagtcgcactagtcacgaccggtgctcgatttagtagctctatcagggggcagaagtctctctcagtcaggacacagcatggacatgagggtccctgctcagctcctgggactcctgctgctctggctcccagatgccggatgtgacatccagatgacccagtcctccatcctccctggctgtatcttgtaggagacagacgtcaaccatcacgttggtcgggcgagtcaggactattagctaatttatttacgcttggtatcagcagagaccgtaggactaagttcctaagtctacctgatacaagtcgctcgtccgtaccgtaccttaacaagtcgtaggttccgtacccgtgttccggttcaggtggcaggcggactcgtggtactagtactttctcgtctcaccntacagcagccgtgcctagtcctaggagttgtttagtaactttagtacttgaactagttaacttattacgacgttccgaccgttaggtaccggttcggaaccgtaacgggtaaccgtaacgggttagaaaccgttacgaaaccgttacggtacggttacggcctacgg

SEQ ID NO: 204153 - DNA, 536 bp, Homo sapiens
  misc_feature: GYAE6OF02F23PG.39.74.G08.1.454.CMB.1.raw
  modified_base (342)..(342): a, c, t, g, unknown or other
  misc_feature (342)..(342): n is a, c, g, or t
  modified_base (365)..(365): a, c, t, g, unknown or other
  misc_feature (365)..(365): n is a, c, g, or t
  modified_base (389)..(389): a, c, t, g, unknown or other
  misc_feature (389)..(389): n is a, c, g, or t
tcagtcgcactagtcacgaccggtgctcgatttagtagctctatcagggggcagaagtctctctcagtcaggacacagcatggacatgagggtccctgctcagctcctgggactcctgctgctctggctcccagatgccggatgtgacatccagatgacccagtctccatcctccctggctgtatctgtaggagacagagtcaccatcacttggtcggcgagtcaggacattagctaattattagcctggtatcagcagagacctggactaaagttcctaaagcctacctgatacaatcgactcggccgtccgtaccttaacaactcgaggttcgtcccgtntcggttcagtgcaggcggatcgnggacagtacttctctctcactacncacgcacgtcctgcagcctgaggttatttacggtaactttattactagtactaagtactattacgtagtcgtacctacggtaccgttcggaactaacgggaaccgtagggtacgtaacgtacgaaacgtacgtacgtacggctaccg

SEQ ID NO: 204154 - DNA, 722 bp, Homo sapiens
  misc_feature: GYAE6OF02GJ0U1.39.74.G08.1.454.CMB.1.raw
  modified_base (529)..(529): a, c, t, g, unknown or other
  misc_feature (529)..(529): n is a, c, g, or t
  modified_base (550)..(550): a, c, t, g, unknown or other
  misc_feature (550)..(550): n is a, c, g, or t
  modified_base (588)..(588): a, c, t, g, unknown or other
  misc_feature (588)..(588): n is a, c, g, or t
tcagtcgcactagtcacgaccggtgctcgatttagtagctctatcagggggcagaagtctctctcagtcaggacacagcatggacatgagggtccctgctcagctccgtgggactcctgctgctctggcctacccagatcggccggatgtgacactccagatcgaccctgtcctaccacgttccctcccgtggtactgtatcgttggaggtagacaggtaacgtaccactacctactacgttcgggtaccgggacgtagtaccgaaggtactattacggacttaatttagttacgtccgtaggttacacgacgacgaggtacgtacggtacggtaaccgtaaacgttaccgtagtaccttcctagtacttacgtaagtcggtctccggttaccgtccctacgttaacttaccgcgttagggtaccccgttccggtttcgttacggtcgtacgggtcggaccgtacggtaccgggtcttacggggacgtaaccgtagtttccgtttaccttaccgtccaaccgtaccgtnacgtactccgtactccggacngtaccgagtcgtaagttcgtaaccgttatttaccggtnttaccgtagactttaccgtaagttgtaccgtccggttaccgccggttacggtcccggaaacgggaaccgggtaacgggttacgggtaacgtaaccgtacgtaaaccgggtcttaacgggtccggaacttacccg

SEQ ID NO: 204155 - DNA, 403 bp, Homo sapiens
  misc_feature: GYAE6OF01DG8CM.11.60.F05.1.454.CMB.1.raw
  modified_base (394)..(403): a, c, t, g, unknown or other
  misc_feature (394)..(403): n is a, c, g, or t
tcagcgagagataccacgaccggtgctcgatttagtacgtcatcagggaaagggccaccctctcttgtagggccagtcagagtgttagcagcaactacttagcctggtactagcagacacctggccaggctcccaggctcctcatccatggtgcatccaccagggccactggcatcccagacaggttcagtggcagtgggtctgggacagacttcattctcaccatcagcagactggagcctgaagattttgcagtttattactgtcagcagcgtatcgactggatcacttcggccaagggacacgactggaaattaacgactgtgctgcacatctgtcttcatcttcccgcatctgagtatctctcgctgacgcggctggcaaggcgcatagnnnnnnnnnn

SEQ ID NO: 204156 - DNA, 420 bp, Homo sapiens
  misc_feature: GYAE6OF01CSSTK.11.60.F05.1.454.CMB.1.raw
  modified_base (406)..(406): a, c, t, g, unknown or other
  misc_feature (406)..(406): n is a, c, g, or t
  modified_base (413)..(420): a, c, t, g, unknown or other
  misc_feature (413)..(420): n is a, c, g, or t
tcagcgagagataccacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgctagtgtattactgtcagcagtacggtagttcatctccgacgttcggcaagggaccaaggtggaaatcaaacgaactgtggctgacaccatctgtcttcattccttcccgctatcctagagtactctctcgctggacgcgggcttggcaaggcncagtagnnnnnnnn

SEQ ID NO: 204157 - DNA, 405 bp, Homo sapiens
  misc_feature: GYAE6OF01BX4SR.11.60.F05.1.454.CMB.1.raw
  modified_base (239)..(239): a, c, t, g, unknown or other
  misc_feature (239)..(239): n is a, c, g, or t
  modified_base (392)..(392): a, c, t, g, unknown or other
  misc_feature (392)..(392): n is a, c, g, or t
  modified_base (396)..(405): a, c, t, g, unknown or other
  misc_feature (396)..(405): n is a, c, g, or t
tcagcgagagataccacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggancctgaagattttgcagtgtattactgtcagcagtacggtagttcatctccgacgttcggccaagggaccaaggtggaaatcaaacgaactgtggctgcacatctgtctcatcttccgcatctaagtatctctcgctgagcggctggcaaggcnatgnnnnnnnnnn

SEQ ID NO: 204158 - DNA, 609 bp, Homo sapiens
  misc_feature: GYAE6OF01CRVAE.11.60.F05.1.454.CMB.1.raw
  modified_base (549)..(549): a, c, t, g, unknown or other
  misc_feature (549)..(549): n is a, c, g, or t
  modified_base (578)..(578): a, c, t, g, unknown or other
  misc_feature (578)..(578): n is a, c, g, or t
  modified_base (586)..(586): a, c, t, g, unknown or other
  misc_feature (586)..(586): n is a, c, g, or t
  modified_base (591)..(591): a, c, t, g, unknown or other
  misc_feature (591)..(591): n is a, c, g, or t
  modified_base (604)..(604): a, c, t, g, unknown or other
  misc_feature (604)..(604): n is a, c, g, or t
  modified_base (606)..(608): a, c, t, g, unknown or other
  misc_feature (606)..(608): n is a, c, g, or t
tcagcgagagataccacgaccggtgctcgatttagtacgtcatcagggaaagggtccaccctctcttgtagggccagtcagagtgttagcagcaactacttagcctggtaccagcagacaccctggccaggctcccaggctcctcatcccatggtgcatccaccagggccactcggcatcccagacaggtttcagtggcaggtcgggtctgggacagacgttcgattctacaccatcgagcagactggagcctaggtaacgtattttgacagttcgttattactgtacagcaggtacggtagttacactctaccggtacgttccggaccgtaagggaccgtaagggtacggaaaactccgaaaacgtacgtaggtcggtcgtacgactaccgtagtcctcgttctcgtaacttccgttcccgtacctacgttccgtagtacgttacttccgtccgtccgtacttacgggtaacggttccgggttacgtacggggtaccgtaaacgggtccggtaaccgtaagttaacgcgtacggtcgcgtcgaccggngacgagcgtacgcgtcgcgtactcgcgcncacgcgcncgtcnctcgcgtcacacncnnnc

SEQ ID NO: 204159 - DNA, 435 bp, Homo sapiens
  misc_feature: GYAE6OF01DIXLE.11.60.F05.1.454.CMB.1.raw
  modified_base (401)..(401): a, c, t, g, unknown or other
  misc_feature (401)..(401): n is a, c, g, or t
  modified_base (408)..(435): a, c, t, g, unknown or other
  misc_feature (408)..(435): n is a, c, g, or t
tcagcgagagataccacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcaggtggggtctggggacagacttcgatttcctcaccatcagctagactggagcctgaagatttttgctagtgtattactgtcagcagtacggtattcatctccgagttcggccaagggccaaggtgaaatcaaacgactggtgctgcacatctgtctcactccttcccgctatctgatatctctcgctagagcgggctggcaaggcncagtagnnnnnnnnnnnnnnnnnnnnnnnnnnnn

SEQ ID NO: 204160 - DNA, 762 bp, Homo sapiens
  misc_feature: GYAE6OF01BI181.11.60.F05.1.454.CMB.1.raw
  modified_base (686)..(686): a, c, t, g, unknown or other
  misc_feature (686)..(686): n is a, c, g, or t
  modified_base (741)..(741): a, c, t, g, unknown or other
  misc_feature (741)..(741): n is a, c, g, or t
  modified_base (747)..(747): a, c, t, g, unknown or other
  misc_feature (747)..(747): n is a, c, g, or t
  modified_base (749)..(749): a, c, t, g, unknown or other
  misc_feature (749)..(749): n is a, c, g, or t
  modified_base (754)..(754): a, c, t, g, unknown or other
  misc_feature (754)..(754): n is a, c, g, or t
  modified_base (757)..(757): a, c, t, g, unknown or other
  misc_feature (757)..(757): n is a, c, g, or t
  modified_base (759)..(760): a, c, t, g, unknown or other
  misc_feature (759)..(760): n is a, c, g, or t
tcagcgagagataccacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccaggccactggcatcccagacgaggtttcagtggcaggtcgggtctgggacaggacttcgattcgtacaccatcgaagtcagactggagtccgtaggaaacgttatttttaggacctaaggtttcgttaacttttaccgttaggtaccgtaaggtccgtaacggtttaaccgggttaacgtttacctaaacgtttcccgttaccccggttaaccggtttcccgggaacccggtaaacggggaacccgtaaagggttaacgggtaaaaacttaacccggtaaaaaccggtaaccgttagggttacgggtaccttacggtaacccgtaaccgtacgttaccgtttcggtttacctttaccgtaaccgttttaccccgtttacccccgttaaccgttaaacgttcgttaacgggttaaccgttaacgtttcccgttaccgttaccggtacgttacgggtaacgggttccggggttacgttacgggtaaccggtaaacgggtccggtaacttaaacggttagcgtaacgngtccgtaagtccgagagacgtagtagtcgtcgtactcgtctcgcgacgacgcgancgcgcncncgtcncancnngc

SEQ ID NO: 204161 - DNA, 579 bp, Homo sapiens
  misc_feature: GYAE6OF01DXHP0.11.60.F05.1.454.CMB.1.raw
  modified_base (535)..(535): a, c, t, g, unknown or other
  misc_feature (535)..(535): n is a, c, g, or t
  modified_base (540)..(542): a, c, t, g, unknown or other
  misc_feature (540)..(542): n is a, c, g, or t
  modified_base (544)..(544): a, c, t, g, unknown or other
  misc_feature (544)..(544): n is a, c, g, or t
  modified_base (552)..(554): a, c, t, g, unknown or other
  misc_feature (552)..(554): n is a, c, g, or t
  modified_base (556)..(556): a, c, t, g, unknown or other
  misc_feature (556)..(556): n is a, c, g, or t
  modified_base (558)..(558): a, c, t, g, unknown or other
  misc_feature (558)..(558): n is a, c, g, or t
  modified_base (560)..(560): a, c, t, g, unknown or other
  misc_feature (560)..(560): n is a, c, g, or t
  modified_base (562)..(564): a, c, t, g, unknown or other
  misc_feature (562)..(564): n is a, c, g, or t
  modified_base (566)..(579): a, c, t, g, unknown or other
  misc_feature (566)..(579): n is a, c, g, or t
tcagcgagagataccacgaccggtgctcgatttagtacgtcatcagggaaagggccaccctctcttgtagggccagtcagagtgttagcagcaactacttagcctggtaccagcagacacctggccaggctcccaggctcctcatctatgatgcatttaggagggccactggcatcccacccaggttcagtggcagtgggtctgggacagacttcattctcaccatccgcacgcctagagcctgaagtattttgctagtttatactgtacaacagccgtagctagcgacggtccgtccgggcgtaccggttcggacccgtaaggggaccaaagggttaggaaacgtacgaacggccggtaacgtggtacgggtctacggccaacccgtacttccttcgttcttacgtaacttcccgtttaccccgacctacgtccgttaggtaacgtttacttcctaccgttaccggtcgttacggggaaccgggccggggtcggttaggggacccgaaaggggtcccgtaacgtaacgttacgntgagnnngnagagtatnnngngngngnnngnnnnnnnnnnnnnn

SEQ ID NO: 204162 - DNA, 402 bp, Homo sapiens
  misc_feature: GYAE6OF01EZ1RY.11.60.F05.1.454.CMB.1.raw
  modified_base (239)..(239): a, c, t, g, unknown or other
  misc_feature (239)..(239): n is a, c, g, or t
  modified_base (396)..(402): a, c, t, g, unknown or other
  misc_feature (396)..(402): n is a, c, g, or t
tcagcgagagataccacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggancctgaagattttgcagtgtattactgtcagcagtacggtagttcatctccgacgttcggccaagggaccaaggtgaaatcaaacgactgtggctgcacatctgtctcatcctccgcatctgagtatctctcgctgagcgggctggcaggcgcatagnnnnnnn

SEQ ID NO: 204163 - DNA, 506 bp, Homo sapiens
  misc_feature: GYAE6OF01CNRA5.11.60.F05.1.454.CMB.1.raw
  modified_base (154)..(154): a, c, t, g, unknown or other
  misc_feature (154)..(154): n is a, c, g, or t
  modified_base (179)..(179): a, c, t, g, unknown or other
  misc_feature (179)..(179): n is a, c, g, or t
  modified_base (182)..(182): a, c, t, g, unknown or other
  misc_feature (182)..(182): n is a, c, g, or t
  modified_base (202)..(202): a, c, t, g, unknown or other
  misc_feature (202)..(202): n is a, c, g, or t
  modified_base (232)..(232): a, c, t, g, unknown or other
  misc_feature (232)..(232): n is a, c, g, or t
  modified_base (244)..(244): a, c, t, g, unknown or other
  misc_feature (244)..(244): n is a, c, g, or t
  modified_base (255)..(255): a, c, t, g, unknown or other
  misc_feature (255)..(255): n is a, c, g, or t
  modified_base (397)..(397): a, c, t, g, unknown or other
  misc_feature (397)..(397): n is a, c, g, or t
  modified_base (438)..(438): a, c, t, g, unknown or other
  misc_feature (438)..(438): n is a, c, g, or t
  modified_base (470)..(470): a, c, t, g, unknown or other
  misc_feature (470)..(470): n is a, c, g, or t
  modified_base (476)..(506): a, c, t, g, unknown or other
  misc_feature (476)..(506): n is a, c, g, or t
tcagcgagagataccacgaccggtgctcgatttagtacgtcatcagggaaagggccaccctctcttgtagggccagtcagagtgttagcagcaactacttagcctggtaccagcagacacctggccaggcctcccaggctcctcatccatggtncatccacgaggccactggcatccanacnggttcagtggcagtgggtcngggacagtacttcattcctcaccatccgancagacgtggacncctagtaagtntttcgctagttgtacttacgtgtacgtacgacgtaggtacggtagttcacgttcctccggtacgttcggaccgtaaacgggactaaggtaggaacttacggaaacgtgttaggcgactcaccgtactactcgttactctacncgttcctacccgcctagttcctagtcgtactctccgttcgngtcgacgtcggtcgtacgacggacgtcactancgtaannnnnnnnnnnnnnnnnnnnnnnnnnnnnnn

SEQ ID NO: 204164 - DNA, 460 bp, Homo sapiens
  misc_feature: GYAE6OF01DPB0R.11.60.F05.1.454.CMB.1.raw
  modified_base (349)..(349): a, c, t, g, unknown or other
  misc_feature (349)..(349): n is a, c, g, or t
  modified_base (436)..(437): a, c, t, g, unknown or other
  misc_feature (436)..(437): n is a, c, g, or t
  modified_base (439)..(460): a, c, t, g, unknown or other
  misc_feature (439)..(460): n is a, c, g, or t
tcagcgagagataccacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagtattttgctagtgttattactgtcagcgaggttacggtagttcatccgtccgacgttcggaccgaagggaccaaggtagaaatacaaacgactgtgctgcacntctgtctcactctcccgctatctgtagtactctctcgtcgtggacggtccgggtacgtcgggaccgtaacgggccggtactagtagnngnnnnnnnnnnnnnnnnnnnnnn

SEQ ID NO: 204165 - DNA, 573 bp, Homo sapiens
  misc_feature: GYAE6OF01EVWN7.11.60.F05.1.454.CMB.1.raw
  modified_base (223)..(223): a, c, t, g, unknown or other
  misc_feature (223)..(223): n is a, c, g, or t
  modified_base (531)..(531): a, c, t, g, unknown or other
  misc_feature (531)..(531): n is a, c, g, or t
  modified_base (537)..(537): a, c, t, g, unknown or other
  misc_feature (537)..(537): n is a, c, g, or t
  modified_base (543)..(544): a, c, t, g, unknown or other
  misc_feature (543)..(544): n is a, c, g, or t
  modified_base (546)..(547): a, c, t, g, unknown or other
  misc_feature (546)..(547): n is a, c, g, or t
  modified_base (549)..(558): a, c, t, g, unknown or other
  misc_feature (549)..(558): n is a, c, g, or t
  modified_base (560)..(573): a, c, t, g, unknown or other
  misc_feature (560)..(573): n is a, c, g, or t
tcagcgagagataccacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccaggggccactggcatcccagacaggttcagtggcaggtgggtctggggacagacttcattcncaccatcagcagactggagccagaagtattttgcagtgtattactgtcagctaggtacggtagttcatccgtccggtacggttccgggaccgaaacggggaacccaagggtaacggaaaactaccgaaaacggtaactggtaggtctacgacacctatcttcgttctttactacttcccgttccccgaccctacttcgttacggtaacgttactttacccgttccgttccggtaccgtacggggtaccgggccgggggttaccgtacggggacccggtaaacgggggccgtaaccgtaacggtacganacgagngcgcgnngnngnnnnnnnnnngnnnnnnnnnnnnnn

SEQ ID NO: 204166 - DNA, 604 bp, Homo sapiens
  misc_feature: GYAE6OF01B507B.11.60.F05.1.454.CMB.1.raw
  modified_base (544)..(544): a, c, t, g, unknown or other
  misc_feature (544)..(544): n is a, c, g, or t
  modified_base (548)..(548): a, c, t, g, unknown or other
  misc_feature (548)..(548): n is a, c, g, or t
  modified_base (556)..(556): a, c, t, g, unknown or other
  misc_feature (556)..(556): n is a, c, g, or t
  modified_base (562)..(562): a, c, t, g, unknown or other
  misc_feature (562)..(562): n is a, c, g, or t
  modified_base (565)..(565): a, c, t, g, unknown or other
  misc_feature (565)..(565): n is a, c, g, or t
  modified_base (569)..(569): a, c, t, g, unknown or other
  misc_feature (569)..(569): n is a, c, g, or t
  modified_base (571)..(571): a, c, t, g, unknown or other
  misc_feature (571)..(571): n is a, c, g, or t
  modified_base (574)..(574): a, c, t, g, unknown or other
  misc_feature (574)..(574): n is a, c, g, or t
  modified_base (577)..(577): a, c, t, g, unknown or other
  misc_feature (577)..(577): n is a, c, g, or t
  modified_base (584)..(584): a, c, t, g, unknown or other
  misc_feature (584)..(584): n is a, c, g, or t
  modified_base (587)..(587): a, c, t, g, unknown or other
  misc_feature (587)..(587): n is a, c, g, or t
  modified_base (590)..(591): a, c, t, g, unknown or other
  misc_feature (590)..(591): n is a, c, g, or t
  modified_base (596)..(598): a, c, t, g, unknown or other
  misc_feature (596)..(598): n is a, c, g, or t
  modified_base (600)..(600): a, c, t, g, unknown or other
  misc_feature (600)..(600): n is a, c, g, or t
  modified_base (602)..(604): a, c, t, g, unknown or other
  misc_feature (602)..(604): n is a, c, g, or t
tcagcgagagataccacgaccggtgctcgatttagtacgtcatcagggaaagggccaccctctcttgtagggccagtcagagtgttagcagcaactacttagcctggtaccagcagaccacctggccacggctcccaggctcctcatccatggtgcatcccaccacgggccactggcactcccagactaggttcagtggctaggtgggtcgtgggacacgacttaccatttcctaccaccctatccgagccaaggtcctagggacgtcctaggaagttattttcggactaaggttgttaacttacttggtaccaggtacctaagggtacggttagtttaccacgttccgtacccggtacggttccggaaccggtaaacgggaaccgtaaggtacgaaacttacgaaacgtagtgtacggctacgacactacgttcgtactacttctaccttcccgtcccgactacgttcgtacgtagttactccttaccgtcgtcgttacggcggtacgggtcgtacgggaaccgaacggtcgaactagtacgngacncgagcgancgtagngtngacntncgngtntagtcgncanacnncagannnancnnn

SEQ ID NO: 204167 - DNA, 795 bp, Homo sapiens
  misc_feature: GYAE6OF01CD270.11.60.F05.1.454.CMB.1.raw
  modified_base (725)..(725): a, c, t, g, unknown or other
  misc_feature (725)..(725): n is a, c, g, or t
  modified_base (777)..(777): a, c, t, g, unknown or other
  misc_feature (777)..(777): n is a, c, g, or t
  modified_base (786)..(786): a, c, t, g, unknown or other
  misc_feature (786)..(786): n is a, c, g, or t
tcagcgagagataccacgaccggtgctcgatttagtacgtcatcagggaaagggccaccctctcttgtagggccagtcagagtgttagcagcaactacttagcctggtaccagcagaccacctggccaggctcccaggctcctcatccagtggtgcatcccaccacgggccactggcactccccgagaccgtaggttcacggtcgggactaggttggggtaccgtggggaccaggtactttctatttccgtacacctatccaggcaaggtaccgtggacgtccgttaggtaagttagtttttaggaccgtaagggtttacttaacgttttaaccgttcggtaccgtacggtaccgttaacggggtttaaccgggttacggtttaacctacggttaccccggttaccgggttaacccgggtttaaccggggacccggtaaacgggggtaaccccgtaaagggtaacgggtaaaaccgtttaccgaaaacggtacgttacgggttacggaccttacggaccctaccgttacgttaccgttttcgttacccctttacgtaacccgttccccttaccccggtacccttaaccggttacgttacggttaacggttccccgttttaccggtacccgttacccgggttccggttaccgggacggggtccggggtaacccggtaggaacccgggttaccgaccgggttactaagggtacgcgtacaggtccanacgtagacagtagtactgactacatagtcgtcgactcgtcgtgagcgaccgngctcacgantacgtctac

SEQ ID NO: 204168 - DNA, 467 bp, Homo sapiens
  misc_feature: GYAE6OF02HRYGF.11.60.F05.1.454.CMB.1.raw
  modified_base (381)..(381): a, c, t, g, unknown or other
  misc_feature (381)..(381): n is a, c, g, or t
  modified_base (420)..(420): a, c, t, g, unknown or other
  misc_feature (420)..(420): n is a, c, g, or t
  modified_base (426)..(426): a, c, t, g, unknown or other
  misc_feature (426)..(426): n is a, c, g, or t
  modified_base (428)..(428): a, c, t, g, unknown or other
  misc_feature (428)..(428): n is a, c, g, or t
  modified_base (431)..(432): a, c, t, g, unknown or other
  misc_feature (431)..(432): n is a, c, g, or t
  modified_base (434)..(434): a, c, t, g, unknown or other
  misc_feature (434)..(434): n is a, c, g, or t
  modified_base (436)..(437): a, c, t, g, unknown or other
  misc_feature (436)..(437): n is a, c, g, or t
  modified_base (439)..(446): a, c, t, g, unknown or other
  misc_feature (439)..(446): n is a, c, g, or t
  modified_base (449)..(451): a, c, t, g, unknown or other
  misc_feature (449)..(451): n is a, c, g, or t
  modified_base (453)..(453): a, c, t, g, unknown or other
  misc_feature (453)..(453): n is a, c, g, or t
  modified_base (455)..(455): a, c, t, g, unknown or other
  misc_feature (455)..(455): n is a, c, g, or t
  modified_base (457)..(457): a, c, t, g, unknown or other
  misc_feature (457)..(457): n is a, c, g, or t
  modified_base (459)..(459): a, c, t, g, unknown or other
  misc_feature (459)..(459): n is a, c, g, or t
  modified_base (461)..(461): a, c, t, g, unknown or other
  misc_feature (461)..(461): n is a, c, g, or t
  modified_base (463)..(467): a, c, t, g, unknown or other
  misc_feature (463)..(467): n is a, c, g, or t
tcagcgagagataccacgaccggtgctcgatttagtacgtcatcagggaaagggtccaccctctcttgtagggccagtcagagtgttagcgagcaacctacttagcctggtaccagcagaccacctggccaggctcccaggctcctcatccatggtgcatccaccagggccactggcatcccagacaggttcagtggcaggtgggtctgggacagacttcgattctcaccatcagcagactggagcctgaagattttgcagtgtattactgtacagcagtacgtagttcatctccgacgttcgccaagggccaaggtggaaatctaaacgatgtgctgcacatctgtcttcatcgtccgccatctagagtatctactcgtntgaggtcgggtcgtgggtcgtaaaggccgacgatacggncgcgcncncgnngngnncnnnnnnnncgnnngncncncncncnnnnn

SEQ ID NO: 204169 - DNA, 409 bp, Homo sapiens
  misc_feature: GYAE6OF02GRT34.11.60.F05.1.454.CMB.1.raw
  modified_base (401)..(409): a, c, t, g, unknown or other
  misc_feature (401)..(409): n is a, c, g, or t
tcagcgagagataccacgaccggtgctcgatttagtacgtcatcagggaaagggccaccctctcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggaccaaggtggaaatcaaacgaactgtggctgcacatctgtcttcatcttcccgccatctgagtatctctcgctgagcgggctggcaggcgcatagnnnnnnnnn

SEQ ID NO: 204170 - DNA, 568 bp, Homo sapiens
  misc_feature: GYAE6OF02JZYW4.11.60.F05.1.454.CMB.1.raw
  modified_base (518)..(518): a, c, t, g, unknown or other
  misc_feature (518)..(518): n is a, c, g, or t
  modified_base (526)..(526): a, c, t, g, unknown or other
  misc_feature (526)..(526): n is a, c, g, or t
  modified_base (529)..(529): a, c, t, g, unknown or other
  misc_feature (529)..(529): n is a, c, g, or t
  modified_base (531)..(531): a, c, t, g, unknown or other
  misc_feature (531)..(531): n is a, c, g, or t
  modified_base (534)..(534): a, c, t, g, unknown or other
  misc_feature (534)..(534): n is a, c, g, or t
  modified_base (543)..(544): a, c, t, g, unknown or other
  misc_feature (543)..(544): n is a, c, g, or t
  modified_base (547)..(549): a, c, t, g, unknown or other
  misc_feature (547)..(549): n is a, c, g, or t
  modified_base (551)..(553): a, c, t, g, unknown or other
  misc_feature (551)..(553): n is a, c, g, or t
  modified_base (555)..(568): a, c, t, g, unknown or other
  misc_feature (555)..(568): n is a, c, g, or t
tcagcgagagataccacgaccggtgctcgatttagtacgtcatcagggaaagggccaccctctcttgtagggccagtcagagtgttagcagcaactacttagcctggtaccaacagaaacctggccagactcccaggctcctcatctatgatgcatccaacagggccactggccaccccagccaggttcagtggcagtggtctgggacagactcactctcaccatcagcagcctagacgcctgagtatttgctagtttatactgtcagcagtcgtatcgagtggactcctaccgttccggacgaacgggtaccaccggtaacgtaagggtaaaacttaaaaccggacgtaggtacggctacggaccaacccgtagttccgttacgttcctttacctactttcccgttaccccgtccgtaacttccgtacgtacgtttacttccgttccgtacggtacttcgggacgggtccggggtaccgttacgggaccgtaacgggtccgtactaacggttaggcncgtgcgcncgngnacngtcgcgcgnngcnnncnnngnnnnnnnnnnnnnn

SEQ ID NO: 204171 - DNA, 553 bp, Homo sapiens
  misc_feature: GYAE6OF02IQK38.11.60.F05.1.454.CMB.1.raw
  modified_base (220)..(220): a, c, t, g, unknown or other
  misc_feature (220)..(220): n is a, c, g, or t
  modified_base (246)..(246): a, c, t, g, unknown or other
  misc_feature (246)..(246): n is a, c, g, or t
  modified_base (293)..(293): a, c, t, g, unknown or other
  misc_feature (293)..(293): n is a, c, g, or t
  modified_base (511)..(511): a, c, t, g, unknown or other
  misc_feature (511)..(511): n is a, c, g, or t
  modified_base (524)..(525): a, c, t, g, unknown or other
  misc_feature (524)..(525): n is a, c, g, or t
  modified_base (527)..(529): a, c, t, g, unknown or other
  misc_feature (527)..(529): n is a, c, g, or t
  modified_base (531)..(531): a, c, t, g, unknown or other
  misc_feature (531)..(531): n is a, c, g, or t
  modified_base (533)..(534): a, c, t, g, unknown or other
  misc_feature (533)..(534): n is a, c, g, or t
  modified_base (536)..(553): a, c, t, g, unknown or other
  misc_feature (536)..(553): n is a, c, g, or t
tcagcgagagataccacgaccggtgctcgatttagtacgtcatcagggaaagggccgaccctctcttgtagggccagtcagagtgttagcagcaactacttagcctggtaccagcagacacctggccaggctcccaggctcctcatccatggtgcatcccaccagggccactggcatcccgagaccaggttcagtggcaggtcggctgggacagtacttnatttccacctagtcagcagactgganccgtagaagtatttgctagtgtattactgtcagtcagtacgtgttanactctcgtacgttcggaccgaacggtaacgtaaggtaggaaatacgtaaaacgaactggtcgacgtcgaccgtaacacgtcgttacgtacgttactacgttacccttccccgtacctacgttctacgtacgttaacttcccgttcgtaccgtccgtagggtaccggtaccgggtcgttaccgggaacgtaacgggtccgtaaccgtagttacgacgtnacgtgcgatacgnntnnngngnngnnnnnnnnnnnnnnnnnn

SEQ ID NO: 204172 - DNA, 716 bp, Homo sapiens
  misc_feature: GYAE6OF02II2YN.11.60.F05.1.454.CMB.1.raw
tcagcgagagataccacgaccggtgctcgatttagtacgtcatcagggaaagggccaccctctcttgtagggccagtcagagtgttagcagcaactacttagcctggtaccagcagacacctggccaggctcccaggctcctcatccatggtgcatccacgagggccactggcatcccagacaggttcagtggcaggtgggtctgggacagacttcattctcaccatcagcagactggacgcctagaagtattttgactagttagtaattactggttaccagtaccagttaacggttacgttaccattccgtacccggtaacggtttccgggaaccgtaaacggggacctaaagggttaacggaaaacttaaccgaaaaaccggtaagttacggtacggggtacttcggaactaacccgtacttacgttacggttacttacctaacgtttccccttacccggacctaaacgttcgtacggtaacgttttaactcccgtttaccgtaccgtacgtaggtaccggggtaccgggtacgttaccggggaaacgtaccggggaccgttaaaccggtaacgtttaagggaacctacgtacgtaacgtacgtacgtacgacgtacgtacgtacgtactacgtacgtacgtacgtacgtacgtacgtacgtacgtacgtacgtaacgtacgtagtacgtacgtacgtagtacgtacgtatacg

SEQ ID NO: 204173 - DNA, 339 bp, Homo sapiens
  misc_feature: GYAE6OF01AUVMX.38.17.B06.1.454.CMB.1.raw
  modified_base (335)..(339): a, c, t, g, unknown or other
  misc_feature (335)..(339): n is a, c, g, or t
tcagtcgatcacgtcacgaccggtgctcgatttagtcgatagtgaagggccgattcaccatctccagagacaacgccaagaactcactgtatctgcaaatgaacagcctgagagccgaggacacggctgtatattactgtgcgagagtcacgtccgtcgctgcctactggggccagggaaccctggtcaccgtctcctcagcctccaccaagggcccatcggtcttccccctggcgccctgctccaggagcacctccgagagcacagcggccctgggctgcctggtcaaggctacttccacgtgatcgactgagcgggctggcaaggcgcatagnnnnn

SEQ ID NO: 204174 - DNA, 345 bp, Homo sapiens
  misc_feature: GYAE6OF01DAGKS.38.17.B06.1.454.CMB.1.raw
  modified_base (339)..(345): a, c, t, g, unknown or other
  misc_feature (339)..(345): n is a, c, g, or t
tcagtcgatcacgtcacgaccggtgctcgatttagtcgatagtgaagggccgattcaccatctccagagacaacgccaagaactcactgtatctgcaaatgaacagcctgagagccgaggacacggctgtatattactgtgcgagagtcacgtccgtcgctgcctactggggccagggaaccctggtcaccgtctcctcagcctccaccaagggcccatcggtcttcccctggccgccctgcctccaggagccacctccgagagcacagcggccctgggctgcctggtcaaggactacttccacgtgatcgactgagcgggctggcaagggcgcatagnnnnnnn

SEQ ID NO: 204175 - DNA, 410 bp, Homo sapiens
  misc_feature: GYAE6OF01AQL7A.38.17.B06.1.454.CMB.1.raw
  modified_base (239)..(239): a, c, t, g, unknown or other
  misc_feature (239)..(239): n is a, c, g, or t
  modified_base (257)..(257): a, c, t, g, unknown or other
  misc_feature (257)..(257): n is a, c, g, or t
  modified_base (260)..(260): a, c, t, g, unknown or other
  misc_feature (260)..(260): n is a, c, g, or t
  modified_base (382)..(382): a, c, t, g, unknown or other
  misc_feature (382)..(382): n is a, c, g, or t
  modified_base (384)..(384): a, c, t, g, unknown or other
  misc_feature (384)..(384): n is a, c, g, or t
  modified_base (387)..(387): a, c, t, g, unknown or other
  misc_feature (387)..(387): n is a, c, g, or t
  modified_base (389)..(389): a, c, t, g, unknown or other
  misc_feature (389)..(389): n is a, c, g, or t
  modified_base (392)..(410): a, c, t, g, unknown or other
  misc_feature (392)..(410): n is a, c, g, or t
tcagtcgatcacgtcacgaccggtgctcgatttagtcgatagtgaagggccgattcaccatctccagagacaacgccaagaactcactgtatctgcaaatgaacagcctgagagccgaggacacggctgtatattactgtgcgagagtcacgtccgtcgctgcctacgtggggccagggaccctggtccaccgtctcctcagccctccaccaacgggcccagtcgtccttcccctggcncccctgcctaccgagggnccncccgtccgacgagccacacgcgggcccctggggcctcgccctgggtcgaacgggacctactttcccgacgttcgattccgaccgtgaacggcggcgtggccgaagggccgaccgataaggcngngtnangannnnnnnnnnnnnnnnnnn

SEQ ID NO: 204176 - DNA, 354 bp, Homo sapiens
  misc_feature: GYAE6OF01AYWCS.38.17.B06.1.454.CMB.1.raw
  modified_base (347)..(354): a, c, t, g, unknown or other
  misc_feature (347)..(354): n is a, c, g, or t
tcagtcgatcacgtcacgaccggtgctcgatttagtcgatagtgaagggccgattcaccatctccagagacaacgccaagaactcactgtatctgcaaatgaacagcctgagagccgaggacacggctgtatattactgtgcgagagtcacgtccgtcgctgcctactggggccagggaaccctggtcaccgtctcctcagcctccaccaagggccccagtccggtccttccccctggccgcccctgcctccaggagccacctccgagacgcacagccggccctgggcctgcctggtcaaggactacttccacgtgatcgactgagcgggctggcaaggcgcatagnnnnnnnn

SEQ ID NO: 204177 - DNA, 367 bp, Homo sapiens
  misc_feature: GYAE6OF01CN9AL.38.17.B06.1.454.CMB.1.raw
  modified_base (258)..(258): a, c, t, g, unknown or other
  misc_feature (258)..(258): n is a, c, g, or t
  modified_base (360)..(367): a, c, t, g, unknown or other
  misc_feature (360)..(367): n is a, c, g, or t
tcagtcgatcacgtcacgaccggtgctcgatttagtcgatagtgaagggccgattcaccatctccagagacaacgccaagaactcactgtatctgcaaatgaacagcctgagagccgaggacacggctgtatattactgtgcgagagtcacgtccgtcgctgcctacgtggggccagggaaccctggtccaccgtctcctcagcctccaccaagggcccatccggtccttccccctggccgccctgcctccgaggacnccacctccgagagcacagccggccctggggctcgcctggtaccaaggtacctaccttccacgttgactcgactggacgcgggctgggcaaggcgacagtagnnnnnnnn

SEQ ID NO: 204178 - DNA, 493 bp, Homo sapiens
  misc_feature: GYAE6OF01CTQ59.38.17.B06.1.454.CMB.1.raw
  modified_base (428)..(428): a, c, t, g, unknown or other
  misc_feature (428)..(428): n is a, c, g, or t
  modified_base (432)..(432): a, c, t, g, unknown or other
  misc_feature (432)..(432): n is a, c, g, or t
  modified_base (434)..(434): a, c, t, g, unknown or other
  misc_feature (434)..(434): n is a, c, g, or t
  modified_base (436)..(437): a, c, t, g, unknown or other
  misc_feature (436)..(437): n is a, c, g, or t
  modified_base (439)..(442): a, c, t, g, unknown or other
  misc_feature (439)..(442): n is a, c, g, or t
  modified_base (444)..(445): a, c, t, g, unknown or other
  misc_feature (444)..(445): n is a, c, g, or t
  modified_base (447)..(493): a, c, t, g, unknown or other
  misc_feature (447)..(493): n is a, c, g, or t
tcagtcgatcacgtcacgaccggtgctcgatttagtcgatagtgaagggccgattcaccatctccagagacaacgccaagaactcactgtatctgcaaatgaacagcctgagagccgaggacacggctgtatattactgtgcgagagtcacgtccgtcgctgcctactggggccagggaaccctgggtccacccgtctcctcagccctccaccgaaggggcccctatccggttccctttccccccgtgggcccgcccctgcctccgaggcgccacctccgagacgccacgacggcccggcccctggggcctcggcccgttgggtacccaaacgggtaccctttaccttacccgacgtcgtaacgtccggacgttcggacggtcccgggggctcggggaccgaacggggtcccggaactacgttacggntcgnancnncnnnngnngnnnnnnnnnnnnnnnnnnnnnnnnnnnnnnnnnnnnnnnnnnnnnnn

SEQ ID NO: 204179 - DNA, 611 bp, Homo sapiens
  misc_feature: GYAE6OF01C0ZR3.38.17.B06.1.454.CMB.1.raw
  modified_base (69)..(69): a, c, t, g, unknown or other
  misc_feature (69)..(69): n is a, c, g, or t
  modified_base (434)..(434): a, c, t, g, unknown or other
  misc_feature (434)..(434): n is a, c, g, or t
  modified_base (499)..(499): a, c, t, g, unknown or other
  misc_feature (499)..(499): n is a, c, g, or t
  modified_base (503)..(503): a, c, t, g, unknown or other
  misc_feature (503)..(503): n is a, c, g, or t
  modified_base (521)..(521): a, c, t, g, unknown or other
  misc_feature (521)..(521): n is a, c, g, or t
  modified_base (527)..(527): a, c, t, g, unknown or other
  misc_feature (527)..(527): n is a, c, g, or t
  modified_base (533)..(533): a, c, t, g, unknown or other
  misc_feature (533)..(533): n is a, c, g, or t
  modified_base (541)..(541): a, c, t, g, unknown or other
  misc_feature (541)..(541): n is a, c, g, or t
  modified_base (543)..(544): a, c, t, g, unknown or other
  misc_feature (543)..(544): n is a, c, g, or t
  modified_base (554)..(554): a, c, t, g, unknown or other
  misc_feature (554)..(554): n is a, c, g, or t
  modified_base (556)..(557): a, c, t, g, unknown or other
  misc_feature (556)..(557): n is a, c, g, or t
  modified_base (559)..(559): a, c, t, g, unknown or other
  misc_feature (559)..(559): n is a, c, g, or t
  modified_base (561)..(562): a, c, t, g, unknown or other
  misc_feature (561)..(562): n is a, c, g, or t
  modified_base (564)..(566): a, c, t, g, unknown or other
  misc_feature (564)..(566): n is a, c, g, or t
  modified_base (568)..(569): a, c, t, g, unknown or other
  misc_feature (568)..(569): n is a, c, g, or t
  modified_base (573)..(573): a, c, t, g, unknown or other
  misc_feature (573)..(573): n is a, c, g, or t
  modified_base (575)..(576): a, c, t, g, unknown or other
  misc_feature (575)..(576): n is a, c, g, or t
  modified_base (578)..(579): a, c, t, g, unknown or other
  misc_feature (578)..(579): n is a, c, g, or t
  modified_base (581)..(581): a, c, t, g, unknown or other
  misc_feature (581)..(581): n is a, c, g, or t
  modified_base (583)..(583): a, c, t, g, unknown or other
  misc_feature (583)..(583): n is a, c, g, or t
  modified_base (585)..(590): a, c, t, g, unknown or other
  misc_feature (585)..(590): n is a, c, g, or t
  modified_base (593)..(596): a, c, t, g, unknown or other
  misc_feature (593)..(596): n is a, c, g, or t
  modified_base (598)..(598): a, c, t, g, unknown or other
  misc_feature (598)..(598): n is a, c, g, or t
  modified_base (600)..(600): a, c, t, g, unknown or other
  misc_feature (600)..(600): n is a, c, g, or t
  modified_base (602)..(602): a, c, t, g, unknown or other
  misc_feature (602)..(602): n is a, c, g, or t
  modified_base (607)..(608): a, c, t, g, unknown or other
  misc_feature (607)..(608): n is a, c, g, or t
  modified_base (610)..(611): a, c, t, g, unknown or other
  misc_feature (610)..(611): n is a, c, g, or t
tcagtcgatcacgtcacgaccggtgctcgatttagtcgatagtgaagggccgattcaccatctccaganacaacgccaagaactcactgtatctgacaaatgaacagcctgagcggccgaggacacggctgtaatattactgtgacgagtactccaccgtccgtcgctcgacctaggtcgggacctaacgggtaacccttggtacctacccggtcttacctcgaccgtccctaccgaaaccggaaccgggacccttaacggtttccccggttaccccgtttccccggcgggtaccccgtcccgttacgtcccgtaacggaacgggacaccctaccggtaccggacgtaccgaccgaacggtccggacccggtcccggaggtcctcggacccggtaggtaaccgaaaccggtttacccttcgtaccgacggttanaccgtttaccggaacggtacggcgggtaccggcgtaacgggacgaacgggtcctaagacgttagntaancgagctagccagtgtacngtacgnattacnctagactnanncgattactananncnanncnnncnncgcncnncnncncncnnnnnnacnnnncncnancacanngnn

SEQ ID NO: 204180 - DNA, 337 bp, Homo sapiens
  misc_feature: GYAE6OF02IG87C.38.17.B06.1.454.CMB.1.raw
  modified_base (335)..(337): a, c, t, g, unknown or other
  misc_feature (335)..(337): n is a, c, g, or t
tcagtcgatcacgtcacgaccggtgctcgatttagtcgatagtgaagggccgattcaccatctccagagacaacgccaagaactcactgtatctgcaaatgaacagcctgagagccgaggacacggctgtatattactgtgcgagagtcacgtccgtcgctgcctactggggccagggaaccctggtcaccgtctcctcagcctccaccaagggcccatcggtcttccccctggcgccctgctccaggagcacctccgagagcacagcggccctgggctgcctggtcaaggactacttccacgtgatcgactgagcggctggcaaggcgcatagnnn

SEQ ID NO: 204181 - DNA, 339 bp, Homo sapiens
  misc_feature: GYAE6OF02H09EI.38.17.B06.1.454.CMB.1.raw
  modified_base (336)..(339): a, c, t, g, unknown or other
  misc_feature (336)..(339): n is a, c, g, or t
tcagtcgatcacgtcacgaccggtgctcgatttagtcgatagtgaagggccgattcaccatctccagagacaacgccaagaactcactgtatctgcaaatgaacagcctgagagccgaggacacggctgtatattactgtgcgagagtcacgtccgtcgctgcctactggggccagggaaccctggtcaccgtctcctcagcctccaccaagggcccatcggtcttccccctggcgccctgctccaggagcacctccgagagcacagcggccctgggctgcctggtcaaggactacttccacgtgatcgactgagcgggctggcaaggcgcatagnnnn

SEQ ID NO: 204182 - DNA, 665 bp, Homo sapiens
  misc_feature: GYAE6OF02JHZRS.38.17.B06.1.454.CMB.1.raw
  modified_base (465)..(465): a, c, t, g, unknown or other
  misc_feature (465)..(465): n is a, c, g, or t
  modified_base (509)..(509): a, c, t, g, unknown or other
  misc_feature (509)..(509): n is a, c, g, or t
tcagtcgatcacgtcacgaccggtgctcgatttagtcgatagtgaagggccgggtttcgatctcttcccgagacaattccaggaatgcactgtttctgcgaaactgaacaacttaagacgtcgatgacacggccgtctacttctgtcgcgaaagattttgatagcagtagttcgaatcatgatccggttgcttctggggccagggaccctggtcagttgctccgtccgcctaccaccaagggccccagtccgggtccttccccctggccacccctctaccaaagacgtcctaccttcgcgggggctaacgacggccggcccctagggggacctcgggcccttgggtacccaaagggtaccttaaccgtttcccgaacggtgtaacgttccgggaacttcggaacggccggggtactcggggacgaaacgggtccggaccgtaacgttaacgcgtcgtacgatcgncgtaacgctacgtcgaagcacgtactactacgtcgactactacncgacgacgacgtcgtcgacacgacgtacgtacgtacgtacgtacgtacgtagtacgtacgtacgtacgtacgtacgtactactacgtacgtacgtacgtacgtcgacgtacgtacgtacgtacgtacgtacgtacgtacgtacgtacgtacgtacg

SEQ ID NO: 204183 - DNA, 385 bp, Homo sapiens
  misc_feature: GYAE6OF02JT2W4.38.17.B06.1.454.CMB.1.raw
  modified_base (233)..(233): a, c, t, g, unknown or other
  misc_feature (233)..(233): n is a, c, g, or t
  modified_base (286)..(286): a, c, t, g, unknown or other
  misc_feature (286)..(286): n is a, c, g, or t
  modified_base (369)..(370): a, c, t, g, unknown or other
  misc_feature (369)..(370): n is a, c, g, or t
  modified_base (372)..(372): a, c, t, g, unknown or other
  misc_feature (372)..(372): n is a, c, g, or t
  modified_base (374)..(385): a, c, t, g, unknown or other
  misc_feature (374)..(385): n is a, c, g, or t
tcagtcgatcacgtcacgaccggtgctcgatttagtcgatagtgaagggccggattcaccatctccagagacaacgccaagaactcactgtatctgcaaatgaacagcctgagagccgaggacacggctgtatattactgtgcgagagtcacgtccgtcgctgcctactggggccagggaccctggtcaccgtctcctcagcctccaccagggcccatccggtccttcccccnggccgcccctggcctaccgaggacgccacctccgagacgcacagccggtcccncggggactcgccgtagggtaccaaggacctaccgtcccaacggtgaagtccgacgtgacgcgggctggaccaggcgcatagcnnangnnnnnnnnnnnn

SEQ ID NO: 204184 - DNA, 869 bp, Homo sapiens
  misc_feature: GYAE6OF02FLZGI.38.17.B06.1.454.CMB.1.raw
tcagtcgatcacgtcacgaccggtgctcgatttagtcgatagtgaagggggtctcagagaggagccttagccctggactccaaggcctttccacttggtgatcagcactgagcacagaggactcaccatggaattgggctgagctgggttttccttgttgctattttagaaggtgtccagtgtgaggtgcagctggtggagtcgtgggggagcgttggtccgaggccgggggggtccctgacgactctcctgtcgacacggtcctgtggtacttccacttcccgtttaggtacgtaacgttattacggggaacttacggtaacccggttcgggggttccccggtacccgggtaaccgggggttaccccggaaggggggggttaaacggggggccgttaaggggggtaacgggtttggggggtaccgggtaaccctaaaagtttaaacggttaaaaaacgggaccgtaaaaaggtaacggttaacggggtaaaagggttacggaaaagggtaaaacttaaccgttaacggtacggttacggtaaccgttacgttacgggttacgggaaccggggtaccctaagtttacccaaccgtacttaccgacccggtaaaggaaccgtaacccgaaaccgtaccgaaaaacgtaacctaacggtacccttagttactacgtacgtaacaaagtacgaaacgtccgtcgtaaacgcggtaaccggacggaaccgggtaccgaaccgttccgttaagttaaccgttaatttaccggacggttacggaaaccggtaaggtaccgttaacccgtaaccgtttccggacccgttccgtaccggttacccgtacggggttcccggggtaacctaacccgggg

SEQ ID NO: 204185 - DNA, 704 bp, Homo sapiens
  misc_feature: GYAE6OF02IXWJ2.38.17.B06.1.454.CMB.1.raw
tcagtcgatcacgtcacgaccggtgctcgatttagtcgatagtgaaggggttctcagagaggagccttagccctggactccaaggcctttccacttggtgatcagcactgagcacagaggactcaccatggaattggggctgagctgggttttccttgttgcttattttagaaggtgtccagtgtgaggtgcagctggtggagtcgtgggggaggtcgttggtcaggccgggggggtccctgagactctccgtgtgcagcctgtggtattcatccttagtcgactatggatgaccgtggtcccgccgtacggggtccgaggggaaggggcgtagggaggtggggtacggaccaaagtaataaaggaccgtaaaggtagtagggaaacgttggaaagtaaaacgtacgttagttaggtacggtacttgtaggtaggaacgggtaccgtacgtttaccgacctaacgtaccctacccgaaaggacgtaacccaaaccgaccgaaaacggtaacctaccgtaacgtacggttataccgtaggaacctaaaacgtagaaaccgtacgtcctaaggtaacgggaaccggtacccggaagggtaacccgaacgggtccttaagggtactttaacgttacgtggtacggacggtaagaaccgtccgaccgttccgcgtcgtacgtcccgtaaggtccgggaactaaccggg

SEQ ID NO: 204186 - DNA, 854 bp, Homo sapiens
  misc_feature: GYAE6OF02JDQKN.38.17.B06.1.454.CMB.1.raw
tcagtcgatcacgtcacgaccggtgctcgatttagtcgatagtgaaggggttctcagagaggagccttagccctggactccaaggcctttccacttggtgatcagcactgagcacagaggactcaccatggaattggggctgagcttgggttttccttgttgcttattttagaaggtgtccagtgtgaggtgcaggcgtggtggagtcgtgggggacgcgtttcgggtccgacgggtcccgggggggtccctggacggactctccgtggtcgccaggtccctgtcggtattcacttaccttaggtcgaccttagttcggaagttcggaccccggttaggggtacccgtacccggtacggggtacccggaaggggggtaaccggggtcgtaggggtaacgggttacgggggtaccgtacccgtaaaagttaaaggtaaacggaacgtaacggtaagtaacgggtaggtaagaaacggtaaaacttgtaggtttacgtaacggtacgttacgttacgggttaaacgggaaaccgggttcccgtaaacggtttccctaaaccgtacgtttacccggtacccggtaaacggtaaccggtaaacccgtaaacccggaaccccgtaaaaacgtaaccgttaaacccgtaacggtttaaccggttaactaccgggttacgtaaaccgtaaaagtaacccgggaaaccgtaacggtaacccgtaggaaccgggtaaccgtacccggaacggtaaccgacggtacttaagtacttacgtacgttggtacgacggtacgttaacggccttaaccggtccgtaccgtacggtacgttccggacggtccgggaccggtaacccggg

SEQ ID NO: 204187 - DNA, 697 bp, Homo sapiens
  misc_feature: GYAE6OF02H5VGZ.38.17.B06.1.454.CMB.1.raw
  modified_base (168)..(168): a, c, t, g, unknown or other
  misc_feature (168)..(168): n is a, c, g, or t
  modified_base (623)..(623): a, c, t, g, unknown or other
  misc_feature (623)..(623): n is a, c, g, or t
  modified_base (655)..(655): a, c, t, g, unknown or other
  misc_feature (655)..(655): n is a, c, g, or t
tcagtcgatcacgtcacgaccggtgctcgatttagtcgatagtgaaggggttctcagagaggagccttagccctggactccaaggcctttccacttggtgatcagccactgagcacagaggactcaccatggaattgggctgagctggtttctgtgctatttagagtntccagtgtgaggtgcgagcgtggtggacgtcggtgggggcggtcgttcgggtccgaggggtccccgggggggttacctggacgtacgttccttccgtggtcgcacggtcctcgtggacttcacttacgtagtacgacttagtttggactcgtaccggtcgggttcccgacccgtaggggtccgaagggggtaacggcgttgggaggttcggggtacgacctaaagtaataaacgcgtaagtagtagggaaagtccgaaagtaaatacgttacgtgtacggacttcgaagttaacgggcgggtactcttaccgaacctatccgtaccgaaggtacgaaaccgaacgtaaacgtaacgaacctagtaacgttagtactttacgagaactaaagtccgaaagttccgacgtagacgaccgacggacggtaaccgcggttatagttacgtattaccggngtaacggcgttaacgcgtaacccgtcgttccnccgttacgccgttaccggtacgggtccggacggttaacccgg

SEQ ID NO: 204188 - DNA, 490 bp, Homo sapiens
  misc_feature: GYAE6OF01B61ZP.8.11.A11.1.454.CMB.1.raw
  modified_base (474)..(490): a, c, t, g, unknown or other
  misc_feature (474)..(490): n is a, c, g, or t
tcagctcgcgtgtccacgaccggtgctcgatttagctacgactgcagggtcctgggcccagtccgtgctgacgcagccgccctcagtgtctggggccccaggccagagggtcgccatctcctgcactgggaacaactccaacatcggggcaggtcatgatgtacattggtaccagcagtttccaggaaaagcccccggactcctcatttttgttaacaacgatcgcccctcaggggtccctgaccgcttctctggctccaggtctggcgcctctgcctccctggccatcgctgggcctccaccttgacgatgagggtttttatactgccagtcgtacgacgacagtctgactgccccggtgttcgggcgcgggacaaggtgaccgtctgagtcagcccaaggctcgcccccaggtccactctcgttcccaccctcctcgacacgcgagctgacgcgggctggcaggcgcatagnnnnnnnnnnnnnnnnn

SEQ ID NO: 204189 - DNA, 471 bp, Homo sapiens
  misc_feature: GYAE6OF01D97WP.8.11.A11.1.454.CMB.1.raw
  modified_base (387)..(387): a, c, t, g, unknown or other
  misc_feature (387)..(387): n is a, c, g, or t
  modified_base (432)..(432): a, c, t, g, unknown or other
  misc_feature (432)..(432): n is a, c, g, or t
  modified_base (437)..(437): a, c, t, g, unknown or other
  misc_feature (437)..(437): n is a, c, g, or t
  modified_base (442)..(442): a, c, t, g, unknown or other
  misc_feature (442)..(442): n is a, c, g, or t
  modified_base (446)..(446): a, c, t, g, unknown or other
  misc_feature (446)..(446): n is a, c, g, or t
  modified_base (461)..(461): a, c, t, g, unknown or other
  misc_feature (461)..(461): n is a, c, g, or t
  modified_base (464)..(471): a, c, t, g, unknown or other
  misc_feature (464)..(471): n is a, c, g, or t
tcagctcgcgtgtccacgaccggtgctcgatttagctacgactgcagggtcctgggcccagtccgtgctgacgcagccgccctcagtgtctggggccccaggccagagggtcgccatctcctgcactgggaacaactccaacatcggggcaggtcatgatgtacattggtaccagcagtttccaggaaaagcccccggactcctcatttttgtaacaacgatcgcccctcacggggtccctgaccgcttctctggctccaggtctggcgcctctgcctccctggccatcgctggctccaccttgacgatggtagggtttttatactgccagtcgtacgacgacagtctgactcgcccggtgtcggcggcggacaaggtcgaccgtcngagtcagcccaagctcgcccccagtcactctcgtcccgccctccncgacncgcgnctgngcggctggcaggcgnatnnnnnnnn

SEQ ID NO: 204190 - DNA, 596 bp, Homo sapiens
  misc_feature: GYAE6OF01BW7UD.8.11.A11.1.454.CMB.1.raw
  modified_base (205)..(205): a, c, t, g, unknown or other
  misc_feature (205)..(205): n is a, c, g, or t
  modified_base (572)..(572): a, c, t, g, unknown or other
  misc_feature (572)..(572): n is a, c, g, or t
  modified_base (574)..(574): a, c, t, g, unknown or other
  misc_feature (574)..(574): n is a, c, g, or t
  modified_base (576)..(580): a, c, t, g, unknown or other
  misc_feature (576)..(580): n is a, c, g, or t
  modified_base (583)..(596): a, c, t, g, unknown or other
  misc_feature (583)..(596): n is a, c, g, or t
tcagctcgcgtgtccacgaccggtgctcgatttagctacgactgcagggtcctgggcccagtccgtgctgacgcagccgccctcagtgtctggggccccaggccagagggtcgccatctcctgcactgggaacaactccaacatcggggcaggtcatgatgtacattggtaccagcagtttccaggaaaacgccccggactcctntatttttagttaacaacgactccgcccctcgacgggtccctgaccgtcttctctggctcgaggtcgtggccgtcctctcgccctccgtcggccagtccgcgtcgggcctccgtaccttgacgtagttggttacggtttttactacgtcgaccgtagtccgtaacgacgactagtctcgtacgtcggcccggttgtcgggcgggacggaccgaaggtcgaccgtcgtagacgtcgacgacccgaaggcctcccgaccccgtacgtctaccgttccgttaccggttccccaccccgtccgtaccgaccgtacccggtcgacgtcgtacggacggccgggtcgcgggtaccgaacggccgacgagtacgnancnnnnncgnnnnnnnnnnnnnn

SEQ ID NO: 204191 - DNA, 519 bp, Homo sapiens
  misc_feature: GYAE6OF01DP1OS.8.11.A11.1.454.CMB.1.raw
  modified_base (442)..(442): a, c, t, g, unknown or other
  misc_feature (442)..(442): n is a, c, g, or t
  modified_base (507)..(507): a, c, t, g, unknown or other
  misc_feature (507)..(507): n is a, c, g, or t
  modified_base (509)..(519): a, c, t, g, unknown or other
  misc_feature (509)..(519): n is a, c, g, or t
tcagctcgcgtgtccacgaccggtgctcgatttagctacgactgcagggtcctgggcccagtccgtgctgacgcagccgccctcagtgtctggggccccaggccagagggtctccatctcctgcactgggagcagaaccagcagtcggggcaggttatgatgtttcatttggaccgccgaggttccaggcacacgcccccagactcctcattaatgaataaacaacaatccggccctcgaggggtctctgaccgtattctctgccctaccaagttctggcctacttctcgcctcctggtccattatctggtcctcgagggtgaggatgaggtctagtatttatactcgacctactctatgaacaacagctgtagttatttggctggttcggcgggcggactagtcgaccgtcctacgcacgccgagcctcgccccgtcgtcnctctccgttcccgccttcacgcacgcgacgctacggagcgggctcggggacacgggcgcaaagtncnnnnnnnnnnn

SEQ ID NO: 204192 - DNA, 884 bp, Homo sapiens
  misc_feature: GYAE6OF01AZK26.8.11.A11.1.454.CMB.1.raw
  modified_base (861)..(861): a, c, t, g, unknown or other
  misc_feature (861)..(861): n is a, c, g, or t
tcagctcgcgtgtccacgaccggtgctcgatttagctacgactgcagggtcctgggcccagtccgtgctgacgcagccgccctcagtgtctggggccccaggccagagggtcgccatctcctgcactgggaacaactccaacatcggggcaggtcatgatgtacattggtaccagcagtttccaaggaaaacgcccccggactcctctatttttgtaaacaacgatccgcccctcgacggggtccctgaccgcttctctggcctccgaggtctggcgcctctcgccctcccgtcggccagtccgcgtcgggaccttccccgtacccgtttggaaccgtagtttcgggttaacggggtttttttacttaccgttcggacccgtaaggttccgtaaccggaaccgtaaccgtacggttcctacggtaaccgttccgggtccccccggggtttgggtttcccggggaccgggggtttacggggaaaccccgtaaacggggttccgggtaacccccggtttcccgttacgggaaccggtttacccgaaaccgggtaccccccggtaaaacggggtccccgtttaccccgggtaccccccccccggttaacggggttaccccttaaccccggttttccccgtttccccggggttttaccccccccggtccccccgtttaccccggttaaccccgggtaaaccccggacccggggtaccccggtaaccggtcccggtttaaccgggccggggttaccccgggggtacccgtttaccggggaaccccgggaaaccggggtccccggtaacccgtaaacggtttccgggaccgtacgacggtcgaccgtccgtagacgtcggtcaccgnacgcgcgtcgacacgcgcgcgcg

SEQ ID NO: 204193 - DNA, 520 bp, Homo sapiens
  misc_feature: GYAE6OF01D9ZQD.8.11.A11.1.454.CMB.1.raw
  modified_base (356)..(356): a, c, t, g, unknown or other
  misc_feature (356)..(356): n is a, c, g, or t
  modified_base (400)..(400): a, c, t, g, unknown or other
  misc_feature (400)..(400): n is a, c, g, or t
  modified_base (407)..(407): a, c, t, g, unknown or other
  misc_feature (407)..(407): n is a, c, g, or t
  modified_base (478)..(478): a, c, t, g, unknown or other
  misc_feature (478)..(478): n is a, c, g, or t
  modified_base (501)..(501): a, c, t, g, unknown or other
  misc_feature (501)..(501): n is a, c, g, or t
  modified_base (503)..(520): a, c, t, g, unknown or other
  misc_feature (503)..(520): n is a, c, g, or t
tcagctcgcgtgtccacgaccggtgctcgatttagctacgactgcagggtcctgggcccagtccgtgctgacgcagccgccctcagtgtctggggccccaggccagagggtcgccatctcctgcactgggaacaactccaacatcggggcaggtcatgatgtacattggtaccagcagtttccaaggaaaagcccccggactcctctattttttagttaacaacgatccgccccttcgacggggtccctgacccgctttctctggcctccaggtctggcgcctctgccctccctggccatcgctcgggctccacttgacgattggagggtttttatctgccagttcgaacgcgacngtctgactcgccccggttgtcggcggcggacaggtcgaccgtcngactcgngcccaggctcgccccaggtcactctcgtcccgccctccgtcaccgacgcgacgcgtcgacgggccggtcgnggacccgacggcgacgatacggncnnnnnnnnnnnnnnnnnn

SEQ ID NO: 204194 - DNA, 729 bp, Homo sapiens
  misc_feature: GYAE6OF01BVT7I.8.11.A11.1.454.CMB.1.raw
  modified_base (716)..(716): a, c, t, g, unknown or other
  misc_feature (716)..(716): n is a, c, g, or t
  modified_base (720)..(720): a, c, t, g, unknown or other
  misc_feature (720)..(720): n is a, c, g, or t
  modified_base (722)..(723): a, c, t, g, unknown or other
  misc_feature (722)..(723): n is a, c, g, or t
  modified_base (725)..(725): a, c, t, g, unknown or other
  misc_feature (725)..(725): n is a, c, g, or t
  modified_base (727)..(727): a, c, t, g, unknown or other
  misc_feature (727)..(727): n is a, c, g, or t
  modified_base (729)..(729): a, c, t, g, unknown or other
  misc_feature (729)..(729): n is a, c, g, or t
tcagctcgcgtgtccacgaccggtgctcgatttagctacgactgcagggtcctgggcccagtccgtgctgacgcagccgccctcagtgtctggggccccaggccagagggtcgccatctcctgcactgggaacaactccaacatcggggcaggtcatgatgtacattggtaccagctagtttaccgaaggaaaaccgcccccggactcctacattaagtgaactaaacaactaacgtccggtccctcgacggggtctcgtacgaccgtattccgtcgtcgtccctaccgtaagttccgtggcctaccttcgtcgtcccttcccgtggttaccattacttcgtcggttccgtaccggaggggtcgaaggtagtacgggacggtcgtagttactttaacttaccgtcgtaccctaccgttaccgtacgtacgaaccaaacgtaccgtcccgtagttaagtttacgtttcgggtcgttcggggttccgggacccggggtaccgggtaaaccgttacggtttacccgggtacccggttacccgttaccggtaccaccggtacccgaacggtccgtacccggtcccccgttcgtacccgtacgttcccgttacccggttcccccgccccgttcccgtaccgaccgccggccggtacggtcgtagggacggccgggtccgtagggtacgaccggcggtaccaagttacggactgactgctgnacgncnncngngn

SEQ ID NO: 204195 - DNA, 677 bp, Homo sapiens
  misc_feature: GYAE6OF01DCUS6.8.11.A11.1.454.CMB.1.raw
  modified_base (560)..(560): a, c, t, g, unknown or other
  misc_feature (560)..(560): n is a, c, g, or t
  modified_base (655)..(655): a, c, t, g, unknown or other
  misc_feature (655)..(655): n is a, c, g, or t
  modified_base (658)..(663): a, c, t, g, unknown or other
  misc_feature (658)..(663): n is a, c, g, or t
  modified_base (665)..(672): a, c, t, g, unknown or other
  misc_feature (665)..(672): n is a, c, g, or t
  modified_base (674)..(677): a, c, t, g, unknown or other
  misc_feature (674)..(677): n is a, c, g, or t
tcagctcgcgtgtccacgaccggtgctcgatttagctacgactgcagggtcctgggcccagtccgtgctgacgcagccgccctcagtgtctggggccccaggccagagggtcgccatctcctgcactgggaacaactccaacagtcggggcaggtcatgatgtacattggtaccagctagtttccaaggaaaacgcccccgacttcctacttattttacgtaacacgactccgcccctcgacggggtcccctacgtacccgtccttccgtctcgggcctaccgcggtccgtggcccgcccttccgtccgtccccttcccgtcggcctacgtccgcgttcgggcctccctacgttcggacgttagttgggtttaggtttttactacgtcggtcctaggttaccgtacgacgtactacgttcgtcgtaccgtcggtccccggttggtccgggcgggaccggaaccggtacggtcgacccgtcgtaggacgtaccgacggacccgaggtcccgtccccgaccccgttaccggtacctcccttcccgttcccgtttaccccccnccccgttcccgtaccgtaccgacccggtccggtacgtccggtacgggaccggggtccggtcggtaccgggaccggacggtccgaccgtaggacgncgnnnnnngnnnnnnnnannnn

SEQ ID NO: 204196 - DNA, 548 bp, Homo sapiens
  misc_feature: GYAE6OF02IULZW.8.11.A11.1.454.CMB.1.raw
  modified_base (232)..(232): a, c, t, g, unknown or other
  misc_feature (232)..(232): n is a, c, g, or t
  modified_base (500)..(500): a, c, t, g, unknown or other
  misc_feature (500)..(500): n is a, c, g, or t
  modified_base (526)..(527): a, c, t, g, unknown or other
  misc_feature (526)..(527): n is a, c, g, or t
  modified_base (530)..(530): a, c, t, g, unknown or other
  misc_feature (530)..(530): n is a, c, g, or t
  modified_base (533)..(548): a, c, t, g, unknown or other
  misc_feature (533)..(548): n is a, c, g, or t
tcagctcgcgtgtccacgaccggtgctcgatttagctacgactgcagggtcctgggcccagtccgtgctgacgcagccgccctcagtgtctggggccccaggcccagagggtcgccatctcctgcactgggaacaactccaacatcggggcaggtcatgatgtacattggtaccagcagtttccaggaaaagcccccggatcctctatttttgttaacaacgatcgcccctnaggggtccctgaccgcttctctggctccaggtctggcgcctctcgcctcctggccatcgctgggcctccaccttgacgtatgtaggtttttatactgcctagtcgtacgacgacaggttctgacgtcgccccggttgttcggcgggacgggacccaagggtcgacctcctggagtccacggcccgaagggctcccggaccccctacgggtcctacctcgtccttccccgaccctccgtcccgacacgccgagtcctggacggccgggntacgggcaaacgggccacgtaatcgnnctngcnnnnnnnnnnnnnnnn

SEQ ID NO: 204197 - DNA, 484 bp, Homo sapiens
  misc_feature: GYAE6OF02GMFZP.8.11.A11.1.454.CMB.1.raw
  modified_base (469)..(469): a, c, t, g, unknown or other
  misc_feature (469)..(469): n is a, c, g, or t
  modified_base (474)..(484): a, c, t, g, unknown or other
  misc_feature (474)..(484): n is a, c, g, or t
tcagctcgcgtgtccacgaccggtgctcgatttagctacgactgcagggtcctgggcccagtccgtgctgacgcagccgccctcagtgtctggggccccaggccagagggtcgccatctcctgcactgggaacaactccaacatcggggcaggtcatgatgtacattggtaccagcagtttccaggaaaacgcccccggactcctctatttttgttaacaacgatccgcccctcaggggtccctgaccgcttctctggctccgaggtctggcgcctctgcctcctggccatcgctgggctccaccttgacgatgagggtttttatactgccagtcgtacgacgacagtctgactgcccgtgtcggcggcgggacaggtcgaccgtcctgacgtcacgcccaaggctcgccccacggtcactctcgtccccaccctcctcgacacgcgacgctgaggcggctggcaggcncatgnnnnnnnnnnn

SEQ ID NO: 204198 - DNA, 503 bp, Homo sapiens
  misc_feature: GYAE6OF02GCFM1.8.11.A11.1.454.CMB.1.raw
  modified_base (229)..(229): a, c, t, g, unknown or other
  misc_feature (229)..(229): n is a, c, g, or t
  modified_base (267)..(267): a, c, t, g, unknown or other
  misc_feature (267)..(267): n is a, c, g, or t
  modified_base (341)..(341): a, c, t, g, unknown or other
  misc_feature (341)..(341): n is a, c, g, or t
  modified_base (384)..(384): a, c, t, g, unknown or other
  misc_feature (384)..(384): n is a, c, g, or t
  modified_base (431)..(431): a, c, t, g, unknown or other
  misc_feature (431)..(431): n is a, c, g, or t
  modified_base (480)..(481): a, c, t, g, unknown or other
  misc_feature (480)..(481): n is a, c, g, or t
  modified_base (483)..(488): a, c, t, g, unknown or other
  misc_feature (483)..(488): n is a, c, g, or t
  modified_base (490)..(503): a, c, t, g, unknown or other
  misc_feature (490)..(503): n is a, c, g, or t
tcagctcgcgtgtccacgaccggtgctcgatttagctacgactgcagggtcctgggcccagtccgtgctgacgcagccgccctcagtgtctggggccccaggccagagggtcgccatctcctgcactgggaacaactccaacatcggggcaggtcatgatgtacattggtaccagcagtttccaggaaaagcccccggatcctcatttttgtaacaacgatcgcccctnaggggtccctgaccgcttctctggctccaggtctggcncctctgcctccctggccatcgctgggctccaccttgacgatgtagggtttttatactgccagtcgtacgacganagtctgactgcccgtgttcggcgcgggaccaaggtcaccgtcngagtcagcccaaggcctgcccccaggtcatctcgttccccacctccncgacacgcgagtcctgagccgggctgggacgtaaggccgcaagttacgnngnnnnnngnnnnnnnnnnnnnn

SEQ ID NO: 204199 - DNA, 497 bp, Homo sapiens
  misc_feature: GYAE6OF02FUSEQ.8.11.A11.1.454.CMB.1.raw
  modified_base (394)..(394): a, c, t, g, unknown or other
  misc_feature (394)..(394): n is a, c, g, or t
  modified_base (443)..(443): a, c, t, g, unknown or other
  misc_feature (443)..(443): n is a, c, g, or t
  modified_base (482)..(497): a, c, t, g, unknown or other
  misc_feature (482)..(497): n is a, c, g, or t
tcagctcgcgtgtccacgaccggtgctcgatttagctacgactgcagggtcctgggcccagtccgtgctgacgcagccgccctcagtgtctggggccccaggccagagggtcgccatctcctgcactgggaacaactccaacatcggggcaggtcatgatgtacattggtaccagcagtttccaggaaaagcccccggactcctcatttttgttaacaacgatcgcccctcaggggtccctgacccgcttctctggctccaggtctggcgcctctgccctccctggccatcgctgggcctccaccttgacgatgtagggtttttattactgccagtcgtacgacgacagtctgactgccccggtgtcggcggcgggacaaggtcgaccgtccgngagtcagcccaaggctcgcccccacggtcactctcgttcccaccctccnccgacacgcgacgctgacgcgggctggcaggcgcatagnnnnnnnnnnnnnnnn

SEQ ID NO: 204200 - DNA, 513 bp, Homo sapiens
  misc_feature: GYAE6OF02FSPPW.8.11.A11.1.454.CMB.1.raw
  modified_base (230)..(230): a, c, t, g, unknown or other
  misc_feature (230)..(230): n is a, c, g, or t
  modified_base (307)..(307): a, c, t, g, unknown or other
  misc_feature (307)..(307): n is a, c, g, or t
  modified_base (342)..(342): a, c, t, g, unknown or other
  misc_feature (342)..(342): n is a, c, g, or t
  modified_base (455)..(455): a, c, t, g, unknown or other
  misc_feature (455)..(455): n is a, c, g, or t
  modified_base (491)..(498): a, c, t, g, unknown or other
  misc_feature (491)..(498): n is a, c, g, or t
  modified_base (500)..(513): a, c, t, g, unknown or other
  misc_feature (500)..(513): n is a, c, g, or t
tcagctcgcgtgtccacgaccggtgctcgatttagctacgactgcagggtcctgggcccagtccgtgctgacgcagccgccctcagtgtctggggccccaggccagagggtcgccatctcctgcactgggaacaactccaacatcggggcaggtcatgatgtacattggtaccagcagtttccaggaaaagcccccggactcctcatttttgtaacaacgatcgcccctnaggggtccctgaccgcttctctggctccaggtctggcgcctctgcctcctggccatcgctgggcctccacttgacgntggtaggtttttatactgccagtcgtacgacgacngtctgactgccccggtgttcggcggcggacaggtcgaccgtcctgagtcacgcccaaggcctcgccccaggtccactcgtcgttccccgccctccctcgaccacgcgacgtcngacgccgggctcgggacgacgggcgacgtacgtagnnnnnnnngnnnnnnnnnnnnnn

SEQ ID NO: 204201 - DNA, 641 bp, Homo sapiens
  misc_feature: GYAE6OF02IUE8M.8.11.A11.1.454.CMB.1.raw
  modified_base (280)..(280): a, c, t, g, unknown or other
  misc_feature (280)..(280): n is a, c, g, or t
  modified_base (607)..(608): a, c, t, g, unknown or other
  misc_feature (607)..(608): n is a, c, g, or t
  modified_base (610)..(610): a, c, t, g, unknown or other
  misc_feature (610)..(610): n is a, c, g, or t
  modified_base (615)..(615): a, c, t, g, unknown or other
  misc_feature (615)..(615): n is a, c, g, or t
  modified_base (618)..(618): a, c, t, g, unknown or other
  misc_feature (618)..(618): n is a, c, g, or t
  modified_base (622)..(622): a, c, t, g, unknown or other
  misc_feature (622)..(622): n is a, c, g, or t
  modified_base (629)..(629): a, c, t, g, unknown or other
  misc_feature (629)..(629): n is a, c, g, or t
  modified_base (633)..(633): a, c, t, g, unknown or other
  misc_feature (633)..(633): n is a, c, g, or t
  modified_base (639)..(639): a, c, t, g, unknown or other
  misc_feature (639)..(639): n is a, c, g, or t
tcagctcgcgtgtccacgaccggtgctcgatttagctacgactgcagggtcctgggcccagtccgtgctgacgcagccgccctcagtgtctggggccccaggccagagggtcgccatctcctgcactgggaacaactccaacatcggggcaggtcatgatgtacattggtaccagcagtttccaaggaaaacgcccccggactcctctattttttgttaacaacgatccgcccctcgacggggtccctgacccgtcttctctggcctccgagtctggccncctctcgcctcccgtcggccactcgcgtgggcctcctaccgttcgacgtagttggttagggttttttacttacgtgcctagttccgtaaccgacgactacgttctagactcggccccggttggttcgggccggcgggacaagggtcgaccgttctggacgtccgacgcccgaacggcctcccgacccccgacggtccctaccgttcccttccggttcccccgcccttcccgtacccggaaccgaccggtcgacgtccgttagggaccgggtccgggtaccgtcgggacccggtaaacgggccggtacgtaacgtacgtacgcgacgnncncgcgnacngcgngagcgcncganacgcgngc

SEQ ID NO: 204202 - DNA, 499 bp, Homo sapiens
  misc_feature: GYAE6OF02G414V.8.11.A11.1.454.CMB.1.raw
  modified_base (229)..(229): a, c, t, g, unknown or other
  misc_feature (229)..(229): n is a, c, g, or t
  modified_base (362)..(362): a, c, t, g, unknown or other
  misc_feature (362)..(362): n is a, c, g, or t
  modified_base (381)..(381): a, c, t, g, unknown or other
  misc_feature (381)..(381): n is a, c, g, or t
  modified_base (428)..(428): a, c, t, g, unknown or other
  misc_feature (428)..(428): n is a, c, g, or t
  modified_base (434)..(434): a, c, t, g, unknown or other
  misc_feature (434)..(434): n is a, c, g, or t
  modified_base (438)..(438): a, c, t, g, unknown or other
  misc_feature (438)..(438): n is a, c, g, or t
  modified_base (444)..(444): a, c, t, g, unknown or other
  misc_feature (444)..(444): n is a, c, g, or t
  modified_base (475)..(475): a, c, t, g, unknown or other
  misc_feature (475)..(475): n is a, c, g, or t
  modified_base (477)..(477): a, c, t, g, unknown or other
  misc_feature (477)..(477): n is a, c, g, or t
  modified_base (480)..(480): a, c, t, g, unknown or other
  misc_feature (480)..(480): n is a, c, g, or t
  modified_base (482)..(491): a, c, t, g, unknown or other
  misc_feature (482)..(491): n is a, c, g, or t
  modified_base (493)..(499): a, c, t, g, unknown or other
  misc_feature (493)..(499): n is a, c, g, or t
tcagctcgcgtgtccacgaccggtgctcgatttagctacgactgcagggtcctgggcccagtccgtgctgacgcagccgccctcagtgtctggggccccaggccagagggtcgccatctcctgcactgggaacaactccaacatcggggcaggtcatgatgtacattggtaccagcagtttccaggaaaagcccccggactcctcatttttgtaacacgatcgcccctnacggggtccctgaccgcttctctgggctccaggtctggcgtcctctgcctccctggccatcgctggctccaccttgacgatgtaggtttttatactgccagtcgtacgacgactcgtctgactcgcccggttntcgggcggtcggacaggtnacgtcctgacgtcacgcccaaggctcgccccgagcactctcgtcccncctccncgcncgcgancgtcgagcggctcggcgaggccgacagtagnancgncnnnnnnnnnncnnnnnnn

SEQ ID NO: 204203 - DNA, 690 bp, Homo sapiens
  misc_feature: GYAE6OF02HGMIN.8.11.A11.1.454.CMB.1.raw
  modified_base (312)..(312): a, c, t, g, unknown or other
  misc_feature (312)..(312): n is a, c, g, or t
  modified_base (321)..(321): a, c, t, g, unknown or other
  misc_feature (321)..(321): n is a, c, g, or t
  modified_base (679)..(679): a, c, t, g, unknown or other
  misc_feature (679)..(679): n is a, c, g, or t
  modified_base (683)..(684): a, c, t, g, unknown or other
  misc_feature (683)..(684): n is a, c, g, or t
  modified_base (686)..(686): a, c, t, g, unknown or other
  misc_feature (686)..(686): n is a, c, g, or t
  modified_base (688)..(690): a, c, t, g, unknown or other
  misc_feature (688)..(690): n is a, c, g, or t
tcagctcgcgtgtccacgaccggtgctcgatttagctacgactgcagggtcctgggcccagtccgtgctgacgcagccgccctcagtgtctggggccccaggccagagggtcgccatctcctgcactgggaacaactccaacatcggggcaggtcatgatgttcattggtaccgccaggttccaggcacagcccccagacctcctcattaatgataacaacaatccggccctcgaggggtctctgaccgtattctctcgcctccaagtctggtcacttctgccctcctggtcatatcgtggtctcgtagggngaggatggngcgttgaatttattactcgaccctacgttaccttatcgtaacaaactacggacccttaggtaggtttaagttttcggggtctttcgggtttaccggggaccgggtaccgggggtaaacccgtaaacgggttttacccggaacccgggtttccccgttaaccgggtaccaaccgggtacccctaaacgggggtcccttccgggtaccccccccgttacgggttcccgttacccttccgttcccgtttacccctacccccttacccgtccgacccgtaccggccgtacgtaccgttacggacgggtccggggaccgttacgggacgaaccgggccggaccgtaggtaacgtcgatacgcngcgnngncnnn

SEQ ID NO: 204204 - DNA, 577 bp, Homo sapiens
  misc_feature: GYAE6OF02HXN71.8.11.A11.1.454.CMB.1.raw
  modified_base (472)..(472): a, c, t, g, unknown or other
  misc_feature (472)..(472): n is a, c, g, or t
  modified_base (513)..(513): a, c, t, g, unknown or other
  misc_feature (513)..(513): n is a, c, g, or t
  modified_base (529)..(529): a, c, t, g, unknown or other
  misc_feature (529)..(529): n is a, c, g, or t
  modified_base (539)..(540): a, c, t, g, unknown or other
  misc_feature (539)..(540): n is a, c, g, or t
  modified_base (542)..(542): a, c, t, g, unknown or other
  misc_feature (542)..(542): n is a, c, g, or t
  modified_base (546)..(546): a, c, t, g, unknown or other
  misc_feature (546)..(546): n is a, c, g, or t
  modified_base (549)..(549): a, c, t, g, unknown or other
  misc_feature (549)..(549): n is a, c, g, or t
  modified_base (555)..(555): a, c, t, g, unknown or other
  misc_feature (555)..(555): n is a, c, g, or t
  modified_base (560)..(560): a, c, t, g, unknown or other
  misc_feature (560)..(560): n is a, c, g, or t
  modified_base (564)..(564): a, c, t, g, unknown or other
  misc_feature (564)..(564): n is a, c, g, or t
  modified_base (571)..(571): a, c, t, g, unknown or other
  misc_feature (571)..(571): n is a, c, g, or t
  modified_base (573)..(575): a, c, t, g, unknown or other
  misc_feature (573)..(575): n is a, c, g, or t
  modified_base (577)..(577): a, c, t, g, unknown or other
  misc_feature (577)..(577): n is a, c, g, or t
tcagctcgcgtgtccacgaccggtgctcgatttagctacgactgcaggtcctgggcccagtccgtgctgacgcagccgccctcagtgtctggggccccaggccagagggtcgccatctcctgcactgggaacaactccaacatcggggcaggtcatgatgtacattggtaccagctagtttccaggaaaacgcccccggactcctctatttttagtaacaacgactccgcccctcgacggggtccctgacccgtctttccgtcctggcctccgaggtctggccgtccctctcgccctccctggcccatcgctgggctcccaccttgacgattggtaggtttttatactgccagtcgtacgacgacagtctgactcggccccggttgttcggcggcgggaccaaggtcgaccgtccgtgacgtcgacgcccaaggcctccggcccccgaggtccaccgtcgtaccgttccccncctccctccgacctacgccgagtcctagggacgtccggggntacgggacaacgggcncgtaatggcnngngctncgngtacgntacgngacngacgcanannngn

SEQ ID NO: 204205 - DNA, 154 bp, Homo sapiens
  misc_feature: GYAE6OF01EGGXK.23.68.G02.1.454.CMB.1.raw
  modified_base (153)..(154): a, c, t, g, unknown or other
  misc_feature (153)..(154): n is a, c, g, or t
tcagacgcgagtatcacgaccggtgctcgatttagtcgatagtgaagggaaagggacacgactggacattaaacgaactgtggctgcaccatctgtcttcatcttcccgccatctgaatactcgcgtctgagcgggctggcaaggcgcatagnn

SEQ ID NO: 204206 - DNA, 153 bp, Homo sapiens
  misc_feature: GYAE6OF01CYIM1.23.68.G02.1.454.CMB.1.raw
  modified_base (153)..(153): a, c, t, g, unknown or other
  misc_feature (153)..(153): n is a, c, g, or t
tcagacgcgagtatcacgaccggtgctcgatttagtcgatagtgaagggaaagggacacgactggacattaaacgaactgtggctgcaccatctgtcttcatcttcccgccatctgaatactcgcgtctgagcgggctggcaaggcgcatagn

SEQ ID NO: 204207 - DNA, 184 bp, Homo sapiens
  misc_feature: GYAE6OF01EYTK4.38.28.C06.1.454.CMB.1.raw
  modified_base (175)..(184): a, c, t, g, unknown or other
  misc_feature (175)..(184): n is a, c, g, or t
tcagtcgatcacgtcacgaccggtgctcgatttagagctcacgtattgggtttgggggaagaggaagactgacggtcctgctccaggagcacctccgagagcacagcggccctgggctgcctggtcaaggactacttccacgtgatcgactgagcgggctggcaaggcgcatagnnnnnnnnnn

SEQ ID NO: 204208 - DNA, 176 bp, Homo sapiens
  misc_feature: GYAE6OF01DBJAZ.38.28.C06.1.454.CMB.1.raw
  modified_base (175)..(176): a, c, t, g, unknown or other
  misc_feature (175)..(176): n is a, c, g, or t
tcagtcgatcacgtcacgaccggtgctcgatttagagctcacgtattgggtttgggggaagaggaagactgacggtcctgctccaggagcacctccgagagcacagcggccctgggctgcctggtcaaggactacttccacgtgatagactgagcgggctggcaaggcgcatagnn

SEQ ID NO: 204209 - DNA, 556 bp, Homo sapiens
  misc_feature: GYAE6OF01A0881.38.28.C06.1.454.CMB.1.raw
  modified_base (265)..(265): a, c, t, g, unknown or other
  misc_feature (265)..(265): n is a, c, g, or t
  modified_base (301)..(301): a, c, t, g, unknown or other
  misc_feature (301)..(301): n is a, c, g, or t
  modified_base (352)..(352): a, c, t, g, unknown or other
  misc_feature (352)..(352): n is a, c, g, or t
  modified_base (393)..(393): a, c, t, g, unknown or other
  misc_feature (393)..(393): n is a, c, g, or t
  modified_base (409)..(409): a, c, t, g, unknown or other
  misc_feature (409)..(409): n is a, c, g, or t
  modified_base (463)..(463): a, c, t, g, unknown or other
  misc_feature (463)..(463): n is a, c, g, or t
tcagtcgatcacgtcacgaccggtgctcgatttagagctcacgtattgggtttgggctgagcgtgcgtttctaggtggctatttaaaaggtgtccagtgtgaggtgcaggtgtcggagtctgggggaggcttggttcagcctggggggtccctgagactctcctgtgcagtctctggattaacctttagtgactatgccatgatctgggtccgcaggctccagggaaggggctggagtgggtctcagcaattaatggtaggggtnattcacatattacgcagactccggtgggggccgttnaccatccaccagagacaactccgaggagcacactatatctaacaaatgcanagcctgagagtcgaggacacggcgtgtattattgtgcgagngactcccgaaagggtnacctacgttggtgtcttttgatttcgtgtggccaagggacaagtggtcaccgtntcttcagtccctaccacgaagggtccccagttcccggtccttcccccgtggcccgtcccctggccctccgaggacgtccacccgtcgagaccg

SEQ ID NO: 204210 - DNA, 176 bp, Homo sapiens
  misc_feature: GYAE6OF01DCXQL.38.28.C06.1.454.CMB.1.raw
  modified_base (175)..(176): a, c, t, g, unknown or other
  misc_feature (175)..(176): n is a, c, g, or t
tcagtcgatcacgtcacgaccggtgctcgatttagagctcacgtattgggtttgggggaagaggaagactgacggtcctgctccaggagcacctccgagagcacagcggccctgggctgcctggtcaaggactacttccacgtgatcgactgagcgggctggcaaggcgcatagnn

SEQ ID NO: 204211 - DNA, 761 bp, Homo sapiens
  misc_feature: GYAE6OF01AH9Z4.38.28.C06.1.454.CMB.1.raw
  modified_base (215)..(215): a, c, t, g, unknown or other
  misc_feature (215)..(215): n is a, c, g, or t
  modified_base (269)..(269): a, c, t, g, unknown or other
  misc_feature (269)..(269): n is a, c, g, or t
  modified_base (324)..(324): a, c, t, g, unknown or other
  misc_feature (324)..(324): n is a, c, g, or t
  modified_base (340)..(340): a, c, t, g, unknown or other
  misc_feature (340)..(340): n is a, c, g, or t
tcagtcgatcacgtcacgaccggtgctcgatttagagctcacgtattgggtttgggctgagcgtggcgttttctggtggctattttaaaggtgtccagtgtgaggtgcaggtgtcggagtctgggggaggcttggttcagcctggggggtccctgagactctcctgtgcagtctctggatttaacctttagtgactatgccatgatctgggtccncaggctccagggaaggggctggagtgggtctcagcaattaagtgggtaggggtnattccactatattacgcagcgtccgggtggggggccgttacaccatccacgaganaccaactccgaggacncactatatactactaacaatcggaccaacgacgtccgtaggaaggtacggtacggaaggaccgaccggggttcgttagtttaagtttagttgggtaccggacggtaaggtaacgtaaccgttacccccggaaacggggttacccgtaaccccgttaaccggttttggggttacgtttaccgttttttaaggttaccgtttttaccggtgggttaaccgggacccggtaaaaggggtaccttaacgggttccggttaccctacccgtttccttccgttaccgaccgtaccccgtacccgaaccggaccggggtaccccttacgtttccccgggtttcccctttccccccgggtgggtacccccgtcccgtccgtaacccgtcccggtacgggacccgccccgacccgtccggaaggacccgg

SEQ ID NO: 204212 - DNA, 630 bp, Homo sapiens
  misc_feature: GYAE6OF01AM1NZ.38.28.C06.1.454.CMB.1.raw
  modified_base (214)..(214): a, c, t, g, unknown or other
  misc_feature (214)..(214): n is a, c, g, or t
  modified_base (272)..(272): a, c, t, g, unknown or other
  misc_feature (272)..(272): n is a, c, g, or t
  modified_base (366)..(366): a, c, t, g, unknown or other
  misc_feature (366)..(366): n is a, c, g, or t
  modified_base (611)..(611): a, c, t, g, unknown or other
  misc_feature (611)..(611): n is a, c, g, or t
tcagtcgatcacgtcacgaccggtgctcgatttagagctcacgtattgggtttgggctgagcgtgcttttctgtggctattttaaaaggtgtccagtgtgaggtgcaggtgttggagtctgggggaggcttggttcagcctggggggtccctgagactctcctgtgcagtctctggatttaacctttagtgactatgccatgattctgggtccnccaggctccgaggggaaggggctgggagtgggtctcagcaatttaagtggtaggggtnatttcacctatattacgcagacctccggtggggggccgttcaccatcaccagagacaactccgaggacgctacactatatctaacaaatgcaanacgctgagagtcgaggaccacgggtctggtattagtgtgacgagagactcccgtaaggtcgaccgtacgttggtgttcttttgtatttcgtggtcgtacccgaagggtaccaagttcgggtacctaccggttctacctttgaccgtccctacccaccgaaacggggtcccctagttcccgggttcccttccccccgtgggccccggtccccttccggtcccgttacccgacgggtaccgaccccncccgtacccggagacccgg

SEQ ID NO: 204213 - DNA, 548 bp, Homo sapiens
  misc_feature: GYAE6OF01B0RF7.38.28.C06.1.454.CMB.1.raw
  modified_base (362)..(362): a, c, t, g, unknown or other
  misc_feature (362)..(362): n is a, c, g, or t
  modified_base (423)..(423): a, c, t, g, unknown or other
  misc_feature (423)..(423): n is a, c, g, or t
  modified_base (487)..(487): a, c, t, g, unknown or other
  misc_feature (487)..(487): n is a, c, g, or t
tcagtcgatcacgtcacgaccggtgctcgatttagagctcacgtattgggtttggggtctgagagaggagcccagccctgggattttcaggcgttttcatttggtgatcaggactgaacagagagaactcaccatggagtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccgcaggctccgaggggaaggggctgggagtggggtctgaggcaattaagtgggtaggggtnattcacatattacgcagactccggtgggggccgttcaccatccacagagacaactcaggancacactatatactaacaaatgacacagactgaagagtcgaaggacacgggccgtataattgtgngagagagactacccgaaggtcaaccctaccgtttgggcgttcttttgtattttcgtacggg

SEQ ID NO: 204214 - DNA, 177 bp, Homo sapiens
  misc_feature: GYAE6OF01EYCL3.38.28.C06.1.454.CMB.1.raw
  modified_base (175)..(177): a, c, t, g, unknown or other
  misc_feature (175)..(177): n is a, c, g, or t
tcagtcgatcacgtcacgaccggtgctcgatttagagctcacgtattgggtttgggggaagaggaagactgacggtcctgctccaggagcacctccgagagcacagcggccctgggctgcctggtcaaggactacttccacgtgatcgactgagcgggctggcaaggcgcatagnnn

SEQ ID NO: 204215 - DNA, 652 bp, Homo sapiens
  misc_feature: GYAE6OF01CW4KI.38.28.C06.1.454.CMB.1.raw
  modified_base (94)..(94): a, c, t, g, unknown or other
  misc_feature (94)..(94): n is a, c, g, or t
  modified_base (262)..(262): a, c, t, g, unknown or other
  misc_feature (262)..(262): n is a, c, g, or t
  modified_base (271)..(271): a, c, t, g, unknown or other
  misc_feature (271)..(271): n is a, c, g, or t
  modified_base (308)..(308): a, c, t, g, unknown or other
  misc_feature (308)..(308): n is a, c, g, or t
  modified_base (395)..(395): a, c, t, g, unknown or other
  misc_feature (395)..(395): n is a, c, g, or t
  modified_base (399)..(399): a, c, t, g, unknown or other
  misc_feature (399)..(399): n is a, c, g, or t
tcagtcgatcacgtcacgaccggtgctcgatttagagctcacgtattgggtttgggctgagcgtggcgttttctaggtggctattttaaaaggngtccagtgtgaggtgcaggtgtcggagtctggggggaggcttgggttcagcctggggggtccctgagactctcctgtgcagtctctggattaacctttagtgactatgccatgatctgggtccgccaggctccgagggaaggggctggagtgggtctcagcaattaanggtagggtnattcaccatattacgcagactccggtgggggccgttnaccatcaccagagacaactccaggagcaacactaatactctaacaaatgacacagccctagagagtcgaggacacggcgtgtaattnttgngcgagagatacccgaacggtcgacctaaccgttggtcgtccgtttttgtacgttttcgtggttcggacccgaaaggggacctaaagttcggtacctaaccggttcttccttaccgtacgtccccttccaaacccggaaacgggtcccccgaacgtttcccggttcccgtttccccccccgttgggccccggtcccccgttacggtcccgttcccgaacgggacgccccgttaaccccgccggaacgaacccgg

SEQ ID NO: 204216 - DNA, 666 bp, Homo sapiens
  misc_feature: GYAE6OF01BSAKA.38.28.C06.1.454.CMB.1.raw
tcagtcgatcacgtcacgaccggtgctcgatttagagctcacgtattgggtttgggctgagctggcttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccgagggaaggggctggagtgggtctcagcaattaagtggtaggggtgattcaccatattacgcagactcggtgggggccgttcacatcaccagagacaactccaggagcaacactatatctaacaaatgcacagcctgagagtcgaggacacggcctgtattatgtgcgagagactccccgaaaggtgaacctaccgttggtcgtctttttggacttttcgtagttcgggaccgtaaaggggacctaagttcgggtacctaaccccggttcttacccgtttaccacggtccccttacccgaaccccgtaaaggggtcccccctaaagttcccgggttcccctttcccccccgggttgggacccccgttccccccgttgggaccccttaccccggtaaggggtacccggaccctaaccccccggttcccggaaaggtaaaccccgg

SEQ ID NO: 204217 - DNA, 580 bp, Homo sapiens
  misc_feature: GYAE6OF01B8S1P.38.28.C06.1.454.CMB.1.raw
  modified_base (93)..(93): a, c, t, g, unknown or other
  misc_feature (93)..(93): n is a, c, g, or t
  modified_base (366)..(366): a, c, t, g, unknown or other
  misc_feature (366)..(366): n is a, c, g, or t
  modified_base (407)..(407): a, c, t, g, unknown or other
  misc_feature (407)..(407): n is a, c, g, or t
  modified_base (442)..(442): a, c, t, g, unknown or other
  misc_feature (442)..(442): n is a, c, g, or t
  modified_base (529)..(529): a, c, t, g, unknown or other
  misc_feature (529)..(529): n is a, c, g, or t
  modified_base (541)..(541): a, c, t, g, unknown or other
  misc_feature (541)..(541): n is a, c, g, or t
tcagtcgatcacgtcacgaccggtgctcgatttagagctcacgtattgggtttgggctgagcgtgcgtttctaggtggctaattttaaaaggngtccagtgtgaggtgcaggtgtcggagtctgggggaggcttggttcagcctggggggtccctgagactctcctgtgcagtctctggattaacctttagtgactatgccatgatctgggtccgccaggctccgaggggaaggggctgggagtgggtctcgagcaatttaagtgggtaggggtgattcaaccatattacgcaggacctccggtggggggccgttcaccatcaccagagacaactccaggagcacactatatctaacaaatgacanacgcctgagacgtcggaaggacacggcgttgtattagttgngcgagagactcccgaaaggtcgacctacgttggtntcttttgtatttcgtgtcgacaagggacagtggtacacgtctctcacgcctccaccgtaacggcccagttccggtcccttcccccgnggcccggtcccncggtccctccgacgggacacccacccgtccggagtaccg

SEQ ID NO: 204218 - DNA, 734 bp, Homo sapiens
  misc_feature: GYAE6OF01ESX7M.38.28.C06.1.454.CMB.1.raw
  modified_base (414)..(414): a, c, t, g, unknown or other
  misc_feature (414)..(414): n is a, c, g, or t
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggatttaacctttagtgactatgccatgatctgggtccgccaggctccaggggaaggggctgggagtgggtctcagcaatttaatggtaggggtgattcaccatattacgcagactccgtgggggccgttcaccatcaccagagacaactccaggagcacactatatctaacaaatgcacagcctgagagtcgaggacacgggccgtgtattatgtgcgagagatccccgaaacggtnaacccaccgtttgggtcgtctttttgattttctgttcgggaccctaaggggacctaaagtcgggttacctaaccccggttcctttccgttttaccaacggtcccccctttacccgaaacccccgtaaaacggggggtcccccccctaaaacggtttcccccgggggttttacccccttttttacccccccccccggttaggggggtccccccggtccccccccggtttccgggtacccccgtttacccccccggaaggggggtaaaccccgaccccccgttaaacccccggtttaccccccgggaagggtaaaccccggg

SEQ ID NO: 204219 - DNA, 538 bp, Homo sapiens
  misc_feature: GYAE6OF01EYWTS.38.28.C06.1.454.CMB.1.raw
  modified_base (457)..(457): a, c, t, g, unknown or other
  misc_feature (457)..(457): n is a, c, g, or t
  modified_base (524)..(524): a, c, t, g, unknown or other
  misc_feature (524)..(524): n is a, c, g, or t
tcagtcgatcacgtcacgaccggtgctcgatttagagctcacgtattgggtttgggctgagcgtggcttttcttgtggctattttaaaaggtgtccagtgtgaggtgcaggtgtcggagtctgggggaggcttggttcagcctggggggtccctgagactctcctgtgcagtctctggatttaaccttagtgactatgccatgatctgggtccgccaggctccaggggaaggggctggagtgggtctcagcaattaatggtaggggtgattcaccatattacgcagactccgtggggggccgttcaccatcaccagagacaactccaggagcacactatatctaacaaatgcacagcctgagagtcgaggacacggccgtgtattattgtgcgagagatcccaacggtgaaccacttggtgcttttgatttctgtggcaagggcaatggtcaccgtntcttcagcctccacaacgggcccagtccggtccttcccccgtggcccgccctgccctccacgggacnccaccctcgagacg

SEQ ID NO: 204220 - DNA, 616 bp, Homo sapiens
  misc_feature: GYAE6OF01ED22N.38.28.C06.1.454.CMB.1.raw
tcagtcgatcacgtcacgaccggtgctcgatttagagctcacgtattgggtttgggctgagctggcttttcttgtggctattttaaaaggtgtccagtgtgaggtgcaggtgtcggagtctgggggaggcttggttcagcctggggggtccctgagctctcctgtgcagtctctggatttaaccttttagtgactatgccatgatctgggtccgccaggctccgaggggaaggggctgggagtgggtctcagcaatttaagtggtagggtgattcacatattacgcagacgtcggtgggggccgttcacctatcaccagagacaactccaggagcacactatatactaacaaatgacacagcctaggagagtcgaggacacggtcgtatattatgtgacgagagtactacccgaacggttcgaaccaccgtttgggtcgttctttttaggtactttttccggtggtacggacccgaaagggactaagtcggtacctaccggttcttcttacgacgcccttaccgaaccgtaacggccctacgtcccggttacccttcccccgtagggcccctcccgtgccctaccgacgggacacccgtacccgtccggagaaccg

SEQ ID NO: 204221 - DNA, 540 bp, Homo sapiens
  misc_feature: GYAE6OF01CL5VQ.38.28.C06.1.454.CMB.1.raw
  modified_base (267)..(267): a, c, t, g, unknown or other
  misc_feature (267)..(267): n is a, c, g, or t
  modified_base (393)..(393): a, c, t, g, unknown or other
  misc_feature (393)..(393): n is a, c, g, or t
  modified_base (504)..(504): a, c, t, g, unknown or other
  misc_feature (504)..(504): n is a, c, g, or t
  modified_base (510)..(510): a, c, t, g, unknown or other
  misc_feature (510)..(510): n is a, c, g, or t
  modified_base (527)..(527): a, c, t, g, unknown or other
  misc_feature (527)..(527): n is a, c, g, or t
tcagtcgatcacgtcacgaccggtgctcgatttagagctcacgtattgggtttgggctgagcgtggcttttcttgtggctattttaaaaggtgtccagtgtgaggtgcaggtgtcggagtctgggggagacttggttcagcctggggggtccctgagactctcctgtgcagtctctggattaacctttagtgactatgccatgatctgggtccgccaggctccaggggaaggggctggagtgggtctcagcaattaatggtagggtnattcacatattacgcagactccggtgggggccgttcaccgatcaccagagacaactccgaggagcacactatatctaacaaatgcacagcctgagagtcgaggacacggctgtattatgtgcgagngactccgaacggtgacctacgttggtgtcttttgattttctggtggaccaagggtacaagtcgtcaccgtctcttcacgcctcaccgacggcccagtcgtccttcccccgnggcccncccgtgctccgaggacncaccctcgagacg

SEQ ID NO: 204222 - DNA, 175 bp, Homo sapiens
  misc_feature: GYAE6OF01BDVIH.38.28.C06.1.454.CMB.1.raw
  modified_base (175)..(175): a, c, t, g, unknown or other
  misc_feature (175)..(175): n is a, c, g, or t
tcagtcgatcacgtcacgaccggtgctcgatttagagctcacgtattgggtttgggggaagaggaagactgacggtcctgctccaggagcacctccgagagcacagcggccctgggctgcctggtcaaggactacttccacgtgatcgactgagcgggctggcaaggcgcatagn

SEQ ID NO: 204223 - DNA, 661 bp, Homo sapiens
  misc_feature: GYAE6OF01EWW9E.38.28.C06.1.454.CMB.1.raw
  modified_base (396)..(396): a, c, t, g, unknown or other
  misc_feature (396)..(396): n is a, c, g, or t
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccgaggggaaggggctgggagtgggtctcagcaattaagtgggtaggggtgattcaccatattacgcagactccggtggggggccgttcaccatcaccagagacaactccaggagcacactatatctaacaaatgcacagcctagagagtcgaggacacggccgtgtattattgngcgagagactaccccaagggtcaacctaccgtttgggtcgtctttttagattttcgtggttcggacctaaggggaccaaagttcgggtacctacccggttcttcctttccgacgtcccctacccgaacccgaaacggggtcccccctaaggttcccgggttccccgttttaccccccccggtggggacccccgtcccccgttccggaccccttaccccggaacggggtaccgaccctaacccccgttcccggaacggtaacccgg

SEQ ID NO: 204224 - DNA, 382 bp, Homo sapiens
  misc_feature: GYAE6OF01DWSPR.38.28.C06.1.454.CMB.1.raw
  modified_base (374)..(374): a, c, t, g, unknown or other
  misc_feature (374)..(374): n is a, c, g, or t
  modified_base (379)..(382): a, c, t, g, unknown or other
  misc_feature (379)..(382): n is a, c, g, or t
tcagtcgatcacgtcacgaccggtgctcgatttagagctcacgtattgggtttgggtgccgaagttgctggaggtcacggttcaccatcaccagagacaactccaggagcacactatatctacaaatgcacagcctgagagtcgaggacacggccgtgtattattgtgcgagagatcccaacggtgaccaccttggtgcttttgatttctgtggccaagggacaatggtcaccgtctcttcagcctccaccaaggcccatcggtcttcccctggccgccctgctccaggagcacctccgagagcacagccggccctgggctgccctggtcaaggctacttccacgtgatcgactgagcgggctgggcaaggcgnatagnnnn

SEQ ID NO: 204225 - DNA, 612 bp, Homo sapiens
  misc_feature: GYAE6OF01B5XME.38.28.C06.1.454.CMB.1.raw
  modified_base (273)..(273): a, c, t, g, unknown or other
  misc_feature (273)..(273): n is a, c, g, or t
  modified_base (366)..(366): a, c, t, g, unknown or other
  misc_feature (366)..(366): n is a, c, g, or t
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttgggttcagccgtggggggtccctgagactctcctgtgcagtctctggattaacctttagtgactatgccatgatcgtgggtccgccaggctccgaggggaagggctggagtgggtctcagcaattaagtgggtaggggtnattcacctatattacgcagacgtccggtgggggccgttcaccatcaccagacgacaactccgaggagcacactatatactaacaaatgacacngctgagagcgaggacacggcgtgtattatgtgcgagagactacccgaaggtcgaaccctacgttggtcttcgttttgtacttttcgtgtcgggtaccgaagggaactaagttggtaccctaaccggttcttaccgttcaccgtcccctaccgaaccgaacgggccctacgttcccggttcccgttcccccgtcgggccccgtccctcgtaccctccgacggtccacccgacccgtcggacgaccgg

SEQ ID NO: 204226 - DNA, 594 bp, Homo sapiens
  misc_feature: GYAE6OF01C782J.38.28.C06.1.454.CMB.1.raw
  modified_base (423)..(423): a, c, t, g, unknown or other
  misc_feature (423)..(423): n is a, c, g, or t
tcagtcgatcacgtcacgaccggtgctcgatttagagctcacgtattgggtttgggctgagctggcttttcttgtggctattttaaaaggtgtccagtgtgaggtgcaggtgtcggagtctgggggaggcttggttcagcctggggggtccctgagactctcctgtgcagtctctggatttaacctttagtgactatgccatgatctgggtccgccaggctccgaggggaaggggctggagtgggtctcagcaattaatggtaggggtgattcaccatattacgcagactccggtgggggccgttcacatcacagagacaactccaggagcacactatatctaacaaatgacacagcctagagagtcgagacacggccgtagtatttatgtcgacgagagatcccaacggtgaccacttggtntcttttgatttcgtgtggacaagggacaagtggtaccaccgtctcgttacacgtcctaccaacccaaggggcccctacgtcccgggttccctttcccccccgtcgggcccgtccccccgttcggtcccttacccgaacgggacgacccgacccccttcggaacgtaaccgg

SEQ ID NO: 204227 - DNA, 378 bp, Homo sapiens
  misc_feature: GYAE6OF01CTC8X.38.28.C06.1.454.CMB.1.raw
  modified_base (273)..(273): a, c, t, g, unknown or other
  misc_feature (273)..(273): n is a, c, g, or t
  modified_base (286)..(286): a, c, t, g, unknown or other
  misc_feature (286)..(286): n is a, c, g, or t
  modified_base (296)..(296): a, c, t, g, unknown or other
  misc_feature (296)..(296): n is a, c, g, or t
  modified_base (363)..(363): a, c, t, g, unknown or other
  misc_feature (363)..(363): n is a, c, g, or t
  modified_base (369)..(378): a, c, t, g, unknown or other
  misc_feature (369)..(378): n is a, c, g, or t
tcagtcgatcacgtcacgaccggtgctcgatttagagctcacgtattgggtttgggtgccgaagttgctggaggtcacggttcaccatcaccagagacaactccaggagcacactatatctacaaatgcacagcctgagagtcgaggacacggccgtgtattattgtgcgagagatcccaacggtgaccaccttggtgcttttgatttctgtggccaagggacaatggtcaccgtctcttcagcctccaccaaggcccatcggtctccctgcnccctgctccaggncacctcgagngcacagcggccctgggctgcctggtcaaggctactccacgtgatcgactgagcgggctggcaaggcncatagnnnnnnnnnn

SEQ ID NO: 204228 - DNA, 177 bp, Homo sapiens; identical to SEQ ID NO: 204214
  misc_feature: GYAE6OF01CI0KZ.38.28.C06.1.454.CMB.1.raw
  modified_base (175)..(177): a, c, t, g, unknown or other
  misc_feature (175)..(177): n is a, c, g, or t

SEQ ID NO: 204229 - DNA, 175 bp, Homo sapiens; identical to SEQ ID NO: 204222
  misc_feature: GYAE6OF01EGLVJ.38.28.C06.1.454.CMB.1.raw
  modified_base (175)..(175): a, c, t, g, unknown or other
  misc_feature (175)..(175): n is a, c, g, or t

SEQ ID NO: 204230 - DNA, 597 bp, Homo sapiens
  misc_feature: GYAE6OF01DKTGW.38.28.C06.1.454.CMB.1.raw
  modified_base (338)..(338): a, c, t, g, unknown or other
  misc_feature (338)..(338): n is a, c, g, or t
  modified_base (373)..(373): a, c, t, g, unknown or other
  misc_feature (373)..(373): n is a, c, g, or t
  modified_base (406)..(406): a, c, t, g, unknown or other
  misc_feature (406)..(406): n is a, c, g, or t
  modified_base (508)..(508): a, c, t, g, unknown or other
  misc_feature (508)..(508): n is a, c, g, or t
  modified_base (584)..(584): a, c, t, g, unknown or other
  misc_feature (584)..(584): n is a, c, g, or t
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctgggggggtccctgagactctcctgtgcagtctctggatttaacctttagtgactatgccatgatctgggtccgcaggctccgaggggaaggggctgggagtgggtctcagctaaattaagtgggtaggggtgattcaccatattacgcagactccggtgggggccgttcacatcaccagagacactccgaggacncacactatatctaacaaatcgacacagcctgaagngtacgaggacacggtccgtagtatttagttggngacgagagactacccgaacgggtcgaccctacgttggtgttcgttttagtacttttcgtggtcggaccgtaagggactaagttggacctaccgtcttcctcncgtccctaccgaccgacggtcccacgtccggttcccttcccccgtggcccgtccctgcccgtccgacggacgaccnccgtccgagaccg

SEQ ID NO: 204231 - DNA, 645 bp, Homo sapiens
  misc_feature: GYAE6OF01BMZ95.38.28.C06.1.454.CMB.1.raw
  modified_base (274)..(274): a, c, t, g, unknown or other
  misc_feature (274)..(274): n is a, c, g, or t
tcagtcgatcacgtcacgaccggtgctcgatttagagctcacgtattgggtttgggctgagcgtggcgttttcttaggtggctattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccaggggaaggggctggagtgggtctcagcaaatttaagtggtaggggtnattcaccatattacgcagactccggtgggggccgttcaccatccaccagagacaactccaggagcacactatactactaacaaatgcacagcctagagagtcgaggaccacgggccgtgtattattgtgcgagacgactaccccgaaggtcgaccctaccgtttggtacgtctttttgtacttttcgtggttcggaccgaaggggacctaagttcggtacctacccggttcttaccgtttaccgacggtaccccttacccgaacccgtaaacgggccccctaagttcccgggttccccctttccccccgtacgggcccgtccccgtcgcccgttacccgacgggtaccgacccacccgtcccggaggaccg

SEQ ID NO: 204232 - DNA, 571 bp, Homo sapiens
  misc_feature: GYAE6OF01BJWAP.38.28.C06.1.454.CMB.1.raw
  modified_base (409)..(409): a, c, t, g, unknown or other
  misc_feature (409)..(409): n is a, c, g, or t
tcagtcgatcacgtcacgaccggtgctcgatttagagctcacgtattgggtttgggctgagctggcttttcttgtgtctattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccaggggaaggggctggagtgggtctcagcaattaagtgggtaggggtgattcaccatattacgcagactccggtgggggccgttcaccatcaccagagacaactccaggagcacactatatctaacaaatgcacagcctgagagtcgaggacacggccgtgtattattgtgcgagagatcccaaggtnacctacttggtgtcttttgatttcgtgtcggccaagggactaagtggtacaccggtctcttcacgtccctaccaccgaacgggcccctagtccggttcccttcccccgtgggccccgtcccgtcggccctaccgacgggtacgacccacccgtccgagaccg

SEQ ID NO: 204233 - DNA, 650 bp, Homo sapiens
  misc_feature: GYAE6OF01EFAAV.38.28.C06.1.454.CMB.1.raw
  modified_base (276)..(276): a, c, t, g, unknown or other
  misc_feature (276)..(276): n is a, c, g, or t
  modified_base (334)..(334): a, c, t, g, unknown or other
  misc_feature (334)..(334): n is a, c, g, or t
tcagtcgatcacgtcacgaccggtgctcgatttagagctcacgtattgggtttgggctgagcgtggcttttcttgtggctattttaaaaggtgtccagtgtgaggtgcaggtgtcggagtctggggggaggcttggttcaggcctggggggtccctgagactctcctgtgcagtctctggatttaacctttagtgactatgccatgatcgtgggtccgccaggctccgaggggaaggggctgggagtgggtctcagcaattaagtgggtaggggtnattcaccatattacgcagactcggtgggggccgttcaccatcacagagacactcaggncacactatatactaacaaatcgacacagcctagagagtcgaggacacggcgtagtacttagtgtgacgagagactcccgaacgggtcaaccgaccgtttgggtacgttcgttttgtacttttcgtggttcggacccgtaaaggggacctaaagttcgggtacctacccggttcttccgttaccacgtcccctaccgaacccgtaacgggcccctaacgttcccgggttacccctttccccccgtagggtccccgtcccccgtggtccccttacccggaacgggaccgaccctacccggttccggaacggtaaccgg

SEQ ID NO: 204234 - DNA, 385 bp, Homo sapiens
  misc_feature: GYAE6OF01DDE85.38.28.C06.1.454.CMB.1.raw
  modified_base (378)..(385): a, c, t, g, unknown or other
  misc_feature (378)..(385): n is a, c, g, or t
tcagtcgatcacgtcacgaccggtgctcgatttagagctcacgtattgggtttgggtgccgaagttgctggaggtcacggttcaccatcaccagagacaactccaggagcacactatatctacaaatgcacagcctgagagtcgaggacacggccgtgtattattgtgcgagagatcccaacggtgaccaccttggtgcttttgatttctgtggccaagggacaatggtcaccgtctcttcagcctccaccaagggcccatcggtcttcccctggcgccctgcctccaggacgccacctccgagagcacagcggccctgggctgcctggtcaaggctactccacgtgatcgactgagcgggctggcaaggcgcatagnnnnnnnn

SEQ ID NO: 204235 - DNA, 640 bp, Homo sapiens
  misc_feature: GYAE6OF01D0Q0M.38.28.C06.1.454.CMB.1.raw
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctgggggggtccctgagactctcctgtgcagtctctggattaacctttagtgactatgccatgatctgggtccgccaggctccgaggggaaggggctgggagtgggtctcagcaattaagtgggtaggggtgattcaccatattacgcagactccggtggggggccgttcaccatcaccagagacaactccaggacgcaacactatactctaacaaatgcacagcctgagagtcgaggacacggcgtgtattatgtgcgagagactcccgaacgggtcacctaccgtttgggtcgttctttttgtacttttcgtgggtcggtacccgtaaggggaactaagttcgggtacctaccgttcttccgtttccacgtcccctacccgaaccgaaaccggggtcccctacgttcccggttacccctttcccccccggtgggccccgtcccccgttcggcccgttacccgacggggaccaccgtaccccgtccggaacggaaccg

SEQ ID NO: 204236 - DNA, 744 bp, Homo sapiens
  misc_feature: GYAE6OF01EA26E.38.28.C06.1.454.CMB.1.raw
  modified_base (261)..(261): a, c, t, g, unknown or other
  misc_feature (261)..(261): n is a, c, g, or t
  modified_base (283)..(283): a, c, t, g, unknown or other
  misc_feature (283)..(283): n is a, c, g, or t
  modified_base (341)..(341): a, c, t, g, unknown or other
  misc_feature (341)..(341): n is a, c, g, or t
  modified_base (357)..(357): a, c, t, g, unknown or other
  misc_feature (357)..(357): n is a, c, g, or t
tcagtcgatcacgtcacgaccggtgctcgatttagagctcacgtattgggtttgggctgagcgtgtcgttttctaggtggctaattttaaaaggtgtccagtgtgaggtgcaggtgtcggagtctggggggaggcttggttcaggcctggggggtccctgagctctcctgtgcagtctctggtatttaacctttagtgactatgccatgatcgtgggtccgccaggcctccgaggggaaggggctgggagtgggtctcagntaatttaagtggggtaggggtntattccactatacttacgcagccgtccgggtggggggccgttcaccatccaccgaganaccaactccgaggacnctacatatactactaaacaaatcgaccaacgacggcctaggaaggacgtaccgggaaggaccacggggtccgttagttaattttagttgggacgacggaacggacgtaaccgtaccccggtaaacgggtcgtaaccccgtaccggttttggggttactttccgtttttgtaactttttccgtggttaccgggaacccgtaaaggggtactaacggttccggttaccgtacccggtttccttaccgtttccgaccgttacccccgtaccgtaacccggaacggggtccccctaccggttcccggttccccccttcccccggtggcccccgttaccccgtcgtcccctacccgggaggtacccgacccaccccggtcggaacggacccg

SEQ ID NO: 204237 - DNA, 578 bp, Homo sapiens
  misc_feature: GYAE6OF01AHSL5.38.28.C06.1.454.CMB.1.raw
  modified_base (271)..(271): a, c, t, g, unknown or other
  misc_feature (271)..(271): n is a, c, g, or t
  modified_base (337)..(337): a, c, t, g, unknown or other
  misc_feature (337)..(337): n is a, c, g, or t
  modified_base (397)..(397): a, c, t, g, unknown or other
  misc_feature (397)..(397): n is a, c, g, or t
  modified_base (432)..(432): a, c, t, g, unknown or other
  misc_feature (432)..(432): n is a, c, g, or t
tcagtcgatcacgtcacgaccggtgctcgatttagagctcacgtattgggtttgggctgagctggctttttcttgtggctattttaaaaggtgtccagtgtgaggtgcaggtgtcggagtctggggggaggcttggttcagccgtggggggtccctgagactctcctgtgcagtctctggattaacctttagtgactatgccatgatctgggtccgccaggctccgaggggaaggggctggagtgggtctcagcaattaatggtaggggtnattcaccatatacgcagactccggtgggggccgttcaccatccaccagagaccaactccgaggacncaacactatatctaacaaatgacacacgcctgagagtcgaggacacggcgtgtattatgngcgagagactcccgaacggtgaccctacgttggtntcttttgatttctggtcggaccaagggactaagtcggtacaccgttctccttcacgtccctaccaccggaacggccctacgtccggtcccttcccccgtggcccgtcccgtgccctaccgaggaccgaccctacccgtccgagacg

SEQ ID NO: 204238 - DNA, 685 bp, Homo sapiens
  misc_feature: GYAE6OF01DM62N.38.28.C06.1.454.CMB.1.raw
  modified_base (269)..(269): a, c, t, g, unknown or other
  misc_feature (269)..(269): n is a, c, g, or t
  modified_base (332)..(332): a, c, t, g, unknown or other
  misc_feature (332)..(332): n is a, c, g, or t
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccgagggaaggggctggagtgggtctcagcaattaagtggtaggggtnattcaccatattacgcagactccggtgggggccgttcaccatcaccagagacaactccaggancacactatactactaacaaatgacacagccctgagacgtcgaggacacggccgtgtaattattggtgcgagagactacccgaacggtcgaccctacgttggtcgtcttttgtatttccgtggtcggacccgtaagggaacctaaagtttcgggtaccctaaccggttccttaccgtttaccgacgtaccccctaccgaaccccgtaaacggggtccccccaaacggttcccgggttccccgtttaccccccccggtggggacccccggttccccccgttcgggtaccccgtttaccccggaaacggggtaaccccggaccctaaccccccgttacccggggaacggaacccgg

SEQ ID NO: 204239 - DNA, 411 bp, Homo sapiens
  misc_feature: GYAE6OF01BY8YF.38.28.C06.1.454.CMB.1.raw
  modified_base (278)..(278): a, c, t, g, unknown or other
  misc_feature (278)..(278): n is a, c, g, or t
  modified_base (291)..(291): a, c, t, g, unknown or other
  misc_feature (291)..(291): n is a, c, g, or t
  modified_base (310)..(310): a, c, t, g, unknown or other
  misc_feature (310)..(310): n is a, c, g, or t
  modified_base (391)..(411): a, c, t, g, unknown or other
  misc_feature (391)..(411): n is a, c, g, or t
tcagtcgatcacgtcacgaccggtgctcgatttagagctcacgtattgggtttggggtgccgaagttgctggaggtcacggttcaccatcaccagagacaactccaggagcacactatatctacaaatgcacagcctgagagtcgaggacacggccgtgtattattgtgcgagagatcccaaggtgaccaccttggtgcttttgatttctgtggccaagggacaatggtcaccgtctctcagcctcaccgaagggcccatccggtcttccccctggcnccctgctccaggngcacctccgagacgcacgnggcggccctgggctgcctggtcaaggactactccgacgtgactcgacgtgaggccgggctgggcaagggccgacagtaggnnnnnnnnnnnnnnnnnnnnn

SEQ ID NO: 204240 - DNA, 659 bp, Homo sapiens
  misc_feature: GYAE6OF01EYAQL.38.28.C06.1.454.CMB.1.raw
  modified_base (352)..(352): a, c, t, g, unknown or other
  misc_feature (352)..(352): n is a, c, g, or t
  modified_base (385)..(385): a, c, t, g, unknown or other
  misc_feature (385)..(385): n is a, c, g, or t
tcagtcgatcacgtcacgaccggtgctcgatttagagctcacgtattgggtttgggctgagcgtggcttttcttgtggctattttaaaaggtgtccagtgtgaggtgcaggtgtcggagtctgggggaggcttggttcagcctggggggtccctgagactctcctgtgcagtctctggatttaaccttagtgactatgccatgatctgggtccgccaggctccagggaaggggctggagtgggtctcagcaattaagtggtagggtgattcaccatatacgcagactccgtgggggccgttcaccatcaccagagacaactccgaggagcacactatatctacaaatgacanagtctgagagtcgagacacggctgtattattgngcgagagactcccgaacggtgaacctaccgttgggtacgtctttttgattttctggttcggaccgtaaaggggacaagttcgggtaccacccggtttcttactttccgacgtcccctacccgaacccgaaacggggtcccccctaagttccccggggtttaccccttttccccccccgtagggcccccggtccccccgttgggtacccccttaaccccggacgggggtaaccgacccccgaacccccggtttacccgggaacgggtaaacccgg

SEQ ID NO: 204241 - DNA, 610 bp, Homo sapiens
  misc_feature: GYAE6OF01DM8K0.38.28.C06.1.454.CMB.1.raw
  modified_base (400)..(400): a, c, t, g, unknown or other
  misc_feature (400)..(400): n is a, c, g, or t
  modified_base (447)..(447): a, c, t, g, unknown or other
  misc_feature (447)..(447): n is a, c, g, or t
tcagtcgatcacgtcacgaccggtgctcgatttagagctcacgtattgggtttgggctgagcgtggctttttcttgtggctatttttaaaaggtgtccagtgtgaggtgcaggtgtcggagtctgggggaggcttggttcagcctggggggtccctgagactctcctgtgcagtctctggatttaacctttagtgactatgccatgatctgggtccgccaggctccaggggaaggggctggagtgggtctcagcaattaatggtaggggtgattcaccatattacgcagactcggtgggggccgttcaccatcaccagagacaactccgaggagcaacactaatatactacaaatgcacagcctgagagtcgaggacacggcctgtattatgtgcgaganacgtcccaacgggtcaccgtacgttggtcgtcttttggtattttcgnggttcggtacccgaagggtactaattcgggtaccaccggttccttcttccacggtccctaccaaccgtaaaccgggccctaacgtcccggttccccgttaccccccgtgggtcccgtccccttggcccttcccgtacgggacgtcccaccccgtcgagaccgg

SEQ ID NO: 204242 - DNA, 578 bp, Homo sapiens
  misc_feature: GYAE6OF01BWHQR.38.28.C06.1.454.CMB.1.raw
  modified_base (184)..(184): a, c, t, g, unknown or other
  misc_feature (184)..(184): n is a, c, g, or t
  modified_base (211)..(211): a, c, t, g, unknown or other
  misc_feature (211)..(211): n is a, c, g, or t
  modified_base (222)..(222): a, c, t, g, unknown or other
  misc_feature (222)..(222): n is a, c, g, or t
  modified_base (245)..(245): a, c, t, g, unknown or other
  misc_feature (245)..(245): n is a, c, g, or t
  modified_base (298)..(298): a, c, t, g, unknown or other
  misc_feature (298)..(298): n is a, c, g, or t
tcagtcgatcacgtcacgaccggtgctcgatttagagctcacgtattgggtttggggtctgagagaggagcccagccctgggattttcaggtcgttttcatttggtgatcaggactgaacagagagaactcaccatggagtttgggctgagcggtgtcgtttctaggcggctaagtttaaaggntcagtgtgagtgcaggtgcggatcggnggagtctgtcngcggtgggtcagactctctgtgngacgagtctgtagtacttacttgacatgtcgctatgctcggtccggccgacgngtccgtacggagggacgtgtaggtaggtcgtcgagagtagtaagtaagtagggtaggtagtatacgtactatacgtacgacgacgtacggtcgggtcgggtacgtactacacacacgacgacgacacgacgacgacgacactactatactactaagtaacacgactacgacgacgtagagacgtacgacgacgacgtacgtagtagtagtagtacgagacgtacgacgtaccggtacgtacgtacgtacgttcgttacgttagttacgttagttgtacgg

SEQ ID NO: 204243 - DNA, 665 bp, Homo sapiens
  misc_feature: GYAE6OF01A5BIZ.38.28.C06.1.454.CMB.1.raw
  modified_base (215)..(215): a, c, t, g, unknown or other
  misc_feature (215)..(215): n is a, c, g, or t
  modified_base (271)..(271): a, c, t, g, unknown or other
  misc_feature (271)..(271): n is a, c, g, or t
  modified_base (333)..(333): a, c, t, g, unknown or other
  misc_feature (333)..(333): n is a, c, g, or t
tcagtcgatcacgtcacgaccggtgctcgatttagagctcacgtattgggtttgggctgagcgtgcgttttctaggtggctattttaaaaggtgtccagtgtgaggtgcaggtgtcggagtctgggggaggcttggttcagcctggggggtccctgagactctcctgtgcagtctctggattaacctttagtgactatgccatgatctgggtccnccaggctccaggggaaggggctggagtgggtctcagcaatttaagtggtaggggtnattcaccatattacgcagactccgtgggggccgttcaccatcaccagagacaactccaggancacactaatatctaacaaatgacacagcctgagagtcgaggacacggccgtgtattatgtgcgagacgactccccgaacgggtcgaaccctaccgtttgggtacgtcttttttaggaatttttccgtggttcgggacccaaagggggtacccaaagttcgggttaccctaacccggtttcttccgttttaccgaacggtccccttacccaacccgtaaacggggccccctaagttccccgggttccctttcccccccgtgggtccccggtaccccctcggtccctaccccgtaaggggtacgacccctaccccgttcccgggaagtacccgg

SEQ ID NO: 204244 - DNA, 554 bp, Homo sapiens
  misc_feature: GYAE6OF01CY0LP.38.28.C06.1.454.CMB.1.raw
  modified_base (269)..(269): a, c, t, g, unknown or other
  misc_feature (269)..(269): n is a, c, g, or t
  modified_base (331)..(331): a, c, t, g, unknown or other
  misc_feature (331)..(331): n is a, c, g, or t
  modified_base (427)..(427): a, c, t, g, unknown or other
  misc_feature (427)..(427): n is a, c, g, or t
  modified_base (442)..(442): a, c, t, g, unknown or other
  misc_feature (442)..(442): n is a, c, g, or t
  modified_base (514)..(514): a, c, t, g, unknown or other
  misc_feature (514)..(514): n is a, c, g, or t
  modified_base (537)..(537): a, c, t, g, unknown or other
  misc_feature (537)..(537): n is a, c, g, or t
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccaggggaaggggctgggagtgggtctcagcaattaatggtaggggtnattcacatattacgcagactccggtgggggccgttcaccatcaccagagacaactccaggancacactatatactaacaaatgacacagcctgagagtcgaaggacacggccgtgtattattgtgcgagagactcccgaaaggtgacctacgttggtntcttttgattttcgngtggaccaagggacagtggtacacgttctctcacgccctcaaccgagggcccagttccggtcccttccccgnggccctccctgcctccgaggacncctaccgtccgagaccg

SEQ ID NO: 204245 - DNA, 618 bp, Homo sapiens
  misc_feature: GYAE6OF01C62BI.38.28.C06.1.454.CMB.1.raw
  modified_base (216)..(216): a, c, t, g, unknown or other
  misc_feature (216)..(216): n is a, c, g, or t
  modified_base (272)..(272): a, c, t, g, unknown or other
  misc_feature (272)..(272): n is a, c, g, or t
  modified_base (336)..(336): a, c, t, g, unknown or other
  misc_feature (336)..(336): n is a, c, g, or t
  modified_base (383)..(383): a, c, t, g, unknown or other
  misc_feature (383)..(383): n is a, c, g, or t
  modified_base (594)..(594): a, c, t, g, unknown or other
  misc_feature (594)..(594): n is a, c, g, or t
tcagtcgatcacgtcacgaccggtgctcgatttagagctcacgtattgggtttgggctgagctgactttttcttgtggctattttaaaaggtgtccagtgtgaggtgcaggtgtcggagtctggggggaggcttggttcagcctgggggggtccctgagactctcctgtgcagtctctggattaacctttagtgactatgccatgatctgggtccnccaggctccgaggggaaggggctgggagtgggtctcagcaattatgggtaggggtnattcaccatattacgcagactccggtgggggccgttcaccatcaccagagacaactccaggacncaacactaatatactaacaaatcgcacacgcctgagagtcgaggacncggtcgtgtattatgtgacgagagactacccgaacggtcgaccctacgttggtcgtcttttgtatttcgtggtcggaccgaagggacctaagtcggtacctacccgttctccttctacgcccttacccaaccgaaaccgggtcccctacggttcccggttcccttccccccggtaggtccccgtccccgttcgtcccgtccgacgggaccnccgtaaccccgtccgcggaaaccg

SEQ ID NO: 204246 - DNA, 590 bp, Homo sapiens
  misc_feature: GYAE6OF01A6XM5.38.28.C06.1.454.CMB.1.raw
  modified_base (214)..(214): a, c, t, g, unknown or other
  misc_feature (214)..(214): n is a, c, g, or t
  modified_base (267)..(267): a, c, t, g, unknown or other
  misc_feature (267)..(267): n is a, c, g, or t
  modified_base (387)..(387): a, c, t, g, unknown or other
  misc_feature (387)..(387): n is a, c, g, or t
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccnccaggctccagggaggggctggagtgggtctcagcaattaagtggtaggggtnattcaccatattacgcagactcgtgggggccgttcaccatcaccagagacaactccaggagcacactatatctacaaatgacacagcctgagagtcgagacacggcgtgtacttattggngcgagagactaccccgaagggtcaaccctaccgttgggtactctttttagacttttcgtggtcggaccgaaagggactaagttcggtaccacccggttcttccttacacgtcccctaccgaaccgaacgggcccctagttcccggtcccttcccccgtggcccgccctgccctacccggagggccaccctccgtccgaagccg

SEQ ID NO: 204247 - DNA, 600 bp, Homo sapiens
  misc_feature: GYAE6OF01DYP51.38.28.C06.1.454.CMB.1.raw
  modified_base (576)..(576): a, c, t, g, unknown or other
  misc_feature (576)..(576): n is a, c, g, or t
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctgggggggtccctgagactctcctgtgcagtctctggatttaacctttagtgactatgccatgatctgggtccgccaggctccaggggaaggggctggagtgggtctcagcaattaagtggtaggggtgattcaccatattacgcagactccggtgggggccgttcaccatcaccagagacaactccaggagcacactatatactacaaatgacacagcctgagagtcgaggacacggcgtgtattagttgtgcgagacgactccccgaaagggtcgacctaccgttggtcgttcttttgactttctggtcggaccgaagggactaagtcggtaccaccgttcctcttcacgtccctcccgaaccgacgggccctacgtcccggttcccttccccccgtgggccccgtccccgtacgcccttaccgacgggacncccgaacccgttcccgaggaccgg

SEQ ID NO: 204248 - DNA, 611 bp, Homo sapiens
  misc_feature: GYAE6OF01BEN8D.38.28.C06.1.454.CMB.1.raw
  modified_base (304)..(304): a, c, t, g, unknown or other
  misc_feature (304)..(304): n is a, c, g, or t
  modified_base (355)..(355): a, c, t, g, unknown or other
  misc_feature (355)..(355): n is a, c, g, or t
  modified_base (483)..(483): a, c, t, g, unknown or other
  misc_feature (483)..(483): n is a, c, g, or t
tcagtcgatcacgtcacgaccggtgctcgatttagagctcacgtattgggtttggggtctgagagaggagcccagccctgggattttcaggcgttttcatttggtgatcaggactgaacagagagaactcaccatggagtttgggctgagcgtggcttttctgtggctattttaaaggtgtccagtgtgaggtgcaggtgtcggagtcgtgggggagcttggttcaggccgtgggggtccctgagactctcctgtgcagtctctggtacttaaccttagtgactatcgccatgatcgtggtccnccaggcctccgaagggagggctggaggtgggtctcgagacgtaaatttagngggtaggggtatacgttcactagtacttacgcgaagtaccgtccgggtcggggggtccttacaaccgatccaaccgagaacgaccaacgccgaggagaccacaactatactactaacgaaatcgacanaaccgcttaacggaagacggtaccgaaggtaccgacgggaccgttagtattaagtgtacggacgtaagtacgacctacccgaacggtaccgaccctacgtttcggtcttagtttcgtgttcgtacggg

SEQ ID NO: 204249 - DNA, 677 bp, Homo sapiens
  misc_feature: GYAE6OF01BNX88.38.28.C06.1.454.CMB.1.raw
  modified_base (218)..(218): a, c, t, g, unknown or other
  misc_feature (218)..(218): n is a, c, g, or t
  modified_base (274)..(274): a, c, t, g, unknown or other
  misc_feature (274)..(274): n is a, c, g, or t
tcagtcgatcacgtcacgaccggtgctcgatttagagctcacgtattgggtttgggctgagcgtggtcgttttctaggtggctattttaaaagggtgtccagtgtgaggtgcaggtgtcggagtctgggggaggcttggttcagcctggggggtccctgagactctcctgtgcagtctctggattaacctttagtgactatgccatgatctgggtccncaggctcaggggaagggctggagtgggtctcgagctaagttaagtgggtaggggtnattccacctatattacgcagacgtccgggtgggggccgttcaccatccaccgagagaccaactccgaggacgcaacactatacgtctaacaatgaccacacgtcctagagtacgtcgaggacaccgggtccgttagttactttagttggtacggtacgaaggacgtactaccccggtaacggtacgtaaccctaccgtttgggttcgttccgtttttaggtacttttccgtgggtaccgggtaccgtaaaggggtactaaggttcgggtacctacccggttcttccgttccgaaccgtccctaccgaaccgtaacgggcccctacggttcccgttcccgtcccccgtgggccccgtccccgtggtccctaccggtacggaccgaccacccgtcggagacccgg

SEQ ID NO: 204250 - DNA, 404 bp, Homo sapiens
  misc_feature: GYAE6OF01CVHEM.38.28.C06.1.454.CMB.1.raw
  modified_base (311)..(311): a, c, t, g, unknown or other
  misc_feature (311)..(311): n is a, c, g, or t
  modified_base (398)..(404): a, c, t, g, unknown or other
  misc_feature (398)..(404): n is a, c, g, or t
tcagtcgatcacgtcacgaccggtgctcgatttagagctcacgtattgggtttgggctgagctggctttttcttgtggctattttaaaagactccgtgggggccggttcaccatcaccagagacaactccaggagcacactatatctacaaatgcacagcctgagagtcgaggacacggccgtgtattattgtgcgagagatcccaacggtgaccaccttggtgcttttgatttctgtggccaagggacaatggtcaccgtctcttcagcctccaccaagggcccatcgtctcccctgcgccctgctcagncacctccgagagcacagcgccctgggctgcctggtcaaggactacttccacgtgatcgactggagcgggctggcaaggcgacatagnnnnnnn

SEQ ID NO: 204251 - DNA, 656 bp, Homo sapiens
  misc_feature: GYAE6OF01EZB1Q.38.28.C06.1.454.CMB.1.raw
  modified_base (268)..(268): a, c, t, g, unknown or other
  misc_feature (268)..(268): n is a, c, g, or t
tcagtcgatcacgtcacgaccggtgctcgatttagagctcacgtattgggtttgggctgagctggcttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccagggaagggctgggagtgggtctcagcaattaagtgggtaggggtnattcaccatattacgcagactccggtggggggccgttcaccatcaccagagacaactccaggagcacactatatctaacaaatgacacagcctgagagtcgaggacacggccgtgtattagttgtgcgagagactaccccgaaacgggtgaacccgtaccgtttgggtacgttcctttttaggtacttttcgtgggttcggacccgtaaaggggacctaaaggttcggtacctacccggttcttacccgtttcaacgtcccctacccgaacccgaacggggcccctaacgttcccgggttccctttcccccccgtgggccccgtcccccttcggccccgttaccccgaacggggtacccaccccgtaccccgttccggaacggaccgg

SEQ ID NO: 204252 - DNA, 645 bp, Homo sapiens
  misc_feature: GYAE6OF01AT8E0.38.28.C06.1.454.CMB.1.raw
  modified_base (301)..(301): a, c, t, g, unknown or other
  misc_feature (301)..(301): n is a, c, g, or t
tcagtcgatcacgtcacgaccggtgctcgatttagagctcacgtattgggtttggggtctgagagaggagcccagccctgggattttcaggcgttttcatttggtgatcaggactgaacagagagaactcaccatggagtttgggctgagcgtgcgttttctaggtggctattttaaaaggtgtcagtgtgaggtgcaggtgtcggagtctgggggaggcttggttcagcctgggggtccctgagctctcctgtgcagtctctggattaacctttagtgactatgccatgatctgggtccncgaggctccagggagggctggagtgggtctcgagcaagttaagtgggtaggggtgtagttcaccgtattagttacgcacggactccgggtggggggacccttcgaccatccgaacgagaacgacctaactcccgaaggacgcaaccgtaatacctaattacctaacctaaatcggacctaacgaccgtaccgtagaacggtacggtaccggaagggacccgtaacggggtacccgttagttaagttttaacgttggtacgtaccgggtaagacgtacgtacccgtaaacggtccgtaaacccgtacgtttcgggtacttagtttttcgtaagtttcgttcgggg

SEQ ID NO: 204253 - DNA, 664 bp, Homo sapiens
  misc_feature: GYAE6OF01A8T2Y.38.28.C06.1.454.CMB.1.raw
  modified_base (241)..(241): a, c, t, g, unknown or other
  misc_feature (241)..(241): n is a, c, g, or t
  modified_base (345)..(345): a, c, t, g, unknown or other
  misc_feature (345)..(345): n is a, c, g, or t
  modified_base (350)..(350): a, c, t, g, unknown or other
  misc_feature (350)..(350): n is a, c, g, or t
  modified_base (355)..(355): a, c, t, g, unknown or other
  misc_feature (355)..(355): n is a, c, g, or t
  modified_base (617)..(617): a, c, t, g, unknown or other
  misc_feature (617)..(617): n is a, c, g, or t
tcagtcgatcacgtcacgaccggtgctcgatttagagctcacgtattgggtttgggctgagcgtgtcgtttctaggtcggctaattttaaaaggtgtccagtgtgaggtgcaggtgtcggagtctgggggagcttggttcagccgtggggggtccctgagactctcctgtgcagtctctaggatttaacctttagtgactatgtcatgatcgtgggtccgcaggctcgagggagggctggngtcgggtctcgagctaattaagtgggtaaggggttctattcaacctatagtacgcaagacgtcggtgggggtccttcaccagtcaccagagaccaactcaggancaacntaatntactaacaatgcaagcgcctgagacggtacgaggacaccgggtcgtaggttatttagttgaaggcgaagacgactaccccgaaacggggttcaaccctaaccgtttgggcgtttaccttttggttaactttcgtaggttacggtacccgtaaaggggacctaaggttccggtacctaacccggttccttccttacgaccgttacctacccgaaccggacgggtccctaacgttcccggttaccccttccccgacgggtcccncccgtcgcctaccggaagggtcccacctaccctccgggtacgaaccg

SEQ ID NO: 204254 - DNA, 414 bp, Homo sapiens
  misc_feature: GYAE6OF01ALUUF.38.28.C06.1.454.CMB.1.raw
  modified_base (237)..(237): a, c, t, g, unknown or other
  misc_feature (237)..(237): n is a, c, g, or t
  modified_base (407)..(414): a, c, t, g, unknown or other
  misc_feature (407)..(414): n is a, c, g, or t
tcagtcgatcacgtcacgaccggtgctcgatttagagctcacgtattgggtttgggctgagctggctttttcttgtggctattttaaaagactccgtggggggccggttcaccatcaccagagacaactccaggagcacactatatctacaaatgcacagcctgagagtcgaggacacggccgtgtattattgtgcgagagatcccaacggtgaccaccttggtgcttttgatttcngtggccaagggcaatggtcaccgtctcttcagcctccaccaagggcccatcggtcttccccctggcgccctgcctccaggacgcacctccgagacgcacagccggccctgggcctgcctggtcaaggctactccacgtgatcgactgagcgggctggcaaggcgcatagnnnnnnnn

SEQ ID NO: 204255 - DNA, 381 bp, Homo sapiens
  misc_feature: GYAE6OF01EH1GG.38.28.C06.1.454.CMB.1.raw
  modified_base (302)..(302): a, c, t, g, unknown or other
  misc_feature (302)..(302): n is a, c, g, or t
  modified_base (368)..(368): a, c, t, g, unknown or other
  misc_feature (368)..(368): n is a, c, g, or t
  modified_base (374)..(381): a, c, t, g, unknown or other
  misc_feature (374)..(381): n is a, c, g, or t
tcagtcgatcacgtcacgaccggtgctcgatttagagctcacgtattgggtttgggtgccgaagttgctggaggtcacggttcaccatcaccagagacaactccaggagcacactatatctacaaatgcacagcctgagagtcgaggacacggccgtgtattattgtgcgagagatcccaaggtgaccaccttggtgcttttgatttctgtggccaagggacaatggtcaccgtctcttcagcctccaccaagggcccatcggtcttccccctggccgccctgctccaggagcacctcgagngcacagccggcctgggctgcctggtcaaggctactccagtgatcgactgagcgggctggcaaggcncatagnnnnnnnn

SEQ ID NO: 204256 - DNA, 772 bp, Homo sapiens
  misc_feature: GYAE6OF01A3UJE.38.28.C06.1.454.CMB.1.raw
  modified_base (259)..(259): a, c, t, g, unknown or other
  misc_feature (259)..(259): n is a, c, g, or t
  modified_base (269)..(269): a, c, t, g, unknown or other
  misc_feature (269)..(269): n is a, c, g, or t
tcagtcgatcacgtcacgaccggtgctcgatttagagctcacgtattgggtttgggctgagcgtggcttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccgagggaaggggctggagtgggtctcagcaattaagnggtaggggtnattcacatatacgcagactccggtgggggccgttcaccgatcaccagacgacaactccgaggacgcacactatatactaacaaactgacacgacgcgtagagacggtacggaaggaccgaccgggtccgttagttaactttagttcgggtaggaccgaaggaacggtaaccttacccccggaaacggggtttaccgaaaccccgttaacccggtttgggttaccgttaccgtttttttagggtaactttttccgttgggttaccgggaacccggtaaagggggtaaccgtaaaggttccgggttaccctaacccggtttccttacccgtttaccgaccggtaccccttaccccgaaacccggtaaccgggtaccccccgtaacgttccccgggtttacccccgtttccccccggtacggggtcccccggttccccccgttacggtccccttacccggaaccggggaccgtacccccgacccccgttaccgggaacggtaccgg

SEQ ID NO: 204257 - DNA, 618 bp, Homo sapiens
  misc_feature: GYAE6OF01CTK2B.38.28.C06.1.454.CMB.1.raw
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccgaggggaaggggctggagtgggtctcagctaattaagtgggtaggggtgattcaccatattacgcagactccggtggggggtccgtcaccatcaccagagacactccaggagcacgactatatctaacaaatcgacacacgctagagagtcgaggaccacggtccgtagtattagttgtgacgagagactaccccgaacggtcacccgtacgttggtcgtcgttttagattttcgtggtcggaccgaagggacctaagttcggtacacccgttctcgtttaccgacgtccctaccaaccggtaacgggcccctagtcccggttcccgttcccccgtgggacccgtccccgttggaccctccgacgggaccgtaccaccccgttccgacgacccgg

SEQ ID NO: 204258 - DNA, 919 bp, Homo sapiens
  misc_feature: GYAE6OF01C3BB0.38.28.C06.1.454.CMB.1.raw
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctggtccgccaggctccgagggaagggctggagtgggtctcagactaaagttaagtgggttaggggtgtactttccgaacctaattaagtttaaccgctaacggtaaccgtttcccggggtcgggggggggtaccccggtttaccaaccccgtaattacccgaaacccaaggaacgaaccaaaccgtacccgaaggggtacaccaaaccaaaccttaattaactacccttaaaaccgaaaaattcggtacccaaaaccgtaacgggccccgttaaggaaagggtaaccggttaccgggaaacgggtaaccccggaccggggtaccccgggtttagtttaaaacgttttaagtttcgggttagggaaccggtaaagggaacggtaaaccgtttaccccccggtaaaacggggttacccggtaaccccttaacccggtttttacggggtacggtttcccgtttttttaaggtaccgttttttaccgtacgggttaaccggggttaacccgaaaacggggggtaaacctaaacgggttccgggttaacccggaacccccggtttcttacccgttaccgtaacggtacccctaccccgtaaccggaaacccggggtcccctaacgttcccggtttccccgttaccccccggtggacccgttccccgcgtaccctacccgtaaccgggactacccgaaccccttccgaaaggtaacccg

SEQ ID NO: 204259 - DNA, 640 bp, Homo sapiens
  misc_feature: GYAE6OF01BKWT9.38.28.C06.1.454.CMB.1.raw
  modified_base (272)..(272): a, c, t, g, unknown or other
  misc_feature (272)..(272): n is a, c, g, or t
  modified_base (344)..(344): a, c, t, g, unknown or other
  misc_feature (344)..(344): n is a, c, g, or t
  modified_base (411)..(411): a, c, t, g, unknown or other
  misc_feature (411)..(411): n is a, c, g, or t
  modified_base (448)..(448): a, c, t, g, unknown or other
  misc_feature (448)..(448): n is a, c, g, or t
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcaggcctggggggtccctgagactctcctgtgcagtctctggattaacctttagtgactatgccatgatcgtgggtccgccaggctccgaggggaggggctggaggtgggtctcagcaattaagtggtaggggtnattcacctatatacgcaggacgtcggtcgggggccgttacaccatccaccgagagaccaactccgaaggacncacactatatactaacaaatcgacacagcctagagacgtcgagacgaccggcgttagtattagttgngacgagagctacccgaacggtcaaccgtccgttggtnttactttgtactttcgtggaggtaccgaagggactaacgtcggtaccctaccgtcttccgttacacgttcccctaccgaacccggaacggtcccctaacgttcccggtaccccgttccccggtcgggccccgtccccgtccgggacctaccccgggaggttacccgaccgtaccccgtaccggacgtaccgg

SEQ ID NO: 204260 - DNA, 596 bp, Homo sapiens
  misc_feature: GYAE6OF01A4MAW.38.28.C06.1.454.CMB.1.raw
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccgaggggaaggggctgggagtgggtctcgagcaattaagtgggtaggggtgattcaccatattacgcagactccggtgggggccgttcaccatcaccagagacaactccaggacgcacactatatactaacaaatcgacacgacgccgtagagaggtcggaaggaccgaccgggtccgttagttatttagttgtgcgaagagactacccgaaggtcgaacctacgttggtgtcttttgtatttcgtggtcggacgaaggactagtcggtacctaccgtcttcttcacgccctaccgaccgaacgggccctacgttcccggtcccttcccccgtggcccgtccctcgcctccgacggcaccacccgtcgagaccg

SEQ ID NO: 204261 - DNA, 625 bp, Homo sapiens
  misc_feature: GYAE6OF01D8EUN.38.28.C06.1.454.CMB.1.raw
  modified_base (576)..(576): a, c, t, g, unknown or other
  misc_feature (576)..(576): n is a, c, g, or t
  modified_base (584)..(584): a, c, t, g, unknown or other
  misc_feature (584)..(584): n is a, c, g, or t
  modified_base (606)..(606): a, c, t, g, unknown or other
  misc_feature (606)..(606): n is a, c, g, or t
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccaggggaaggggctggagtgggtctcagcaattaagtggtaggggtgattcaccatatacgcagactccggtgggggccgttcaccatcaccagagaccaactccaggagcaacactatatctaacaaatgacacacgcctagagacgtcgaggaccacgggtccgtagtactttatggtcgacgaagacgactaccccgaacgggtcaacctaccgtttgggacgttctttttaggacttttcgtggtcgggacccgtaaaggggtaccaaaggttcggtaccacccggttcttccgttcacgtccctaccgaaccgtaacgggcccctagttcccggttcccttcccccggngggccccncccgttgaccctaccgaggacncccgaacctccgagtaccg

SEQ ID NO: 204262 - DNA, 598 bp, Homo sapiens
  misc_feature: GYAE6OF01AYV91.38.28.C06.1.454.CMB.1.raw
  modified_base (271)..(271): a, c, t, g, unknown or other
  misc_feature (271)..(271): n is a, c, g, or t
  modified_base (583)..(583): a, c, t, g, unknown or other
  misc_feature (583)..(583): n is a, c, g, or t
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccgaggggaaggggctggagtgggtctcagcaattaagtgggtaggggtnattcgacctatattacgcagactccggtgggggccgttcaccatccaccagagaccaactccaggagcacactatatctaacaaatcgacacacgcctagagagtcgaggacacggctgtattagtgtgcgagacgactaccccgaacggtcgaccctacgttggtacgtctttttagattttccgtggttcggacccgaaaggggtacctaaggttcggtacctacccgtcttacttcgacgtccctaccgaaccgaagggcccctagtcccgtcccgttccccgtggcccgccctgcctaccgaggtacnccacccgtcgagacg

SEQ ID NO: 204263 - DNA, 633 bp, Homo sapiens
  misc_feature: GYAE6OF01CGME0.38.28.C06.1.454.CMB.1.raw
  modified_base (219)..(219): a, c, t, g, unknown or other
  misc_feature (219)..(219): n is a, c, g, or t
  modified_base (326)..(326): a, c, t, g, unknown or other
  misc_feature (326)..(326): n is a, c, g, or t
  modified_base (358)..(358): a, c, t, g, unknown or other
  misc_feature (358)..(358): n is a, c, g, or t
  modified_base (626)..(626): a, c, t, g, unknown or other
  misc_feature (626)..(626): n is a, c, g, or t
tcagtcgatcacgtcacgaccggtgctcgatttagagctcacgtattggggtttgggctgagcgtggctttttcttggtggctattttaaaaggtgtccagtgtgaggtgcaggtgtcggagtctgggggagcttggttcaggcctggggggtccctgagactctcctgtgcagtctctggatttaacctttagtgactatgccatgatcgtgggtccncaggctccgaggggaagggctggagtgggtctcagcaattaagtggtaggggtgattcaccatattacgcagactccggtggggggccgttcacgatcaccgagganaccaactccgaggagcaacactatatcctaanaaagtgaccaacgagcctaggaagtacgtacggacggacgaccggtccggtagtttaagttattcggtgacgaggtacgactaccccgaacgtcgaaccctaacggtttggtcgttccgttttagtaacttttcgtagtcggaccgtaaagggactaaggttcgtacctaccgtcgttccttacgcgtaccctaccaacggaccgcctacgtccgtccgttccccgaggcccgtccgcgtccgtaccgacgggactccacccgttcgnggtaccg

SEQ ID NO: 204264 - DNA, 574 bp, Homo sapiens
  misc_feature: GYAE6OF01E091B.38.28.C06.1.454.CMB.1.raw
  modified_base (216)..(216): a, c, t, g, unknown or other
  misc_feature (216)..(216): n is a, c, g, or t
  modified_base (335)..(335): a, c, t, g, unknown or other
  misc_feature (335)..(335): n is a, c, g, or t
  modified_base (457)..(457): a, c, t, g, unknown or other
  misc_feature (457)..(457): n is a, c, g, or t
  modified_base (560)..(560): a, c, t, g, unknown or other
  misc_feature (560)..(560): n is a, c, g, or t
tcagtcgatcacgtcacgaccggtgctcgatttagagctcacgtattgggtttgggctgagcgtgcgttttctaggtggctattttaaaaggtgtccagtgtgaggtgcaggtgtcggagtctgggggaggcttggttcagcctggggggtccctgagactctcctgtgcagtctctggattaacctttagtgactatgccatgatcgtgggtccnccaggctccgaggggagggctgggagtgggtctcagcaattaatggtaggggtgattcaccatattacgcagactccggtggggggccgttcaccatcaccagagacaactccgaggancacactatatctaacgaaatgcacagcctgagtagtcgaaggactacgggccgttagtattagttgtagcgagagactacccgaacggtgaaccctacttgggtctcgttttgacttttcgnggttggaccgaagggacaagtggtaccaccgttctcttcgacgtccctccaaccgacggccctagtccggttcctccccgtgccgccctagccctcgaggtcnccgacctcgagacg

SEQ ID NO: 204265 - DNA, 583 bp, Homo sapiens
  misc_feature: GYAE6OF01BPKAY.38.28.C06.1.454.CMB.1.raw
  modified_base (200)..(200): a, c, t, g, unknown or other
  misc_feature (200)..(200): n is a, c, g, or t
  modified_base (261)..(261): a, c, t, g, unknown or other
  misc_feature (261)..(261): n is a, c, g, or t
  modified_base (266)..(266): a, c, t, g, unknown or other
  misc_feature (266)..(266): n is a, c, g, or t
  modified_base (276)..(276): a, c, t, g, unknown or other
  misc_feature (276)..(276): n is a, c, g, or t
  modified_base (316)..(316): a, c, t, g, unknown or other
  misc_feature (316)..(316): n is a, c, g, or t
  modified_base (327)..(327): a, c, t, g, unknown or other
  misc_feature (327)..(327): n is a, c, g, or t
  modified_base (339)..(339): a, c, t, g, unknown or other
  misc_feature (339)..(339): n is a, c, g, or t
  modified_base (351)..(351): a, c, t, g, unknown or other
  misc_feature (351)..(351): n is a, c, g, or t
  modified_base (356)..(356): a, c, t, g, unknown or other
  misc_feature (356)..(356): n is a, c, g, or t
  modified_base (373)..(373): a, c, t, g, unknown or other
  misc_feature (373)..(373): n is a, c, g, or t
  modified_base (501)..(501): a, c, t, g, unknown or other
  misc_feature (501)..(501): n is a, c, g, or t
  modified_base (503)..(503): a, c, t, g, unknown or other
  misc_feature (503)..(503): n is a, c, g, or t
tcagtcgatcacgtcacgaccggtgctcgatttagagctcacgtattgggtttgggctgagcgtggtcgttttcttaggtggctaattttaaaaggtgtccagtgtgaggtgcaggtgtcggagtcgtggggggagcttggttcaggccgtggggggtccctgagactctcctgtgcagtctgtggtattaaccttagtnactatgccatgactcgtcgggccaccgaggcctccgaggggaagggtctgggagtgggtcncaganaagtttaagnggtaggggtatattacactatatacgcaggccgtccgggnggggtccttanacacacacaganacactccgaganactanactatactacaagaaanacacacacgacgagagagacgacgacgacgtacgtagtagtagtgtagagagagacgtacgtacgacgtacgtacgtcgtgttcgttgttcgttgtgtacgacgagagtagtacgtactcgtctctcncnccacgacgaccgtcctaccgtccgtcccgtcccgtccgccgcccgtccgtccgaccgtacgacgaccgaccgcgacgacg

SEQ ID NO: 204266 - DNA, 772 bp, Homo sapiens
  misc_feature: GYAE6OF01E5L9O.38.28.C06.1.454.CMB.1.raw
  modified_base (197)..(197): a, c, t, g, unknown or other
  misc_feature (197)..(197): n is a, c, g, or t
  modified_base (221)..(221): a, c, t, g, unknown or other
  misc_feature (221)..(221): n is a, c, g, or t
  modified_base (291)..(291): a, c, t, g, unknown or other
  misc_feature (291)..(291): n is a, c, g, or t
tcagtcgatcacgtcacgaccggtgctcgatttagagctcacgtattgggtttgggctgagcgtgtcgttttctaggtggctaattttaaaaggtgtccagtgtgaggtgcaggtgtcggagtctgggggagcttggttcagccgtggggggtccctgagactctcctgtgcagtctctggtaatttaacctttagngactatcgcatgatcgtgggtccnccaggctccggaaggggacggggctggaggtgggtcctacgagactaaagtttaaggtggggtaggggtntacttacaacctattaacgttaccgcgtaacggtaccggtccggggttcggggggggtccccgttacaaccctacgtaccgaccgaagaaccgtaaaccaacccgtcccggaaggacacctaactaaccttaatactaactaacgtaaatcgacacgacgtcgagagacggtagaacggacacggtccgttagttacttagttggcgtacggagtacgtacccgtaaccgtacgggtacctaacccgttcgggtttgttcgtactttttaggtacttttaggtacgggtacggtacccggtaagggtaacctaggttaccggtacccgtacccgtttccttacgttacccgaccgtaccccctaccgtaaacccggacccggtccccttaacgttccccgggttcccccttccccggtccggaccccgtccgttcccgaccgtccggaaccggtcgaaccccttaccggccggaagacccg

SEQ ID NO: 204267 - DNA, 756 bp, Homo sapiens
  misc_feature: GYAE6OF01B49GK.38.28.C06.1.454.CMB.1.raw
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccgaggggaaggggctggagtgggtctcagcaagttagtgggtaggggtgattcaccatattacgcagaccgtccgggtggggggcccgttcaccactccaccgagacgaaccaactccgaggacgaccacacttatatactaacaaatcgacacgagcctaggaagacggtacgaaggaccgaccgggtccgttaggtttaactttagttcggaggacggagtacgtacctaccccgtaacgggtacgaccccgttaccgtttgggttacgttcgtttttacggtacttttccggtagggttcgggaacccggtaaaggggtaccgtaacgttcgggttaacccgtaccccgtttactttcccgttaccgaaccgttcccccgtaaccccgaaccggtaaccccggggacccctaccggttcccccgggtttcccccgtttcccccccggttcgggccccccggttcccctccggttccccgtaccccggtaacgggacccaaccccggtaccccgtacccggagggaaccccg

SEQ ID NO: 204268 - DNA, 592 bp, Homo sapiens
  misc_feature: GYAE6OF01CJ3LI.38.28.C06.1.454.CMB.1.raw
  modified_base (219)..(219): a, c, t, g, unknown or other
  misc_feature (219)..(219): n is a, c, g, or t
  modified_base (276)..(276): a, c, t, g, unknown or other
  misc_feature (276)..(276): n is a, c, g, or t
  modified_base (463)..(463): a, c, t, g, unknown or other
  misc_feature (463)..(463): n is a, c, g, or t
tcagtcgatcacgtcacgaccggtgctcgatttagagctcacgtattgggtttgggctgagctggctttttcttgtggctattttaaaaggtgtccagtggtgaggtgcaggtgtcggagtctgggggaggcttgggttcagcctggggggtccctgagactctcctgtgcaggtctctggattaacctttagtgacgtatggccatgatctgggtccnccaggctccaggggaagggctaggagtgggtctcagcaagttaagtgggtaggggtnattcgaccatattacgcagactccgtgggggccgttcaccatcaccagagaacaactccgaggagcacactatatctaacaaatgctacagcccgagagtcgaggacacgggcctagtattattggtgcgagaggactcccgaacgggtcgaacccgacctttgggtcgtcgtttttgacttttcgngttcggaccaaaggggacaagtcggtaccaccgttctccttcacgtccctccaccgaacgggcccagtccggtccttcccccgtggcccgccctgcctcccgacggacgccgacctcccggagcgaccg

SEQ ID NO: 204269 - DNA, 539 bp, Homo sapiens
  misc_feature: GYAE6OF01AHSOR.38.28.C06.1.454.CMB.1.raw
  modified_base (482)..(482): a, c, t, g, unknown or other
  misc_feature (482)..(482): n is a, c, g, or t
  modified_base (522)..(522): a, c, t, g, unknown or other
  misc_feature (522)..(522): n is a, c, g, or t
tcagtcgatcacgtcacgaccggtgctcgatttagagctcacgtattgggtttggggtctgagagaggagcccagccctgggattttcaggcgttttcatttggtgatcaggactgaacagagagaactcaccatggagtttgggctgagctggctttttcttgtggctattttaaaaggtgtccagtgtgaggtgcaggtgtcggagtcgtgggggaggcttggttcagccgtggggggtccctgagactctcctgtgcagtctctggattaacctttagtgactatgccatgatcgtggtccgccaggctccagggaatgggctggagtgggtctcgagcaattagtggtagggtgattcaccatattacgcagactccggtgggggccgttcaccatcaccagagacaactccaggacgcaacactatactactaacaatcgacacacgcctagagagtcgagacacggacgtgtattnttgtgcgagagactcccgaacggtcgaccgtccttgggtnttcgttttgtgtttcgg

SEQ ID NO: 204270 - DNA, 800 bp, Homo sapiens
  misc_feature: GYAE6OF01DZTJO.38.28.C06.1.454.CMB.1.raw
  modified_base (213)..(213): a, c, t, g, unknown or other
  misc_feature (213)..(213): n is a, c, g, or t
  modified_base (337)..(337): a, c, t, g, unknown or other
  misc_feature (337)..(337): n is a, c, g, or t
  modified_base (627)..(627): a, c, t, g, unknown or other
  misc_feature (627)..(627): n is a, c, g, or t
tcagtcgatcacgtcacgaccggtgctcgatttagagctcacgtattgggtttggggtctgagagaggagcccagccctgggattttcaggtcgttttcatttggtgatcaggactgaacagagagaactcaccagtggtagtttgggctgagcgtggtctttttcgtagtggacttaagttttaaaaggtcgtaccacgttgtaggaggtgntagtttggttggagttcggtgggggacgtcgttaggtacgacggtccggttcggggggtccctggacgtccgttcctccgtgtcgcgtacgtccctgtcgtacttccacgtttagctagtctancgaccagtcggacgtcggttccgggacccgcgacggtcctccggacgggccggtggtcgggtacggttcgggtaccttaccgtaacgttacgttacgaaaggtttaagtacggtaggttaccggtacctaacttacgttaccggacgtacgaacggtaccgtacggtacgggtaccgggtcccgtacctaccgtaccttccgaaccgaaggtaaccgaacttaaacctaacgaaaccgaacctaactaacctacgttaaccgataacgaaacgtacgaaaccgtacccgnggaaccgcccggaacgggaacgaacccgtaccgaccgttaaattacgtaaacgttacggtaggtaaacgggtaacggggaaacgggttcccgggaacgggttcgaccccgggtttggggaacccgggtacccgggaaccggtacccgtcccgggttaaccaccccgggttccc

SEQ ID NO: 204271 - DNA, 727 bp, Homo sapiens
  misc_feature: GYAE6OF01BO44E.38.28.C06.1.454.CMB.1.raw
  modified_base (322)..(322): a, c, t, g, unknown or other
  misc_feature (322)..(322): n is a, c, g, or t
  modified_base (333)..(333): a, c, t, g, unknown or other
  misc_feature (333)..(333): n is a, c, g, or t
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatcgtgggtccgccgaggctccgaggggaagggctggagtgggtctcagcaattaagtggtaggggtgtattcacctatattacgcagacgtcggtgggggccgttcacatcaccaganacaactcaggngacacactatatactaacaaatcgacacagccgtagagacgtcggaaggacctacggccggttagttaagttgtttaggtcgacggaagaagtacctaccccgtaacgggtaccgacccgtaccgtttgggtacgttcgttttacgtacgttttcgtcgggtacggaccggtaaacgggaacgtaacgttcgggttacctacccgtttaccgtttccgttacggtaaccgtccccctaacccgtaaaccccggtaaaccgggcccccttaaaccgggttcccccggttaccccgtttaccccccggttcgggtaccccccgtcccccgttccggtccccgttaaccccgacggggtacccctcccgtaaaccccgtcccggaaggtacccccgg

SEQ ID NO: 204272 - DNA, 775 bp, Homo sapiens
  misc_feature: GYAE6OF01C1CN2.38.28.C06.1.454.CMB.1.raw
  modified_base (218)..(218): a, c, t, g, unknown or other
  misc_feature (218)..(218): n is a, c, g, or t
tcagtcgatcacgtcacgaccggtgctcgatttagagctcacgtattgggtttgggctgagctggctttttcttgtggctattttaaaaggtgtccagtgtgaggtgcaggtgtcggagtctggggggaggcttgggttcagcctggggggtccctgagactctcctgtgcagtctctggattaacctttagtgactatgccatgatcgtgggtcccnccaggctccgaggggaagggctggagtgggtctcagcaattaagtgggtaggggtgattcacatattacgcagacgtccggtgggggccgttcaccatcaccagacgaccaactccgaggactcaacactatactactaacaatacgacaacgagccgtagaagaacggtcggaaggtaccacgggtacccgttaggttaatttagttcgggtaggaccgtaaggtacgtaaccgtacccccggtaaaacgggttaccgtaacccgttaacccgtttggggttcgttccgtttttttaggtaaccgtttttccgtagggttaccgggtaacccggaaacgggggtaacctaaacggtttccggtaaccgttaaccccggttcttacccgttaccgaaccggttacccctacccgaaacccggtaacccgggtccccctaaggttccccgggttacccccgtttccccccggtagggtaccccgttcccccgttacgaccccgttacccggaaccgggtaacccgacccgtaacccccgttacgggaaccgaaccggg

SEQ ID NO: 204273 - DNA, 710 bp, Homo sapiens
  misc_feature: GYAE6OF01CKXQS.38.28.C06.1.454.CMB.1.raw
  modified_base (273)..(273): a, c, t, g, unknown or other
  misc_feature (273)..(273): n is a, c, g, or t
  modified_base (336)..(336): a, c, t, g, unknown or other
  misc_feature (336)..(336): n is a, c, g, or t
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcaggcctggggggtccctgagactctcctgtgcagtctctggattaacctttagtgactatgccatgatctgggtccgccaggctccgaggggaaggggtctggagtgggtctcgagcaattaagtggtaggggtntattcacatatacgcagactcggtgggggccgttcaccatcaccgagagacaactccaggacncacactatatactaacaaatcgcaacgagcctggaacgaggtcggaacggtacgaccgggtccggttagtttaacgtttgttagggttcgacggtaaggacggtaacccgttaccccgaaacggggttcgaaacccgttaccggtttgggttcgtttcgttttaggttacttttcgtacggtcggacccggtaaagggtaacctacgttcgggtacctacccgttccttcgtttaccacgccccttaccgaaacccggacgggtaccccacgtttccccgggtacccctttccccccggtgggccccggttcccccttcggacccttaccccgggaaggtacccacccgtaaccccgtccggaacggtaaccgg

SEQ ID NO: 204274 - DNA, 437 bp, Homo sapiens
  misc_feature: GYAE6OF01EZ5FU.38.28.C06.1.454.CMB.1.raw
  modified_base (211)..(211): a, c, t, g, unknown or other
  misc_feature (211)..(211): n is a, c, g, or t
  modified_base (299)..(299): a, c, t, g, unknown or other
  misc_feature (299)..(299): n is a, c, g, or t
  modified_base (308)..(308): a, c, t, g, unknown or other
  misc_feature (308)..(308): n is a, c, g, or t
  modified_base (413)..(413): a, c, t, g, unknown or other
  misc_feature (413)..(413): n is a, c, g, or t
  modified_base (416)..(437): a, c, t, g, unknown or other
  misc_feature (416)..(437): n is a, c, g, or t
tcagtcgatcacgtcacgaccggtgctcgatttagagctcacgtattgggtttgggtgccgaagttgctggaggtcacggttcaccatcaccagagacaactccaggagcacactatatctacaaatgcacagcctgagagtcgaggacacggccgtgtattattgtgcgagagatccccaacggtgaccaccttggtgcttttgatttcngtggccaagggacaatggtcaccgtctcttcagcctccaccaagggcccatccggtcttccccctggccgccctgctccaggagcccnacctccgangacgccacgacggccggtcccgtcgggcgtcggccgtcggtacgaacggaccttaccttcctacgtcgacgtcgacgtgacggcgggcgtcggacgaaggcgcanagnnnnnnnnnnnnnnnnnnnnnn

SEQ ID NO: 204275 - DNA, 653 bp, Homo sapiens
  misc_feature: GYAE6OF01E2ZLL.38.28.C06.1.454.CMB.1.raw
  modified_base (215)..(215): a, c, t, g, unknown or other
  misc_feature (215)..(215): n is a, c, g, or t
  modified_base (337)..(337): a, c, t, g, unknown or other
  misc_feature (337)..(337): n is a, c, g, or t
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggatttaacctttagtgactatgccatgatctgggtccnccaggctccgaggggaagggctggagtgggtctcagcaattaagtggtaggggtgattcaccattattacgcagacgtccggtggggggccgttcaccatcaccagacgacaactccaggancacactatatctaacaaatcgacaacacgcctaggagaggtacgaaggaccacgggtccgttagttactttagttgtggacgagacgactaccccgaacgggtcacccgtacgtttggttcgttcgtttttagtacttttcgtggtcggtacccgaaaggggtactaaggtcggttaccgacccgttcttcctttacgacgtcccctacccgtaaccggaaccggtccctacgttcccggttccccttccccccggtggccccggtcccttcgacccgttccgaacgggaccacccgtaccccgtccggagacccg

SEQ ID NO: 204276 - DNA, 648 bp, Homo sapiens
  misc_feature: GYAE6OF01DT0UW.38.28.C06.1.454.CMB.1.raw
  modified_base (157)..(157): a, c, t, g, unknown or other
  misc_feature (157)..(157): n is a, c, g, or t
  modified_base (169)..(169): a, c, t, g, unknown or other
  misc_feature (169)..(169): n is a, c, g, or t
  modified_base (204)..(204): a, c, t, g, unknown or other
  misc_feature (204)..(204): n is a, c, g, or t
  modified_base (222)..(222): a, c, t, g, unknown or other
  misc_feature (222)..(222): n is a, c, g, or t
  modified_base (246)..(246): a, c, t, g, unknown or other
  misc_feature (246)..(246): n is a, c, g, or t
  modified_base (305)..(305): a, c, t, g, unknown or other
  misc_feature (305)..(305): n is a, c, g, or t
  modified_base (341)..(341): a, c, t, g, unknown or other
  misc_feature (341)..(341): n is a, c, g, or t
  modified_base (347)..(347): a, c, t, g, unknown or other
  misc_feature (347)..(347): n is a, c, g, or t
  modified_base (358)..(358): a, c, t, g, unknown or other
  misc_feature (358)..(358): n is a, c, g, or t
  modified_base (368)..(368): a, c, t, g, unknown or other
  misc_feature (368)..(368): n is a, c, g, or t
  modified_base (373)..(373): a, c, t, g, unknown or other
  misc_feature (373)..(373): n is a, c, g, or t
  modified_base (381)..(381): a, c, t, g, unknown or other
  misc_feature (381)..(381): n is a, c, g, or t
  modified_base (390)..(390): a, c, t, g, unknown or other
  misc_feature (390)..(390): n is a, c, g, or t
  modified_base (622)..(622): a, c, t, g, unknown or other
  misc_feature (622)..(622): n is a, c, g, or t
  modified_base (642)..(642): a, c, t, g, unknown or other
  misc_feature (642)..(642): n is a, c, g, or t
  modified_base (646)..(646): a, c, t, g, unknown or other
  misc_feature (646)..(646): n is a, c, g, or t
tcagtcgatcacgtcacgaccggtgctcgatttagagctcacgtattgggtttgggctgagcgtgtcgttttctaggtggctaattttaaaaggtgtccagtgtgaggtgcagggtgtggagtcgtgggggagtcttggtcagccgtgggggtcccngagctctcctgngctgtctcgtaggtaactttaactttgtagacttncgcatgctcgtcgggccncgagtccgcggaaggggacgggtntgggaggttggtcagagactaaagtaggtggggtaggttcacttacaactattacacgngacggttcggtccggggcgggggtacctccaactanacgacngaactacaacncgaaggctanaaacntatactanaacgaagcncaagcgtcgaggagtacggcgaaccggtaggtaccgtggttataagttgttaggcacggagtacgaccgtaccgtaacgtcggtaacccgttcgtggtttaccgttcgttaagttcttttaggcggtaacggtacgaacggtcgtaacggtggtacccttctccttccgaccgttcgaccccttacgacccgccggtctacccgtcgtccccgttaccgccgtcccggtccncgtccgtcgacgcacgccgnggcncc

SEQ ID NO: 204277 - DNA, 610 bp, Homo sapiens
  misc_feature: GYAE6OF01BIZIN.38.28.C06.1.454.CMB.1.raw
  modified_base (262)..(262): a, c, t, g, unknown or other
  misc_feature (262)..(262): n is a, c, g, or t
  modified_base (273)..(273): a, c, t, g, unknown or other
  misc_feature (273)..(273): n is a, c, g, or t
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccgaggggaaggggctgggagtggggtctcagcaagttaangggtaggggtnattcacatattacgcagactccggtggggggccgttcaccgatccaccagagacaactccaaggacgacacactatatactaacaaatcgacacagccctagagacgtcgaaggacacggccgtagtattagttggtgcgaagagtactacccgaacgggtcgacctacgttggtcgttacttttgtactttcgtggtcggaccgtaagggacctaagtcggtacctaccgtcttctcacgtccctcaacccgagggtcccagttccggtcccgttccccgtgggccctcccgtcgccctaccgacgggaccgtacccacccgtccggaagacccgg

SEQ ID NO: 204278 - DNA, 617 bp, Homo sapiens
  misc_feature: GYAE6OF01CFIO4.38.28.C06.1.454.CMB.1.raw
  modified_base (367)..(367): a, c, t, g, unknown or other
  misc_feature (367)..(367): n is a, c, g, or t
  modified_base (435)..(435): a, c, t, g, unknown or other
  misc_feature (435)..(435): n is a, c, g, or t
tcagtcgatcacgtcacgaccggtgctcgatttagagctcacgtattgggtttggggtctgagagaggagcccagccctgggattttcaggcgttttcatttggtgatcaggactgaacagagagaactcaccatggagtttgggctgagctggctttttcttgtggctattttaaaaggtgtccagtgtgaggtgcaggtgtcggagtcgtgggggaggcttggttcagccgtgggggtccctgagactctcctgtgcagtctctggattaacctttagtgactatgccatgatcgtgggtccgccgaggctccgaggggaacggggctgggagtgggtctcagctaagttaagtgggtaggggtnattcacgatagttacgcagacgtcggtcgggggccgttcaccatccacgagacgacaactccaggacncacactatactctaacaatcgacacgacgcctagacgtaggtccggaggaccgaccgggtccgttagttaacgttagttggtacggcggtaagacggtacttacccccggaaacgggttccgaaccccgttaacccggtttgggttacgtttaccgtttttaggcgtttttcggtaccgggg

SEQ ID NO: 204279 - DNA, 752 bp, Homo sapiens
  misc_feature: GYAE6OF01EZYFM.38.28.C06.1.454.CMB.1.raw
  modified_base (274)..(274): a, c, t, g, unknown or other
  misc_feature (274)..(274): n is a, c, g, or t
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctggagactctcctgtgcagtctctggatttaaccttagtgactatgccatgatcgtgggtccgccaggctccgaggggaaggggctgggagtgggtctcagcaattaagtgggtaggggtnattcacctatattacgcagtacgtccgggtggggggcccgttcaccgtatccaccgagacgaaccaaccgtccgaagggacgaccaactacttaataactactaaacgaaatcgacaacacgcccttaggaagtacggtacggaacggaaccgaccggggtaccgttagttaatttacgttggtacggcgaagacgtaactaccccgtaaacgggtccgaacccgtaccgtttgggtacgtttctttttaggtaacttttcgtagggtaccggtaccgaaggggtaacgtaacgttcgggtacctacccggttccttaccgtttaccgaccgttacccctaccccgaaccggtaaccggggtacccccttaacggttcccccgggtttacccctttcccccccggtgggtaccccccggtcccttcccggcccttacccggacgggtaccaccccgtaccccgtccggaacggaccgg

SEQ ID NO: 204280 - DNA, 480 bp, Homo sapiens
  misc_feature: GYAE6OF01CNQFI.38.28.C06.1.454.CMB.1.raw
  modified_base (312)..(312): a, c, t, g, unknown or other
  misc_feature (312)..(312): n is a, c, g, or t
  modified_base (461)..(480): a, c, t, g, unknown or other
  misc_feature (461)..(480): n is a, c, g, or t
tcagtcgatcacgtcacgaccggtgctcgatttagagctcacgtattgggtttgggctgagctggctttttcttgtggctattttaaaagactccgtggggggccggttcaccatcaccagagacaactccaggagcacactatatctacaaatgcacagcctgagagtcgaggacacggccgtgtattattgtgcgagagatccccaaggtgaccaccttggtgtctttttgattttctgtggccaagggacaagtggtcaccgtctcttcacgcctccaaccgaagggcccagtccggtccttcccccgnggccgcccctgcctccgaggacgccacctccgagacgacacgagccggcccgtggggcctcggcctgggtacaaacgggccttaaccgttccacggtgtacgtccgagtcggacggccgggactcgggacgtaacgggccacaagtagnnnnnnnnnnnnnnnnnnnn

SEQ ID NO: 204281 - DNA, 817 bp, Homo sapiens
  misc_feature: GYAE6OF01B4ISB.38.28.C06.1.454.CMB.1.raw
tcagtcgatcacgtcacgaccggtgctcgatttagagctcacgtattgggtttggggtctgagagaggagcccagccctgggattttcaggcgttttcatttggtgatcaggactgaacagagagaactcaccatggagtttgggctgagctggtctttttcttgtggcttaattttaaaaggtgtccagtgtgaggtgcaggtgtcggagtcgtggggaggtcttggttcagccgtgggggtccctgagactctcctgtgcagtctcgtaggtaatttaaccgtttagtacgtacttaatcgacctagtagtactcgtcggggtcccgccgacggccgttaccggaagggggtaacggggcgtaggggtaggttcgggtacctacgaagtactaaaagtttaaggttggggtaaggggttgtaacgtttaccgaaccttaagttaacgtttaaccggacgtaacggtaacccggttcccgggggttacgggggggtaccccgtttaccaaacccgtacgtacccgaacccgtaaggaaccggtaaaccctaaaccgtacccggaaagggaacgacctaaacgtaaccttataacttacctaaaacgaaactccgaaccaacgtaccgtacgtacggaacgtacggtacgggaaccggtaccggaacccggttcggttaagttaacgtttacggttcgggtacggaaccgggtaagtaaccgggtaaccttaacccccgggaaaacggttaccggtaaaccccttaccgggtttacggttccgtttacgttttacggttccgttttcggtaccgggg

SEQ ID NO: 204282 - DNA, 901 bp, Homo sapiens
  misc_feature: GYAE6OF01BYDPD.38.28.C06.1.454.CMB.1.raw
  modified_base (191)..(191): a, c, t, g, unknown or other
  misc_feature (191)..(191): n is a, c, g, or t
tcagtcgatcacgtcacgaccggtgctcgatttagagctcacgtattgggtttgggctgagctggctttttcttgtggctattttaaaaggtgtccagtgtgaggtgcaggtgtcggagtctgggggagcttggttcagcctggggggtccctgagactctcctgtgcagtctctggtattaacctttagngactatgccatgatcgtgggtccgccaggcctccgaggggaagggctggaggttggggtctcgaggtattaggttggaactaggtggtaaggagtagggctatcggcggtacttcgtaggttacgaaagggggtccccgtaagtttccaaggtcctaacgtttccctaccccgaaaggtacggaaacccaaaccggtaccctaaaaaggtaaccttttacccccgtaggtttaaacttacccgtaaaactaaaaagttacggaaaaccgtacggttaccgttaaggaacggtaaacggtcccgttaaggggaaccggaaccgtaaccggggttccttttaaggttaactttaccgtaggtaacgtaaccgtaaaaagtttacgtttttaggtaaaggttttaggtaaagggtttaacgtaacgggttacttaaccgttaacgttaccggttaagttacgggtacggttacggtacgggggtacccgtaaacggggtacccgtaacgggttacccgtaccggttacccgtacccgttaccggtaccgtaccccttacccgaaaccccgggtaaccgggtaccccgttaaccggttccccggtttacccccgttccccccggttacgggtaccccccgtccccgttacggtacccccgttaccgggtaaccgggacccggtacccctaacccccggtaccgggtaaacccgg

SEQ ID NO: 204283 - DNA, 598 bp, Homo sapiens
  misc_feature: GYAE6OF01AJ933.38.28.C06.1.454.CMB.1.raw
  modified_base (215)..(215): a, c, t, g, unknown or other
  misc_feature (215)..(215): n is a, c, g, or t
  modified_base (558)..(558): a, c, t, g, unknown or other
  misc_feature (558)..(558): n is a, c, g, or t
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctgggggggtccctgagactctcctgtgcagtctctggattaacctttagtgactatgccatgatctgggtccnccaggctccaggggaaggggctggagtgggtctcagcaattaagtgggtaggggtgattcaccatattacgcagacctccggtggggggccgttcaccatcaccagacgaccaactccaggacgcacactatatctaacaaatgcacacgcctgagagtcgaggacacggccgtgtattatggtgcgagagactccccgaaggtcgacctacgttggtgtcttttgatttcgtggtcggaccgaagggtacctaagttcgggtacctaccggttcttccgttacacgtcccctaccgaaccggaacgggcccctacgttccggtacccttccccgtgggcccncccgtgccctaccgacggcgaccacccgtccggagtaccg

SEQ ID NO: 204284 - DNA, 490 bp, Homo sapiens
  misc_feature: GYAE6OF01DGR2I.38.28.C06.1.454.CMB.1.raw
  modified_base (225)..(225): a, c, t, g, unknown or other
  misc_feature (225)..(225): n is a, c, g, or t
  modified_base (327)..(327): a, c, t, g, unknown or other
  misc_feature (327)..(327): n is a, c, g, or t
  modified_base (367)..(367): a, c, t, g, unknown or other
  misc_feature (367)..(367): n is a, c, g, or t
  modified_base (468)..(490): a, c, t, g, unknown or other
  misc_feature (468)..(490): n is a, c, g, or t
tcagtcgatcacgtcacgaccggtgctcgatttagagctcacgtattgggtttgggctgagctggctttttcttgtggctattttaaaagactccgtggggggccggttcaccatcaccagagacaactccaggagcacactatatctacaaatgcacagcctgagagtcgaggacacggccgtgtattattgtgcgagagactcccaacggtgaccaccttggntcttttgatttcgtgtggaccaagggacaagtggtctaccgtctcttcacgtcctccaaccgaacgggccctagttccggtccctttccccccgtgggcccnccccgtgcctccgaggacgccacccgtccgagacgcacgngcccggccgtggctcgccgtggacaacggtcctaccgttcccgagtacgtacgtcgtacgtcggacggccgggcgtcgggaacgaacggccgacgatcggnnnnnnnnnnnnnnnnnnnnnnn

SEQ ID NO: 204285 - DNA, 763 bp, Homo sapiens
  misc_feature: GYAE6OF01CCYW7.38.28.C06.1.454.CMB.1.raw
  modified_base (271)..(271): a, c, t, g, unknown or other
  misc_feature (271)..(271): n is a, c, g, or t
  modified_base (551)..(551): a, c, t, g, unknown or other
  misc_feature (551)..(551): n is a, c, g, or t
tcagtcgatcacgtcacgaccggtgctcgatttagagctcacgtattgggtttgggctgagcgtggtctttttcttggtggctaattttaaaaggtgtccagtgtgaggtgcaggtgtcggagtcgtggggggagcttggttcaggccgtggggggtcctgagactctcctgtgcagtctcgtggtaactttaaccgtttagtgaactatcggccaagtgtactcgtcgggtcccgccgaggtcctaccggaagggggaggggcgtagggnggttcgggtctacgagtactaagttagtggggtagggtatattccgaactagtacgttacggactacggtaccggttccggggtcggggggtaccttaccaaccgacgtaccgaacgaacggacgtaaaccaaaccgtccggaaggtacacctaactaacgttaacttacgtaaccgtaaataaaacgtcgaactacgaacgacgtaggacgtacgtaacggacggtaccgacggtcttagttacttgtggtcgacgagtacgaccgtaccgacggtacnccgttacggtcgttagttcgtttacgtacttcggtcgggtacggtaacccgaaagggtacctacgttcgggacccttaccgttcgttaccgttacgacccgtacccgaacccgaacggaccgtaccccgtaccggttcccgttacccggtccccgtcgggaccccttcgcccgtacggtccgagggacccaccgaccggtcgggatacccgg

SEQ ID NO: 204286 - DNA, 610 bp, Homo sapiens
  misc_feature: GYAE6OF01AVVLK.38.28.C06.1.454.CMB.1.raw
  modified_base (274)..(274): a, c, t, g, unknown or other
  misc_feature (274)..(274): n is a, c, g, or t
  modified_base (409)..(409): a, c, t, g, unknown or other
  misc_feature (409)..(409): n is a, c, g, or t
  modified_base (449)..(449): a, c, t, g, unknown or other
  misc_feature (449)..(449): n is a, c, g, or t
tcagtcgatcacgtcacgaccggtgctcgatttagagctcacgtattgggtttgggctgagctggctttttcttgtggctattttaaaaggtgtccagtgtgaggtgcaggtgtcggagtctggggggaggcttgggttcagcctgggggggtccctgagactctcctgtgcagtctctggattaacctttagtgactatgccatgatctgggtccgccaggctccgagggaaggggctggagtgggtctcagcaagttaagtgggtaggggtnattcaccatattacgcagactccggtggggggccgttcaccatcaccagagacaactccaggacgcacactatatctaacaaatgacacagccctaggagaggtcgaggaccacgggccgttagtatttattggngcgagagtactacccgaacgggtcacccgtacgtttggtntcgttttgacttttcgtggtcggccgaagggactaagttcggtacctacccggttcttccttcaccgtccctacccgaacccgacgggcccctagttcccggtcccttcccccgtggccccgtccctcgccctaccgacggcgacccaccgtccgagaccg

SEQ ID NO: 204287 - DNA, 593 bp, Homo sapiens
  misc_feature: GYAE6OF01DY2OT.38.28.C06.1.454.CMB.1.raw
  modified_base (273)..(273): a, c, t, g, unknown or other
  misc_feature (273)..(273): n is a, c, g, or t
  modified_base (342)..(342): a, c, t, g, unknown or other
  misc_feature (342)..(342): n is a, c, g, or t
  modified_base (397)..(397): a, c, t, g, unknown or other
  misc_feature (397)..(397): n is a, c, g, or t
  modified_base (400)..(400): a, c, t, g, unknown or other
  misc_feature (400)..(400): n is a, c, g, or t
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggatttaacctttagtgactatgccatgatctgggtccgcaggctccgaggggaaggggctggagtgggtctcgagctaattaagtgggtaggggtnattcacctatattacgcagacgtccgggtgggggtccgtcaccatccaccgagagaccaactccaggancacactatatactaacaatgacacagctgagagtcgaggacacggcgtagtattntgngacgagagactaccgacggtcgaccgtacgttggtcgttcttttgtatttcgtgtacggacgaaggactaagtcggtacctaccgttctcttcgacgtcctaccaaccgacgggtcccacgttcccggtcccgttccccgtcgggcccgtcccgtacgccgtacccgacggacaccctacccgtccgagaccg

SEQ ID NO: 204288 - DNA, 720 bp, Homo sapiens
  misc_feature: GYAE6OF01AJWFN.38.28.C06.1.454.CMB.1.raw
  modified_base (192)..(192): a, c, t, g, unknown or other
  misc_feature (192)..(192): n is a, c, g, or t
  modified_base (346)..(346): a, c, t, g, unknown or other
  misc_feature (346)..(346): n is a, c, g, or t
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctgggggggtccctgagactctcctgtgcagtctctggattaacctttagngactatgccatgatcgtgggtccgccaggctccgaggggaaggggctgggagtgggtctcagactaagttaagtggggtaggggtgattcaaccattattacgcagaccgtccggtgggggccgttcaccatcaccagagacaactcgaggacncacactatactactaacaatcgacacacgacgtggagacgtcggaaggacaccgggtccgttagttagttagttggtacgacggtaagacgtaccgtaccccggaacgggttaccgacccgttaccgttcggttcgtttccgttttagttacctttcggtaggttaccggaaccgtaagggacttaacgttcggttacccgtacccggttccttaccgttaccgaccgtacccctaccgaaacccggtacccgggcccttaccggtccccgggttaccctttccccccgggacggttcccccggtccccgttccgtacccctacccgggtaccgggaaccctcccgtaccccggttaccgaacgggtaacccgg

SEQ ID NO: 204289 - DNA, 832 bp, Homo sapiens
  misc_feature: GYAE6OF01AWCVA.38.28.C06.1.454.CMB.1.raw
tcagtcgatcacgtcacgaccggtgctcgatttagagctcacgtattgggtttggggtctgagagaggagcccagccctgggattttcaggcgttttcatttggtgatcaggactgaacagagagaactcaccatggagtttgggctgagctggtctttttcttgtggcttaattttaaaaggtgtccagtgtgaggtgcaggtgtcggagtcgtggggagtcttggtcaggccgtcggggggtccctgacgtacctctccgtgtgctagtctcgtggtaatttaaccgtttaggtacgtaactagtcgacctagttacgacgttccggtcggggtccccgaccgacggtcccgttaccggaaagggggtaacggggtcgttagggacgggttcgggtcctacgacggtaaccgtaaagtttaacgggtggggtaacggggttatacgttaccgaaccgtaagttaacgtaccgcgtaacggtacccggttccggggttccggggggtccgtttaaccaaccgtacgttacccgaacgtaacgaaccgtaaccgtaaccctaccgggaacggaacgtacctaaacctaaccgttaattaaccgtaaccttaaaccgtaaacgtccggtaacaacccggtaaccgttaccgtaaggaacgtaccgggtacgggaaaccggtccggtacccggttaccggtttagttaacgtttaggttacgtacgggtaaccgtaaagggacgttaacccgtacccgggtaaacggttaccggtaacccctttacgggtttggttacccgtttagttttacgtacgttttcggtaacccgggg

SEQ ID NO: 204290 - DNA, 666 bp, Homo sapiens
  misc_feature: GYAE6OF01CWGPG.38.28.C06.1.454.CMB.1.raw
  modified_base (303)..(303): a, c, t, g, unknown or other
  misc_feature (303)..(303): n is a, c, g, or t
  modified_base (309)..(309): a, c, t, g, unknown or other
  misc_feature (309)..(309): n is a, c, g, or t
  modified_base (340)..(340): a, c, t, g, unknown or other
  misc_feature (340)..(340): n is a, c, g, or t
  modified_base (365)..(365): a, c, t, g, unknown or other
  misc_feature (365)..(365): n is a, c, g, or t
tcagtcgatcacgtcacgaccggtgctcgatttagagctcacgtattgggtttggggtctgagagaggagcccagccctgggattttcaggcgttttcatttggtgatcaggactgaacagagagaactcaccatggagtttgggctgagctggctttttcttgtggctaattttaaaaggtgtccagtgtgaggtgcaggtgtcggagtcgtggggggagcttggttcaggccgtgggggtccctgagactctctgtgcagtctcgtggtacttaacctttagtgtactatcgcatgatcgnggtccncgaggctccgagggaggcgtggtagtggtcncgagtctaaattagtgggtagggtntattacactaattactacgacacgtacgtccgggtcgggggccttaccaccgtaatccgaacgtaagaccgtaaccaacgtccgaaggacgacaacgactatactactaaacaaagtcacacacgccgtaagaggacgtaacggacgaaccgtacgggtccgttagttaacgttagttacggtcgtaccggtaacggaaccggttaaccgtaacccccggtaaaagggttacccgtaaacccgtttaccggttcggggtttaccttttagtttttacggtaccgtttttgggtaaccgggg

SEQ ID NO: 204291 - DNA, 196 bp, Homo sapiens
  misc_feature: GYAE6OF01E3264.38.28.C06.1.454.CMB.1.raw
  modified_base (176)..(196): a, c, t, g, unknown or other
  misc_feature (176)..(196): n is a, c, g, or t
tcagtcgatcacgtcacgaccggtgctcgatttagagctcacgtattgggtttggggggaagaggaagactgacggtcctgctccaggagcacctccgagagcacagcggccctgggctgcctggtcaaggactacttccacgtgatcgactgagcgggctggcaaggcgcatagnnnnnnnnnnnnnnnnnnnnn

SEQ ID NO: 204292 - DNA, 659 bp, Homo sapiens
  misc_feature: GYAE6OF01COQL8.38.28.C06.1.454.CMB.1.raw
  modified_base (393)..(393): a, c, t, g, unknown or other
  misc_feature (393)..(393): n is a, c, g, or t
  modified_base (497)..(497): a, c, t, g, unknown or other
  misc_feature (497)..(497): n is a, c, g, or t
  modified_base (559)..(559): a, c, t, g, unknown or other
  misc_feature (559)..(559): n is a, c, g, or t
  modified_base (567)..(567): a, c, t, g, unknown or other
  misc_feature (567)..(567): n is a, c, g, or t
tcagtcgatcacgtcacgaccggtgctcgatttagagctcacgtattgggtttggggtctgagagaggagcccagccctgggattttcaggcgttttcatttggtgatcaggactgaacagagagaactcaccatggagtttgggctgagctggtctttttcttgtggtcttaattttaaaaggtgtcctagtgtgaggtgcgtagggtgtcggagtcggtgggggaggcgttggttcgagccgtggggggtccctggacgacctctccgtgtgcagtctgtggtactttaacctttagtgtactatcgccatgattcgtcgggtccgccgacggctaccgaggggaagggctagggagtgggtctcgagactaagttaaggtgggtagggtntattacactaagtagttacgcacgacgtcgggtcgggggtcccgttacaccgataccaccgagacgaacaaccgtcgaggacgcaactactaatataacctaanaagtcgaccaagaccgctaggaacgaggtacgaacggacctcgggtaccgttagttacgttnttacgggngtacggaaggtcgaaccgttaccccggagggtaaccctaacccggttcgtttacggttacgtttacgttttcggtaattttcggttaacggg

SEQ ID NO: 204293 - DNA, 718 bp, Homo sapiens
  misc_feature: GYAE6OF01B9FUX.38.28.C06.1.454.CMB.1.raw
  modified_base (215)..(215): a, c, t, g, unknown or other
  misc_feature (215)..(215): n is a, c, g, or t
  modified_base (261)..(261): a, c, t, g, unknown or other
  misc_feature (261)..(261): n is a, c, g, or t
  modified_base (271)..(271): a, c, t, g, unknown or other
  misc_feature (271)..(271): n is a, c, g, or t
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatcgtgggtccnccaggctccgaggggaaggggctggagtgggtctcagcaattaagngggtagggtnattcacatatacgcagactccggtgggggccgttcaccatcaccagacgacaactccgaggagcaacactatatactaacaaatcgacacgacgccgtagaaggacgtacggaagggaaccaccgggtccgttagttaatttaacgttggtcggacgaggtaacgtaacgtaccccgaaacgggttcgaaacccgttaccgtttgggtacgtttacgttttttgtaacgtttttcgtgggttaccgggaacccgtaaaggggtacctaaagtttccgggtaccttacccggttcttaccgttacgaaccgtcccctacccgaaacccggaacgggtccccctaagttcccgggttacccctttcccccggtacgggtccccgtccccttcggaccccttacccggaagggaccctacccgtaccccgttcccgggaagtaaccccgg

SEQ ID NO: 204294 - DNA, 722 bp, Homo sapiens
  misc_feature: GYAE6OF01AXGKM.38.28.C06.1.454.CMB.1.raw
  modified_base (631)..(631): a, c, t, g, unknown or other
  misc_feature (631)..(631): n is a, c, g, or t
  modified_base (682)..(682): a, c, t, g, unknown or other
  misc_feature (682)..(682): n is a, c, g, or t
  modified_base (713)..(713): a, c, t, g, unknown or other
  misc_feature (713)..(713): n is a, c, g, or t
tcagtcgatcacgtcacgaccggtgctcgatttagagctcacgtattgggtttgggctgagctggctttttcttgtggctattttaaaaggtgtccagtgtgagtgcaggtgtcggagtcgtgggggagcttggtcagccgtggggggtccctgagactctcctgtgcagtctctggtactttaaccgtttagtgactagtcgccagtgactcggtcgggtacccgcgaggccgtccggaaggggacggggtctgggtaggttcgggtactacaggtactaaagtttaggtggggttagggtctacttaccactaagttacgttaccgaccgacggtaccggtcccgggggtacgggggtccccttacaacccactaccccgaaccgaaggaccaactaacccgtacgacggactaccaactaacttaatacttaccaaactaagtcgacctacgacgtccgaggaacggacggtacggaacggtaccggtaccgttcgttaagttacgtttagtcggacggacgacgtacgtacccgaccgtacggtacaccgttacgttgttctttcgttagttcgttcgagtacggaacgaacgtacgtacgtcgtaccgtaccgttctacgttaccnccgtaccacccgacgtccgtccctacgtcccgtacccgtcccgtcggcccncccgtcgacctaccgacggacgacccgaccncgacgaccg

SEQ ID NO: 204295 - DNA, 675 bp, Homo sapiens
  misc_feature: GYAE6OF01C09PE.38.28.C06.1.454.CMB.1.raw
  modified_base (568)..(568): a, c, t, g, unknown or other
  misc_feature (568)..(568): n is a, c, g, or t
  modified_base (588)..(588): a, c, t, g, unknown or other
  misc_feature (588)..(588): n is a, c, g, or t
  modified_base (612)..(612): a, c, t, g, unknown or other
  misc_feature (612)..(612): n is a, c, g, or t
  modified_base (663)..(663): a, c, t, g, unknown or other
  misc_feature (663)..(663): n is a, c, g, or t
tcagtcgatcacgtcacgaccggtgctcgatttagagctcacgtattgggtttggggtctgagagaggagcccagccctgggattttcaggtcgttttcatttggtgatcaggactgaacagagagaactcaccatggagtttgggctgagctggtctttttcttgtggtcttaattttaaaaggtgtccagtgtgaggtgcaggtgtcggagtcgtgggggaggcgttggttcaggtcccggttggggggtccctggacggtaccttccgtccgtgtcgctaggttcctcgtaggtactttaaacctttagtagtactatcgacctatgacttcgtgggtccgccgtacggccgtaccggaggggaacgggtcggtagggtaggttcgggtacttcgaacgtactaaagttaagtggggtaagggtgtaattccaacgattacgtaacgcgacgtaccggttccgggtggggggtacccgttacacccgtagtaccgaaccgaagacgaactaacccgtacgacgggacacctacgtacttaagtactacgaaacaatcgacacacncgtagagtacgacgaggacnccggtagttagtaacttagttcgngtacgagacgtacctcccggaagtccgtacctcgttcggttatcgttttancgtttcgtacgg

SEQ ID NO: 204296 - DNA, 700 bp, Homo sapiens
  misc_feature: GYAE6OF01DTZ0Q.38.28.C06.1.454.CMB.1.raw
  modified_base (193)..(193): a, c, t, g, unknown or other
  misc_feature (193)..(193): n is a, c, g, or t
  modified_base (273)..(273): a, c, t, g, unknown or other
  misc_feature (273)..(273): n is a, c, g, or t
  modified_base (337)..(337): a, c, t, g, unknown or other
  misc_feature (337)..(337): n is a, c, g, or t
tcagtcgatcacgtcacgaccggtgctcgatttagagctcacgtattgggtttgggctgagctggctttttcttgtggctattttaaaaggtgtccagtgtgaggtgcaggtgtcggagtctggggggaggcttggttcagccgtggggggtccctgagactctcctgtgcagtctctggattaacctttagngactatgccatgatcgtgggtccgccaggctccgaggggagggctggagtgggtctcagactaattaagtggtaggggtntattcacatatacgcagacgtccgggtcgggggccttcaccatcaaccagacacactcgaggcncacactatactactaacaaatgaccaacgacgtccgtaggaggtacgtacggaaggaccgaccgggtccttagttaactttagttggtggacgtaagacgaacctccccggaaacgggtcgaacccgtccgtttgggtccgtttacgttttgtacttttcggaggttcggaccgtaaggggtacctaaggttcggttacccacccggtttcctcgttacgaccgtaccctaccaacccgggaaccgggtcccctacggttccccggttacccccgttcccccggtgggtccccctcccgtcggtccccttaacccggaacgggacccaccccggttaaccccgcccgggtaaggtaaccccgg

SEQ ID NO: 204297 - DNA, 731 bp, Homo sapiens
  misc_feature: GYAE6OF01CDW1I.38.28.C06.1.454.CMB.1.raw
  modified_base (296)..(296): a, c, t, g, unknown or other
  misc_feature (296)..(296): n is a, c, g, or t
  modified_base (315)..(315): a, c, t, g, unknown or other
  misc_feature (315)..(315): n is a, c, g, or t
  modified_base (452)..(452): a, c, t, g, unknown or other
  misc_feature (452)..(452): n is a, c, g, or t
  modified_base (719)..(719): a, c, t, g, unknown or other
  misc_feature (719)..(719): n is a, c, g, or t
tcagtcgatcacgtcacgaccggtgctcgatttagagctcacgtattgggtttgggctgagcgtggtcgttttcttggtggctaattttaaaaggtgtccagtgtgaggtgcaggtgtcggagtctgggggaggcttggttcagccgtggggggtccctgagctctccgtgtgcagtctctggattaacctttagtgactatgccatgatcgtcggggtcccgccgagggtcctaccggaagggggaaggggtctagggagttgggtctcgagactaattaagtggggtaggggtntacttcactattattacgnacgtcgtccgggtacggggggtccgttacaccagtaccaaccgaggacgacaacctccgaggtacacacaagtatactacctaacaaatcgacacacgtccgtaggagaggtaccggaaggaccgacgggtaccgtnttagtttacgtggtcggacggaggtacgtaacctaccccggtaaacgggtcgtaaccgtacggtttcgggttcgtttcgttttagtaacgtttttcggacggttaccggacggaaagggtacgtaaggttccggtaccgtacccggtctttacctccgtaccgtcccctaccgtaacccggaaccggtcccctacggttcccgggtttcccttcccccgggtcggacccgtcccgtcgtacccgttcccgaaggcccacccgtaccncccgaggacccg

SEQ ID NO: 204298 - DNA, 806 bp, Homo sapiens
  misc_feature: GYAE6OF01CTPI9.38.28.C06.1.454.CMB.1.raw
  modified_base (185)..(185): a, c, t, g, unknown or other
  misc_feature (185)..(185): n is a, c, g, or t
  modified_base (260)..(260): a, c, t, g, unknown or other
  misc_feature (260)..(260): n is a, c, g, or t
  modified_base (263)..(263): a, c, t, g, unknown or other
  misc_feature (263)..(263): n is a, c, g, or t
tcagtcgatcacgtcacgaccggtgctcgatttagagctcacgtattgggtttggggtctgagagaggagcccagccctgggattttcaggcgttttcatttggtgatcaggactgaacagagagaactcaccatggagtttgggctgagctggtctttttcttgtggcttaattttaaaaggtntcagtgtgaggtgcaggtgtcggagtcgtggggagtcttggttcagccggtgggggtccctgacgactctcctgngcngtctcgtgtacttaaccgttgtgtactatcgacctatgtactcgtcgggtcccgccgtaggccgtaccggagggggaacgggtcgtgggtaaggtcgggtctcgaagtactaaagtttaacggtggggttagggtagtacttaccgaacctaagttaacttacgacgtacggtacccggttccggggtacggggggtcccgtttaccgaacccgtacgttcccgaaaccgaacggaacggtaaccctaaaccgtaacccggaacgggtaaccgaacctaaacccgtaaaccttaacgttaaacctttaaccgtaaaacctaaaacgttaccgaaaccgaacgtaaccggtacccggtaaggaacggtaacggttaccgggaaccgggaaccgtacccggggtacccgttagtttaaacggtttagtttacgggttaggcggaaacggtaacgtaacccgttaaccccggaaaccgggttacccgtaaacccttacccggttcgggttacgtttaccgtttttggtacgttttccggttacggg

SEQ ID NO: 204299 - DNA, 691 bp, Homo sapiens
  misc_feature: GYAE6OF01APMDA.38.28.C06.1.454.CMB.1.raw
  modified_base (396)..(396): a, c, t, g, unknown or other
  misc_feature (396)..(396): n is a, c, g, or t
  modified_base (541)..(541): a, c, t, g, unknown or other
  misc_feature (541)..(541): n is a, c, g, or t
tcagtcgatcacgtcacgaccggtgctcgatttagagctcacgtattgggtttggggtctgagagaggagcccagccctgggattttcaggcgttttcatttggtgatcaggactgaacagagagaactcaccatggagtttgggctgagcgtggtcgttttctaggtggctaattttaaaaggtgtccagtgtgaggtgcaggtgtcggagtcgtgggggagcttggttcagccgtggggggtccctgagacgtctcctgtgcagtctcgtggtaactttaacctttagtgactatgcctatgatcgtcggtccgccgaggcctccggaggggaagggcgtagggtaggtcggggtcctacgaacggtactaaagtttaagtgggttaaggggtntacgtacaacctattacttacgcgagtaccggtccgggtcgggggtcccgttccaccgtacgtcccaacgtacgaacgtaaccgaacgtacccgaaggacgacaaccgtaacttaactacttaaccaaacgtaattccgactaanaaccgcctaggaacgtacggtacggacggaaccggccggttaacggttgtaacgtttgttacggtacgaccggtaggtaaccgacgttaccccggaaggtaccacccgttaacggtttgtaacgtttgttttaggtccttttgggtacgg

SEQ ID NO: 204300 - DNA, 736 bp, Homo sapiens
  misc_feature: GYAE6OF01EY8TN.38.28.C06.1.454.CMB.1.raw
  modified_base (234)..(234): a, c, t, g, unknown or other
  misc_feature (234)..(234): n is a, c, g, or t
tcagtcgatcacgtcacgaccggtgctcgatttagagctcacgtattgggtttggggtctgagagaggagcccagccctgggattttcaggcgttttcatttggtgatcaggactgaacagagagaactcaccatggagtttgggcttgagctggtctttttcttgtggcttagttttaaaaggtgtccagtgtgaggtgcgaggtgtcggagtcgtgggggagtcttggttcnggtccgtgggggtccctgagactctctgtcgctagtctcgtaggtacttttaaaccgtttagtacgtacttaagtcgacctaagttcgaactttccgtcggggttaccccgccgtaacgggtccgtaccgggaacgggggaaaggggcgtagggacgggttcgggtctaccggagtactaaagtttaaggtacgggttaggggtacgtaacttaccgaactaagttacgttaacgacgacgtaccggttccgggtcggggggtacccttacgtaccacgttcgaacctacggaacgtaacctaacgtaccgagggaactacaactactagtaactacgaactaatcgaacacgacgcgtacgaggacggtaccgggaacgaccggtacggtaccggttagtttaagtgtttacggtacgccgttaagaaccgtaccgttacccgaaacggtcgtaacccgtacgtttcggttacgtttaccttttacgtgtttaccgtaggg

SEQ ID NO: 204301 - DNA, 639 bp, Homo sapiens
  misc_feature: GYAE6OF01BUIRY.38.28.C06.1.454.CMB.1.raw
  modified_base (277)..(277): a, c, t, g, unknown or other
  misc_feature (277)..(277): n is a, c, g, or t
  modified_base (340)..(340): a, c, t, g, unknown or other
  misc_feature (340)..(340): n is a, c, g, or t
  modified_base (538)..(538): a, c, t, g, unknown or other
  misc_feature (538)..(538): n is a, c, g, or t
tcagtcgatcacgtcacgaccggtgctcgatttagagctcacgtattgggtttgggctgagctggctttttcttgtggctattttaaaaggtgtccagtgtgaggtgcaggtgtcggagtctgggggagcttggttcagcctggggggtccctgagactctcctgtgcagtctctggatttaacctttagtgactatgccatgatcgtgggtcccgccaggcctccgaggggaaggggctgggagtgggtctcagctaaattaagtgggtaggggtnattcacatatacgcagacgtccggtgggggccgttcaccatcaccagacgacaactccaggancacactatatactaacaaatgacacacgcctagagacggtcgaaggaccacgggtcgttagttaatttagttggtgacgtagagaccttaccccgaacgggtacgtaacccgtaccgtttgggttcgttcgttttagtacgttttcgtaggtacggaccgtaagggacctaaggttcgtacctaccgtcttcgtaccncgtccctacccgaaccgtaccggccctacgtcccggttcctcccccggtgccccgtcccgtacgcccgtaccgacggacctacccgacccgtccgagaccg

SEQ ID NO: 204302 - DNA, 708 bp, Homo sapiens
  misc_feature: GYAE6OF01BGAU2.38.28.C06.1.454.CMB.1.raw
  modified_base (274)..(274): a, c, t, g, unknown or other
  misc_feature (274)..(274): n is a, c, g, or t
  modified_base (355)..(355): a, c, t, g, unknown or other
  misc_feature (355)..(355): n is a, c, g, or t
tcagtcgatcacgtcacgaccggtgctcgatttagagctcacgtattgggtttgggctgagcgtggcttttcttgtggctattttaaaaggtgtccagtgtgaggtgcaggtgtcggagtctgggggagcttggttcagcctggggggtccctgagactctcctgtgcagtctctggtattaacctttagtgactatgccatgatctgggtccgccaggctccgaggggaagggctggagtgggtctcgagctaagttaagtggggtaggggtntacttcaacctattagttacgcagaccttccgggtgggggcccgttcacctatcaaccgagaacgtaccaactccgagganaccacaacttaatatacctaaacgaaatgaacacgacgccgtagaggtacggcggaacggaccgaccgggccgttagtaatttacgttggtcgacggaaggtaacgtaccgtaccccgtaacgggtacgaacccgttacgtttgggttcgttcgttttagtacgtttcgttaggtcggtaacccggaagggtaactaacggttcgggtaccctacccggttcctaccgtttaccgacgtacccttacccgaaccgtaccgggtcccctaggttaccccgttcctttcccccggacggtccccgtcccgtcgtccctacccggtacggaccgtacccgtacccgtcgcgaccgg

SEQ ID NO: 204303 - DNA, 711 bp, Homo sapiens
  misc_feature: GYAE6OF01EHSVZ.38.28.C06.1.454.CMB.1.raw
  modified_base (221)..(221): a, c, t, g, unknown or other
  misc_feature (221)..(221): n is a, c, g, or t
  modified_base (266)..(266): a, c, t, g, unknown or other
  misc_feature (266)..(266): n is a, c, g, or t
  modified_base (341)..(341): a, c, t, g, unknown or other
  misc_feature (341)..(341): n is a, c, g, or t
tcagtcgatcacgtcacgaccggtgctcgatttagagctcacgtattgggtttgggctgagcgtggcttttctggtggctattttaaaaggtgtccagtgtgaggtgcaggtgtcggagtcgtggggggaggcttgggttcaggccgtgggggggtccctgagactctcctgtgcagtctctggatttaactttagtgactatgccatgatcgtgggtccncgaggctcgaggggaggggctgggagtggtctcagataattaggngggtaggggtatacttacacctagttactacgcgaacgtaccgtccgggggtggggggtcccgttcaacccgtanccaaccgaggaacgaaccaactccgaggacgacaacactatatacgaacaatggaccacgacgtcctaggagtacggcggaacgaccggaacgggtcctagttaagtttcttaggcggtcgagtacgaacgtacccgaacgggtactaccgtaccgttgggttcgttcgttttagtacgtttcgtcggttaggacggtaagggtaccttacggtcggtaccgtaccgttcgttcgtacgcgttacccgtaccaccggaaccggccgttacgttcccgggttccccttaccccgggtccggtccccgacccgttccgtaccggtaccgtaccgggtaaccgcccgttaacccggtccggaacggtacccgg

SEQ ID NO: 204304 - DNA, 817 bp, Homo sapiens
  misc_feature: GYAE6OF01CAQBB.38.28.C06.1.454.CMB.1.raw
tcagtcgatcacgtcacgaccggtgctcgatttagagctcacgtattgggtttgggctgagctggctttttcttgtggctattttaaaaggtgtccagtgtgaggtgcaggtgtcggagtcgtgggggagcttggttcaggccgtggggggtccctgagactctcctgtgcagtctctggtatttaacctttagtgactatcgccatgatcgtcgggtccgcgaggcctccggagggggaagggctgggaggtgggtctcgagtacgtaaagttaaggtggggtaggggtatacttacgaactagttacgttacggacgtaacggtaccggttccgggggtacggggggtcccgttaccaccgtaacgtaccgaaccgaaggaaccgtaaccaaccgtccggaaggacgaccaacgtacttaatacgtactaaacaagtcgacctaacgacgtaccgtaggaacgacggtacggaacggaccgtaccgggttcgttaagtttacgttaggttaggtcgaacggtaagaacgtaacccgtacccggtaaacgggttaccgaaccctttacgggtttcggttacgtttacctttttggtaactttcggacggttacggaacggaagggtacctaggtccggtaacctcccgttcttaccgtaccgtacgtccccgtaaccgaaacccggtaccggtccctaccgggttccccggtttaccccccgttccccgggtaggcccccggtttccccgtacggtacccccgtaacggaaccgggtacccgtaccccgtaacccggtccgggaactaaccccggg

SEQ ID NO: 204305 - DNA, 840 bp, Homo sapiens
  misc_feature: GYAE6OF01C2W0C.38.28.C06.1.454.CMB.1.raw
tcagtcgatcacgtcacgaccggtgctcgatttagagctcacgtattgggtttggggtctgagagaggagcccagccctgggattttcaggtcgttttcatttggtgatcaggactgaacagagagaactcacatggagttggctgagctggtcttttctgtgcttaagtttaaaggtgtcagtgtgaggtgcaggtgtcggagtcggtgggggaggtcgttaggttcaggtccggtcggggggtccctggacgtacctccgtcctgtcgctagtctagtaggtactttaaccttagtcgacttagtcgccagtagtacgtcgtacgggtccgccgaggtccgtccggaaggggaacggggtcgtgggtacggtggtctacgagtactaaaaggttaggtagggtaggggtctaagttaccgaactaacgttagtaaccgactaacggtaccggttccgggggtaccggggggtacccgttaaccgaacccgtaacgtaccgaaccgaaggtaacgaaacccgtaaccgtaccggaaggaacggaacctaaaccgtaacttaacgttaaccttaaacctaaacgtaaacgttcgaacccgtaaccaccgggtaaccgttaacgggaaggttaacccgggtaacgggaaacccgggtaacccggtacgggttaacccgggttagtttaaacgttttacgggttacggtacggtaaaccgggtaaggaaacccggttaaacccggttaccccgggtaaaccgggtacccggttaaacccgtacccggttttacgggttacttttaccggttttaacgggttacgttttcccggttaacgggg

SEQ ID NO: 204306 - DNA, 665 bp, Homo sapiens
  misc_feature: GYAE6OF01AWZFV.38.28.C06.1.454.CMB.1.raw
  modified_base (273)..(273): a, c, t, g, unknown or other
  misc_feature (273)..(273): n is a, c, g, or t
  modified_base (289)..(289): a, c, t, g, unknown or other
  misc_feature (289)..(289): n is a, c, g, or t
  modified_base (327)..(327): a, c, t, g, unknown or other
  misc_feature (327)..(327): n is a, c, g, or t
  modified_base (336)..(336): a, c, t, g, unknown or other
  misc_feature (336)..(336): n is a, c, g, or t
tcagtcgatcacgtcacgaccggtgctcgatttagagctcacgtattgggtttgggctgagctggctttttcttgtggctattttaaaaggtgtccagtgtgaggtgcaggtgtcggagtctggggggaggcttggttcagccgtggggggtccctgagactctcctgtgcagtctctggattaacctttagtgactatgccatgatcgtgggtccgccaggctccgaggggaggggctggagtggtctcgagcaattaagtgggtaggggtnattcacattactacgnagacgtcggtgggggccgttcacatcaccagagacacnccgaggacncacactatatactaacaaatgaccacacgccgtagagacgtcggaacggacgaaccgggtccgttagttaagtttagttggtagacggaaggacgtaccgtaccccgaacgggtcaacccgttacgttggttgttccgttttgtactttacgtggtacggaccgtaagggactaaggtccggtacctaccgttcctccttacgaccgtaccctaccgaacccgtaacgggcccctacgttcccgggttaccccttcccccgggtcgggccccggtccctgtaccccgtaccgacgggtacccgaccctacccggtccgaacggaacccg

SEQ ID NO: 204307 - DNA, 518 bp, Homo sapiens
  misc_feature: GYAE6OF01D9I0N.38.28.C06.1.454.CMB.1.raw
  modified_base (466)..(466): a, c, t, g, unknown or other
  misc_feature (466)..(466): n is a, c, g, or t
  modified_base (468)..(468): a, c, t, g, unknown or other
  misc_feature (468)..(468): n is a, c, g, or t
  modified_base (470)..(472): a, c, t, g, unknown or other
  misc_feature (470)..(472): n is a, c, g, or t
  modified_base (474)..(474): a, c, t, g, unknown or other
  misc_feature (474)..(474): n is a, c, g, or t
  modified_base (477)..(478): a, c, t, g, unknown or other
  misc_feature (477)..(478): n is a, c, g, or t
  modified_base (482)..(484): a, c, t, g, unknown or other
  misc_feature (482)..(484): n is a, c, g, or t
  modified_base (486)..(518): a, c, t, g, unknown or other
  misc_feature (486)..(518): n is a, c, g, or t
tcagtcgatcacgtcacgaccggtgctcgatttagagctcacgtattggggtttggggtgccgaagttgctggaggtcacggttcaccatcaccagagacaactccaggagcacactatatctacaaatgcacagcctgagagtcgaggacacggccgtgtattattgtgcgagagatccccaagggtgacccaccgtttggtgtcctttttgattttctggtggacccaaaggggaccaagttgggtccacccggttctcttcagccctaccaaccgaacggggccccagtccgggttccttccccccgtgggcccgtccctgccttcccgagggacgccacccgtccggaagacgaccaccgaggcccggtcccgtggggcctcggcccgtgggtaccaaacgggtaccttaccttccgacgtgacgtcgacgtggacgcgggctagggcaagggcactagtgntngnnngnatnnacgnnnannnnnnnnnnnnnnnnnnnnnnnnnnnnnnnnn

SEQ ID NO: 204308 - DNA, 906 bp, Homo sapiens
  misc_feature: GYAE6OF01E2T0T.38.28.C06.1.454.CMB.1.raw
tcagtcgatcacgtcacgaccggtgctcgatttagagctcacgtattggggtttggggctgagcgtggtctttttcttgtggctattttaaaaggtgtccagtgtgaggtgcaggtgtcggagtcgtggggggaggcttggttcaggccgtggggggtccctgagactctcctgtgcagtctctgtattaacctttagtgactatgccatgatcgtcgggtccgcaggcctccgaggggagggtctgggaggtcgggtctacgagtacgtaaagtttaggtaggggtaggggttgacttacacctaattaacgttacgcgacgtaccgttccggggtcgggggggtcccgttacaacctatccaaccgtaagaacgaaccaaacccgtcgaacgggacgacaacctaataacgtactaactaaaccaaaagttccgaaccgaaccgacgtacccgttaggaacgtacggtaccggaaacggtaacccggtaaccgggtcccgtttaaggttaacgttttaagttcgggtacggaacgggtaacgtaacggtaacccggttaaccccggtaaaccgggttacccggtaaaccccgttccggttttcgggttacggtttacggtttttacgtttacgttttccggtacgggttacgggtaacccgggaaacgggtaaccgttaaacgggttccggtaaccccggttacccgtttcccttaccgtttaccggtacccgtccccgtaaccccggtaaacccggaacccggggtccccttaaaccggttcccccggtttacccccggttccccccggtcgggttccccccggtacccttccggtacccccggttaccggaaccgggtacccgtaaccccggaacccccgttacggggaaccgtaacccggg

SEQ ID NO: 204309 - DNA, 831 bp, Homo sapiens
  misc_feature: GYAE6OF01EN9B8.38.28.C06.1.454.CMB.1.raw
tcagtcgatcacgtcacgaccggtgctcgatttagagctcacgtattgggtttggggtctgagagaggagcccagccctgggattttcaggtcgttttcatttggtgatcaggactgaacagagagaactcaccagtggagtttgggctgagctggtcttttcttgtgcttaattttaaaggtgtccagtgtgaggtgcgtaggtgtcggagtcggtgggggaggtcgtttggttcacggtccggttcggggggtcccctggaacgtaccgttccgttccgttggtcgaccgtacgttccgtccgttaggtaacttttaaaccgttttaggtacgtacctaagttcgacctagttggtactccggttaccggggtcccgaccggtacgggtccgtacccgggaacgggggtaacggggtccggtaggggacgggttcgggttcctaacggacgtacttaaagtttagggtacggggttagggtacgtacttacgaacgtagtacttacgcgtacgtaccggtcgggtccgggggtacctcgtacctacgtaccgaacgtacggaacgaaccgtaccgtaccgaacggacgtaccgaaccgtaacttaacgttaactaacccgttaaagtaaactccgaaccgaaccgtacgtacccgtaagggaccggtacgggtaccgggaaccggacccggtaacgggttccggtttagtttacgtttagttcggggtaccgaaggtaacggtaccgtaaccggtaaccccggtacggtacccgtacccgttacggtttacggttgtttacccgtttttgttacggtttcgtaacgggg

SEQ ID NO: 204310 - DNA, 701 bp, Homo sapiens
  misc_feature: GYAE6OF01DY8XU.38.28.C06.1.454.CMB.1.raw
  modified_base (189)..(189): a, c, t, g, unknown or other
  misc_feature (189)..(189): n is a, c, g, or t
  modified_base (217)..(217): a, c, t, g, unknown or other
  misc_feature (217)..(217): n is a, c, g, or t
  modified_base (273)..(273): a, c, t, g, unknown or other
  misc_feature (273)..(273): n is a, c, g, or t
  modified_base (386)..(386): a, c, t, g, unknown or other
  misc_feature (386)..(386): n is a, c, g, or t
tcagtcgatcacgtcacgaccggtgctcgatttagagctcacgtattgggtttgggctgagcgtgcgttttctagtggctattttaaaaggtgtccagtgtgaggtgcaggtgtcggagtctggggagcttggttcagcctggggggtccctgagactctctgtgcagtctctggatttaacctttagngacttattgcctatgatcgtcgggtccnccaggctccgaggggaagggtctggagtggtctacagcaagttaagtggtacgggntattcacatattacgcaagtcctcggtgggggccttcaccgatcaccgagacgacaaactccgaaggtgctacactatacgtcctaagaaatcggcactacgtccgtagaagnggttaccgaaggtaccaacgggtcccgttataacgtttattgggcgtacggacgtacgaccgttacccgaacggtacgtaccgtaaccctttgggtacgtttctttttgtacttttcgtggttcggacccgaaggggtactaacggttcgttacccgtacgttcccgttacgttaccgaccggtacccttacccgaaccggtaacccgggtcccttacgttaccccgggtttccccttaccccccggtggtccccggtccccgttcgacccgtaccgtaaccgggcgtaccccgttacccctggaggtaaccccg

SEQ ID NO: 204311 - DNA, 775 bp, Homo sapiens
  misc_feature: GYAE6OF01B59YJ.38.28.C06.1.454.CMB.1.raw
  modified_base (193)..(193): a, c, t, g, unknown or other
  misc_feature (193)..(193): n is a, c, g, or t
  modified_base (299)..(299): a, c, t, g, unknown or other
  misc_feature (299)..(299): n is a, c, g, or t
  modified_base (351)..(351): a, c, t, g, unknown or other
  misc_feature (351)..(351): n is a, c, g, or t
  modified_base (379)..(379): a, c, t, g, unknown or other
  misc_feature (379)..(379): n is a, c, g, or t
  modified_base (397)..(397): a, c, t, g, unknown or other
  misc_feature (397)..(397): n is a, c, g, or t
tcagtcgatcacgtcacgaccggtgctcgatttagagctcacgtattgggtttgggctgagctggctttttcttgtggctattttaaaaggtgtccagtgtgaggtgcaggtgtcggagtcgtgggggagcttggttcaggccgtggggggtccctgagactctctgtgcagtctctggtattaacctttagngactatcgacctatgacttcgtcgggtacccgccgaggcctccggaagggggaacggggctgggaggttcgggtctcgagactaagtttaaggtggggtaggggtnacttaccacctattactacgcaggtaccgtcgggtcgggggtccttcacctntccgacgagacgaccacgtcgaaggacncaactatatacacctaanaagtcgacacgacgtccgtagacgtacggtaccggaacggaaccgaccggtacgttaagttaactttaggttcgacggacgaagtaaccgtaccgtaccccggtaacgggtacccgtaacccttacggtttagggttcgttttaccgttttaggttacgttttcggtacggtacgggtaaccgtaacgggtaactaacggttcggtacccgttaccgttcccgttaccgtaccgtacccgtaccccgttacccggaaacccggtacccgggtacccttaccggtttccccggtaccccgtttcccccggcggtccccgtcccgttcgaccccgttaccggaacggtacccgtaacccgtcccgtaccggagtacccgg

SEQ ID NO: 204312 - DNA, 728 bp, Homo sapiens
  misc_feature: GYAE6OF01BNT1N.38.28.C06.1.454.CMB.1.raw
  modified_base (292)..(292): a, c, t, g, unknown or other
  misc_feature (292)..(292): n is a, c, g, or t
  modified_base (407)..(407): a, c, t, g, unknown or other
  misc_feature (407)..(407): n is a, c, g, or t
  modified_base (708)..(708): a, c, t, g, unknown or other
  misc_feature (708)..(708): n is a, c, g, or t
tcagtcgatcacgtcacgaccggtgctcgatttagagctcacgtattgggtttgggctgagctggcttttcttgtggctattttaaaaggtgtcagtgtgaggtgcaggtgtcggagtcgtggggggaggcttggttcagccgtggggggtccctgagactctcctgtgcagtctctggatttaacctttagtgactatcgccatgatcgtcgggtcccgccgaggtcctccggaagggggaaggggcgtgggtaggtgggtctcagactaagtttaagtggggtaggggtntattccaacctattacgtacgactacggtaccgtccggggtcgggggtccggttccaccgactaccaccgagaacgaccaaccgtcgaaggacacaacacttaatactacctaanaagtcacaacgactccgtaggaagtagggtacgaacggacgaccgggtcgtttaagttagtttacgttggaggaccggtaagacgtaccgtacccgtaacgggtccgaaacccttgtttcggtatttccgttttagttacgtttcgtacgggtacggacgtaacgggtactaagtcgttacctacccgttctccgttacgtaccgcctacccgaccggaccggtaccctacggttcccggtaccccgttccccggtcggtccccgtccccgtacgtcccgaccggtacgacccgtaccccnccgtaaccggacggtaaccg

SEQ ID NO: 204313 - DNA, 401 bp, Homo sapiens
  misc_feature: GYAE6OF01D6AL6.38.28.C06.1.454.CMB.1.raw
  modified_base (129)..(129): a, c, t, g, unknown or other
  misc_feature (129)..(129): n is a, c, g, or t
  modified_base (271)..(271): a, c, t, g, unknown or other
  misc_feature (271)..(271): n is a, c, g, or t
  modified_base (275)..(275): a, c, t, g, unknown or other
  misc_feature (275)..(275): n is a, c, g, or t
  modified_base (305)..(305): a, c, t, g, unknown or other
  misc_feature (305)..(305): n is a, c, g, or t
  modified_base (381)..(381): a, c, t, g, unknown or other
  misc_feature (381)..(381): n is a, c, g, or t
  modified_base (384)..(401): a, c, t, g, unknown or other
  misc_feature (384)..(401): n is a, c, g, or t
tcagtcgatcacgtcacgaccggtgctcgatttagagctcacgtattgggtttgggtgccgaagttgctggaggtcacggttcaccatcaccagagacaactccaggagcacactatatctacaaatgnacagcctgagagtcgaggacacggccgtgtattattgtgcgagagatcccaaaggtgaccaccttggtgtcttttgatttctagtggccaaggacaatggtcaccgtctcttcacgcctccacgaaggccatcgtctccccnggcncctgctcaggagccacctcgagagccacgngccggccctgggctgcctggtacaaggacttctccaggtgatccgactgagcgggctgggacaaggcgacagtagnagnnnnnnnnnnnnnnnnnn

SEQ ID NO: 204314 - DNA, 936 bp, Homo sapiens
  misc_feature: GYAE6OF01CITTS.38.28.C06.1.454.CMB.1.raw
tcagtcgatcacgtcacgaccggtgctcgatttagagctcacgtattgggtttgggctgagctggctttttcttgtggctattttaaaaggtgtccagtgtgaggtgcaggtgtcggagtcgtgggggaggcttggttcaggccgtggggggtccctgagactctcctgtgcagtctcgtaggtactttaaacctttagtgtacttatcgacctagtgacttcggtcgggtacccgccgacggccgtaccggaagggggaacggggtcgtagggaggtcgggtcctacgaagtaacgttaaagttaagggtaggggttacggggtattacgttacccgaacctaagtttacgttacggaccgtaacggtcccggggttccggggggtccgggggtaccccgttaccacccgaactaccgaaccgaagaaccgtaaccaccgtaccggaaggtacgacaaccgtacttaagtacctaacgtaaacaagtaccgacaacgacgtccgtaggaacgtcggacggaaccggtaccggaccggtaccggtttagtttaagtttacgtttacggacgggtaacgaacgggtaacgttacccgtaaaccccggtaacggggtttaccccgtaacccgtttacgggtttcggtttaccggtttacgttttttaaggtcccgtttacggtaccgggttaaccggaaacccgggaaagggtttaaccgtacgggttttcccggttaaccctacccgttttaccttcccggttaacccgacccgtttccccgaaccccggtaaacccgggtaccccggttaccccgttacccggtttaccccggtttccccccctcccgggtccccgggaccccgtttccccctagggtcccccctaaccggggaacgtaccccgtacccgtaacccccggaggggcctaaacccgg

SEQ ID NO: 204315 - DNA, 833 bp, Homo sapiens
  misc_feature: GYAE6OF01DPRKN.38.28.C06.1.454.CMB.1.raw
  modified_base (707)..(707): a, c, t, g, unknown or other
  misc_feature (707)..(707): n is a, c, g, or t
tcagtcgatcacgtcacgaccggtgctcgatttagagctcacgtattgggtttgggtgccgaagttgctggaggtcacggttcaccatcaccagagacaactcgaggagcacactatatctacaaatgcacagcctgagagtcgaggacacggccgtgtattattgtgacgagagtatcccgaacggttcgaacctaccgtttgggtgtctttttggattttcgtgggtcgggacccgaaaggggtacctaaacgttcgggtaccctacccggttcttccgtttaccgacgcccgttacccgaacccggtaaacggggccccctaacggttcccgggttcccctttaccccccggtgggtccccgtcccccttggtcccgttaccccgaagggggaacctccccgtaaccccgtacccggaaggtacggcccgtaaccggacggggtccccgggtccccgttagggggcccttaacgggccccgggttaacgggtaacccaaaaacggggttaccctttaaaccgttttccccggaaacgggtttacggtaaaccgttaccgggtaaacccgtttggggtaaaccggggtcccgggggttcgttaaccgggggaccggtaaacggggtccccggtaaaccgttaaacggttagggtctaccgtggaccgagacgtaacggccaagtcgacttaccgagtacacgtanagacgtagacgtacgtacgtacgtacgtagtagtacgacgacgtacgtacgtacgtcgtacgtacgtacgtacggtacgtacgtacgtcgtacgtgtacggtcgtacgtacgacgtacgtcgtacg

SEQ ID NO: 204316 - DNA, 767 bp, Homo sapiens
  misc_feature: GYAE6OF01DX54X.38.28.C06.1.454.CMB.1.raw
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcaggccgtggggggtccctggagactctcctgtgcagtctctggatttaacctttagtgactatgccatgatcgtgggtaccgccaggcctccgaaggggaaggggtctagggaggtggggtctcgagactaattaagtggggtacggggtgattaccgaccgtaattattacgacacggaccgttccgggtcgggggtaccgttcaaccgtagtccaaccgagtacgaccaacgtaccgaggacgaccactactaatatacctaacaaatcgactaacgacggtcctaggaacggtagtaccggacggtacgtacccggggtaccttagttaacgtttaagtttcgggacggtaacgtaggaacgtaaccgtacccgtaacggggtacgtaacctaccgggttttcggtacgtttacgttttaaggtacgttttccgtacggggttaccgtaaccgtaaacggggtaactaaacggttcggttaccctaaccgttccgtttaccgttaaccgacccgttaccgtacccgtaaaccgaacccggtaccctaacgttcccggttaccccttcccccggttggcccccgtcccgtacgtcccgtacgcggtacaccctaccgcgacgtaccg

SEQ ID NO: 204317 - DNA, 748 bp, Homo sapiens
  misc_feature: GYAE6OF01C3BVH.38.28.C06.1.454.CMB.1.raw
  modified_base (650)..(650): a, c, t, g, unknown or other
  misc_feature (650)..(650): n is a, c, g, or t
  modified_base (739)..(739): a, c, t, g, unknown or other
  misc_feature (739)..(739): n is a, c, g, or t
tcagtcgatcacgtcacgaccggtgctcgatttagagctcacgtattgggtttgggctgagcgtggtcgtttttcttggtcggctagtttttaaaaaggtgtccagtgtgaggtgcaggtgtcggagtcgtgggggagcttggttcagccgtggggggtccctgagactctcctgtgcagtctcgtaggtatttaacctttagtgactatcggcctatgatcggtcgggtcccgccgacggtccgtaccggaggggagggtcgtaggtaggtcgggtctacgacgacgttaaattaaggtaggggttacggggtatacgttccaacctaagttaacgttacggacctaacggtaccggtcccgggggtacggggggtcccgttaccacctatacccaacgacgtacgaacctaacgtaccgaaggacgactaactacgttaataccttaaccgtaaacacgtccgactacgaccgtcgtacggaggtaacgcgggaacggaaccggacggtcgttattagtttagtcgacgtacggagtaccaaccgttacccgaacgggttacctacccgttagttcggttacgttttatttggttaccttggtacggtacgcgtaaggctagttccgacctaccgtcttcacgtaccnccttacggaccggtacgccctacggtcccgttcccgtaccccgtagccccggtcctacgggtccacggtacgaccctaccgttacccgnggtcgaccg

SEQ ID NO: 204318 - DNA, 739 bp, Homo sapiens
  misc_feature: GYAE6OF01CB6M4.38.28.C06.1.454.CMB.1.raw
  modified_base (266)..(266): a, c, t, g, unknown or other
  misc_feature (266)..(266): n is a, c, g, or t
tcagtcgatcacgtcacgaccggtgctcgatttagagctcacgtattgggtttgggctgagctggctttttcttgtggctattttaaaaaggtgtccagtgtgaggtgcaggtgtcggagtctggggagcttggttcagcctgggggtccctgagactctcctgtgcagtctctggattaacctttagtgactatgccatgatctgggtccgccaggctccgagggaagggctggagtgggtctcagcaattaagtggtaggggtnagttcaccatattacgcagactccggtgggggtccgttcaccatccaccagagaacaactccaggacgcacactatactactaacaaatcgacacacgtcctaggagtagtcgaaggaaccgacgggaccgttagttaactttagttggttacgcggtaagagacgttacccccgaaacgggtcgtaacccgtaccgtttagggtcgttccgtttttaggtaactttttcggtacggttacgggtacccgaaaggggtaaccctaaaggttccgggtaccctaaccccggtttccttaccgtttccgaaccgtcccccttaccgaaacccggtaacccgggtcccctaacgttcccgggtttacccccgtttcccccccgggtgggtcccccgttccccggttcgacccccgtttacccggaacggggtacccgtacccctaacccccgggttacccgacgggtaaaccccgg

SEQ ID NO: 204319 - DNA, 911 bp, Homo sapiens
  misc_feature: GYAE6OF01A37MJ.38.28.C06.1.454.CMB.1.raw
  modified_base (300)..(300): a, c, t, g, unknown or other
  misc_feature (300)..(300): n is a, c, g, or t
tcagtcgatcacgtcacgaccggtgctcgatttagagctcacgtattgggtttgggctgagctggctttttcttgtggctattttaaaaggtgtccagtgtgagtgcaggtgtcggagtctgggggagcttggttcagccgtggggggtccctgagactctcctgtgcagtctctggtatttaacctttagtgactatgcctatgactcgtcgggtcccgccgaggtcctacccggaggggaaggggctgggtaggtcgggtcctcgacgtactaaagtttaaggtggggtaaggggttntacgttaccaccgtattaacgttaccgccgtaaggtaccgtcccgggggtggggggtccccgttacccaaccgtactaccgaacccgtagtaacggacctaaaccgtccggaaggtacgacctaacgtaccttaagtaacttccaaaactaaagcgaaccgacgtacgcccgtaggaaagtaccggtacgaacgggacccgtaccggggtcgtttaaggttattttagtgggtacgccggaaagtccgaaccgttaccccgggaacgttacccggtacccgtaacggtttcggtaccgttttacgttttcgttaacgttttccgtacgggtacggtaaccggaagggtaaccctaggtaccgtacccgtacccgtacgtttacccgttaccgacgtaccccgtacccgaaaccccgggttacccggtaccccccgttaacggtttccccccgggtttacccccgtttacccccccggggacccggggtttaccccccggttccccccgttaaggggtacccccccttaacccccggggggtaaacggggtaaccccccctaacccccgggtttaaacccccggccccgggggttaaacccgtacccccggg

SEQ ID NO: 204320 - DNA, 643 bp, Homo sapiens
  misc_feature: GYAE6OF01BNJEK.38.28.C06.1.454.CMB.1.raw
  modified_base (263)..(263): a, c, t, g, unknown or other
  misc_feature (263)..(263): n is a, c, g, or t
  modified_base (298)..(298): a, c, t, g, unknown or other
  misc_feature (298)..(298): n is a, c, g, or t
  modified_base (331)..(331): a, c, t, g, unknown or other
  misc_feature (331)..(331): n is a, c, g, or t
  modified_base (334)..(334): a, c, t, g, unknown or other
  misc_feature (334)..(334): n is a, c, g, or t
  modified_base (341)..(341): a, c, t, g, unknown or other
  misc_feature (341)..(341): n is a, c, g, or t
tcagtcgatcacgtcacgaccggtgctcgatttagagctcacgtattgggtttgggctgagcgtggctttttcttgtggctattttaaaaggtgtccagtgtgaggtgcaggtgtcggagtctgggggaggcttggttcagccgtggggggtccctgagactctcctgtgcagtctctggatttaacctttagtgactatgccatgatctgggtccgccaggctccgaggggaaggggctggagtgggtctcagcaattaagngggtaggggtgattacacatatacgcagactcggnggggccgttcactatcacagagacaactcaggncanactatanctaacaatgacacgagcctgaagcgtacggagacacggccgtagtattagttgtagcgagagactacccgaaggtcaccgtacgttggtagtcttttgactttccgtggtacgaccgtaaagggacctaagtcggtacctaccgttctacttccgagtcccctaccgaaccgtaacgggtaccccctacggttacccggtttaccccttaccccccggttgggaccccgttcccccgtcggtccccttacccgggaacggttacccggaacccctaccccggttaacccggtacggtacccg

SEQ ID NO: 204321 - DNA, 733 bp, Homo sapiens
  misc_feature: GYAE6OF01CEOOP.38.28.C06.1.454.CMB.1.raw
  modified_base (391)..(391): a, c, t, g, unknown or other
  misc_feature (391)..(391): n is a, c, g, or t
  modified_base (439)..(439): a, c, t, g, unknown or other
  misc_feature (439)..(439): n is a, c, g, or t
  modified_base (458)..(458): a, c, t, g, unknown or other
  misc_feature (458)..(458): n is a, c, g, or t
  modified_base (503)..(503): a, c, t, g, unknown or other
  misc_feature (503)..(503): n is a, c, g, or t
tcagtcgatcacgtcacgaccggtgctcgatttagagctcacgtattgggtttgggctgagcgtggtctttttcttgtggctattttaaaaggtgtccagtgtgaggtgcaggtgtcggagtcgtgggggagcttggttcaggccgtgggggtccctgagactctcctgtcgcagtctctggtactttaaccgtttaggtcgtaccttatcggacctagttcggacttcgttcgggacccgaccgacggtccttaccgggaagggggacgggtcgttagggaggttcgggttacacgagacttaaagttaagtgggggttagggtctacttaccgaccgtattacgtacgcggaacgtccggttccggggtagggtcccgttacaccgtanaccgacgaacgcaaaccgtaacgtccgaaggacttaaccacctaatanactacgtaacagtacacanaccgctagcgaacgccgaggaacctcggtacgttattagtttagnggtacggacgtaggaccaccgtaaccggtaacgaccgtaaccgttcgttaggttcttagtttacgtttcttccggtgggacgtacggaagtaccgtgttacggtaccctacggtcttacgtccgacctcccgacggccgacccggttaccctcggtccccgttacccgtcccgaccggtcccgtcctaccgtccctacggacccgtacgccccaccgttcgacgtaccgg

SEQ ID NO: 204322 - DNA, 661 bp, Homo sapiens
  misc_feature: GYAE6OF01BEGJY.38.28.C06.1.454.CMB.1.raw
  modified_base (212)..(212): a, c, t, g, unknown or other
  misc_feature (212)..(212): n is a, c, g, or t
tcagtcgatcacgtcacgaccggtgctcgatttagagctcacgtattgggtttgggctgagctggcttttcttgtggctattttaaaaggtgtccagtgtgaggtgcaggtgtcggagtctgggggagcttggttcagcctggggggtccctgagactctcctgtgcagtctctggattaacctttagtgactatgccatgatctgggtccnccaggctccgaggggaagggctgggagtgggtctcgagctaaagttagtgggtaaggggtgacttcacccatacttacggcacgactccggtaggggggtccgttcacctatcaccgagacgaccaactccgaggtacgcactactaactagttacctaacaaatcgactacacggtcctgagtacgtccggaagaccgacggtccgtggttaattacgttggttacgacggtagtaacgtacgtacccgtaacgggttcgaccgtacgtttggtacgttccttttaggtactttcgtggtcggaccgtaagggacctaagtcgggttactaccggtcttacgttcacgtccctaccgacgtaacggccctagtccccggtccttaccccgtggcccctccgtacgccgttaccgacggtacccgccttaaccctcggaacgtacccgg

SEQ ID NO: 204323 - DNA, 452 bp, Homo sapiens
  misc_feature: GYAE6OF01C3VXO.38.28.C06.1.454.CMB.1.raw
  modified_base (278)..(278): a, c, t, g, unknown or other
  misc_feature (278)..(278): n is a, c, g, or t
  modified_base (417)..(417): a, c, t, g, unknown or other
  misc_feature (417)..(417): n is a, c, g, or t
  modified_base (424)..(452): a, c, t, g, unknown or other
  misc_feature (424)..(452): n is a, c, g, or t
tcagtcgatcacgtcacgaccggtgctcgatttagagctcacgtattgggtttgggggggaagaggaagactgacggtcctgccacaggtggtgctgggcacggtgggcactcgacacaacatttgcgctcaactgtcttgaccaccttggtgtcttttgattttctggtcggccgaaagggacaatggtccaccgtctcttcacgcctccaccgtaacggcccagttccggtccttccccgtggccgccctgcctcgaggacgccacctccgagacnccgacgacggcccggtccccggtaggccgtcgtacccggtgggtaccgaaacgggttccttaaccggtttccccaacgggtcgtaactttaccggaacttcggggacggcccggggttcgacggggaccaaggggaccntaagcgnnnnnnnnnnnnnnnnnnnnnnnnnnnnn

SEQ ID NO: 204324 - DNA, 793 bp, Homo sapiens
  misc_feature: GYAE6OF01DEXV3.38.28.C06.1.454.CMB.1.raw
  modified_base (161)..(161): a, c, t, g, unknown or other
  misc_feature (161)..(161): n is a, c, g, or t
  modified_base (228)..(228): a, c, t, g, unknown or other
  misc_feature (228)..(228): n is a, c, g, or t
  modified_base (534)..(534): a, c, t, g, unknown or other
  misc_feature (534)..(534): n is a, c, g, or t
tcagtcgatcacgtcacgaccggtgctcgatttagagctcacgtattgggtttgggctgagctggctttttctgtggctattttaaaaggtgtccagtgtgaggtgcgaggtgtcggagtcgtggggggaggcttggttcaggccgtggggggtccctganactctcctgtgcagtctgtaggtaatttaacctttgtgactagtcgcctatcgattcgtcgggtccnccgacggcctccggaagggggacggggcgttgggaggttcgggtcctacgagacgtaaagtttaaggtggggtaggggttctacttacgaacctagttaacgttaccgacgtaacggtaccgggttccggggtccgggggggtccccgttaccgaaaccgtaccttaccgaaccgaacggaccgtaaaccgaaccgtccggaaggacgactaacccaattactaacacctaaactaagcgtaccaacgacgtcctaaggacgtaacggcgggaacgaacggcggtaccgttattagttcgttaggngtacggacaacgtccgtaacccgtacgggtacgtaacccgtcgtttacgggttctttaccgttttagtacgtttcggtacgttacgggaaccggttaagtacgtaacggttccgtaaccgtaccgttctacccgttcaccgtccctaccggaacggtccggtaacccttccgggtacccttccccgtcccggtaggtcccccgtacgtcccgactacccccgggtatacccgaccgtccccgtaaacggcgtaacccgg

SEQ ID NO: 204325 - DNA, 787 bp, Homo sapiens
  misc_feature: GYAE6OF01AO19S.38.28.C06.1.454.CMB.1.raw
  modified_base (200)..(200): a, c, t, g, unknown or other
  misc_feature (200)..(200): n is a, c, g, or t
  modified_base (212)..(212): a, c, t, g, unknown or other
  misc_feature (212)..(212): n is a, c, g, or t
  modified_base (230)..(230): a, c, t, g, unknown or other
  misc_feature (230)..(230): n is a, c, g, or t
  modified_base (300)..(300): a, c, t, g, unknown or other
  misc_feature (300)..(300): n is a, c, g, or t
  modified_base (320)..(320): a, c, t, g, unknown or other
  misc_feature (320)..(320): n is a, c, g, or t
  modified_base (774)..(774): a, c, t, g, unknown or other
  misc_feature (774)..(774): n is a, c, g, or t
tcagtcgatcacgtcacgaccggtgctcgatttagagctcacgtattgggtttgggctgagcgtgtcgttttctgtggctattttaaaaggtgtccagtgtgaggtgcaggtgtcggagtcgtgggggaggtcttggttccaggtccgtggggggtccctgagcctctcctgtgcagtctcgtggtatttaacctttggnactagtgacctntgatcgttcgggccgcgnggtcctacggaggggacgggtgtagggtggtcggtcctacaggtataagtttaggtacggggtaggggtntatccaactaattaccgtancgacggtaccgccgggggtcgggggtacttaccactactaccgaaccgtaggaacaaaccctaccggacgacggacgacctaactctttaaagttaccttacggaaaacgtactaccgaccgtaacggaccggtacaagggaccgaaccgggttacccggaaacggttaaccccgacgggtttaaccgggttaatttaccggttttaacgaggggttaacccgaggtaacgaaccggttaccgtaacccggtaacgtacccggtaccttaccgggttgtttaacgtttctttagttcttcgtacggtcgaacgtagacgtgttaccgaccggttcttagttacccgtaaccgtcccgaacccgtaccggaaccgtcccgtccgttacccggtcccgttccccgaggtcccgtccccgtccggacccgtaaccggaccgtcaaccccggtacccncgggaacgtaccg

SEQ ID NO: 204326 - DNA, 786 bp, Homo sapiens
  misc_feature: GYAE6OF01CSMOZ.38.28.C06.1.454.CMB.1.raw
  modified_base (174)..(174): a, c, t, g, unknown or other
  misc_feature (174)..(174): n is a, c, g, or t
  modified_base (670)..(670): a, c, t, g, unknown or other
  misc_feature (670)..(670): n is a, c, g, or t
  modified_base (748)..(748): a, c, t, g, unknown or other
  misc_feature (748)..(748): n is a, c, g, or t
  modified_base (764)..(764): a, c, t, g, unknown or other
  misc_feature (764)..(764): n is a, c, g, or t
tcagtcgatcacgtcacgaccggtgctcgatttagagctcacgtattgggtttgggctgagctggctttttcttgtgctaattttaaaaggtgtccagtgtgaggtgcaggtgtcggagtcgtgggggaggcttggttccaggccgtggggggtccctgagactctcctgtgcngccctctgcacttcctaacctttaagtaaacttatttaaagtgagtccgtcgggtcccgccacgcccgtaccggaggggaacggggcgtgggaggtggggtcggaccagtacctaacttaaaccgaaagagtaggtaacgtaaagtaaaaaattactagttagtacggtacttcgtggtacggaacggggcctacgttccgacctacgttcctaaccgagaacgaaccgtaaccgacccaaagtaactccgaacgtggtcggaccgtcgaactaacgtacgtaacggaaccggacgtaggacggaaccgggaccgaaccggaacccgtagggtccttggttaccgttacttcggtggtaccggtaccggaaccgtaccccgacccccgtaacgggtcgggaacggtcgtaaacggagggtacgggacgtacctaccgtagtttacggacgtacgggtaccgggaccgtaccgggtaccgtcggccctaccgttccncgtacccgacgcccctaacgacccggacccggtccctaccggtcccgtaccccctcccggtccgtacccccgtacccnccctaccgacgacccncccgtacgtcccgggtaccggg

SEQ ID NO: 204327 - DNA, 729 bp, Homo sapiens
  misc_feature: GYAE6OF01EWXGT.38.28.C06.1.454.CMB.1.raw
  modified_base (170)..(170): a, c, t, g, unknown or other
  misc_feature (170)..(170): n is a, c, g, or t
  modified_base (213)..(213): a, c, t, g, unknown or other
  misc_feature (213)..(213): n is a, c, g, or t
  modified_base (226)..(226): a, c, t, g, unknown or other
  misc_feature (226)..(226): n is a, c, g, or t
  modified_base (452)..(452): a, c, t, g, unknown or other
  misc_feature (452)..(452): n is a, c, g, or t
  modified_base (468)..(468): a, c, t, g, unknown or other
  misc_feature (468)..(468): n is a, c, g, or t
  modified_base (576)..(576): a, c, t, g, unknown or other
  misc_feature (576)..(576): n is a, c, g, or t
  modified_base (584)..(584): a, c, t, g, unknown or other
  misc_feature (584)..(584): n is a, c, g, or t
tcagtcgatcacgtcacgaccggtgctcgatttagagctcacgtattggggtttgggctgagcggtgtcgttttctaggtggctaattttaaaaggtgtccagtgtgaggtgcaggtgtcggagtcgtgggggaggcttggtcaggccgtggggggtccctgagacttcncctgtgcatctctggtattaacctttagtgactatgccagtancttcgtcgggccnccgtaaggcctaccggaggggaacggggtctagggtcggtgggtcctagaacggtactaaagtttaaacggtggggttaaaggggttctattccgaaacctaattaagttaccggcgaaacggtaccgttccggggtcgggggtaccgtcaaccgtcaccgaaacggagaacggaacctaaaccgtcgaagggactacctaactaactactaagtacctaaataanccggacaaagccggtntaacggtagacgtaacggcgagttacccgtgtaagtttattagtcgtcggtagagaacgtacgtaccgtaaccgtacgtacctacgttacggtgttttcttacggttntttacggngtaccgacgtaacggactaagtcgtacggtaccttctacgtcacgcctaaccggaccgtaacgcccgtacgtttacccgcccgtttccccgggattccggccccttgtacccgaccggacggtcaccctacggcccgtgaacccg

SEQ ID NO: 204328 - DNA, 935 bp, Homo sapiens
  misc_feature: GYAE6OF01ATHHZ.38.28.C06.1.454.CMB.1.raw
tcagtcgatcacgtcacgaccggtgctcgatttagagctcacgtattgggtttggggtctgagagaggagcccagccctgggattttcaggcgttttcatttggtgatcaggactgaacagagagaactcaccatggagtttgggctgagctggtctttttcttgtggcttattttaaaaggtgtccagtgtgaggtgcaggtgtcggagtcgtgggggagtcttggttcagtccgtgggggtccctgacgactctctgtgctagtctcgtggtaactttaaccgtttagtcgtactatcggacctagtgtacttcggttcgggtcccgaccgtacgggtccgtaccggaagggggtaacggggtcgttaggggagggtttcgggtacctacgaacggtaaccttaaaggtttaacgggttacgggggttaagggggttaccgttacgttaacccgtaaccgttaagttaaccgtttaccggacgtaaccggttaaccccggggttccggggggttcccgggggggttacccccggtttaacccgaaacccgtaccggttaacccgtaacccggtaaccgggtaaaccgtaaccccgaaccccgtttaacccgggaacgggtaaacccgaacccgtaaaccggtaaacctttaacgttaacccttaaaccgtaaaacgttaaaacgtccgtaaccgaaccgaacccggtaccggttaaggaacgggtaaccggtaccgggaacgggtaaccggtaccccggggttacggtttacgtttaacgggtttaacgtttcgggtacggtaccggtaaaggtcccggtaaacccgttaccccggggttaaaccggttacccggtaaaccccgttaccgggttttacgggttaaccgtttttaccggtttttaagtttccggtttccgggtttaacccgggg

SEQ ID NO: 204329 - DNA, 809 bp, Homo sapiens
  misc_feature: GYAE6OF01DUHMK.38.28.C06.1.454.CMB.1.raw
  modified_base (197)..(197): a, c, t, g, unknown or other
  misc_feature (197)..(197): n is a, c, g, or t
  modified_base (305)..(305): a, c, t, g, unknown or other
  misc_feature (305)..(305): n is a, c, g, or t
  modified_base (459)..(459): a, c, t, g, unknown or other
  misc_feature (459)..(459): n is a, c, g, or t
  modified_base (568)..(568): a, c, t, g, unknown or other
  misc_feature (568)..(568): n is a, c, g, or t
tcagtcgatcacgtcacgaccggtgctcgatttagagctcacgtattgggtttgggctgagctggtctttttcttgtggcttaattttaaaaggtgtccagtgtgaggtgcaggtgtcggagtcgtgggggaggcttggttcaggccgtggggggtccctgagctctcctgtgcagtctctggtatttaacctttgngactatcgcctatgactcgtcgggtcccgcgaggccgtaccggaggggaagggtctaggtaggttcgggtacctcgaagtactaaaagtttaaggtggggtaggggtntacttaccgaacctagttaacgttaccgactaacggtaccgttccgggggtcggggggtacccttaccgaaccctacgtacccgaacgaacggtagaacccaaacgtccgaaggagaccaacgtactaatactaccgtaacaaagtcgaccaanacggtcctaggaagacgtacgggaacggaaccgtaccggtcgttagttaattacgtggtacgacgtagaacgtactaaccggtagtacctaccgttacgttggtacttnttttacgtacgtttcgtaaggtccggaacgtaagggtaactaggttacccgtaccgttacccgttacctttaccgtaacgtacccgtacccgttaacccgaaccgggttaacccgggtccctaaccggtttcccgtttacccccgtaccccgggtcccgggtaccccgttccccgacggttacccgacccgttaaacggggaccctacccggtttaaacccccgtgggaaaccgtacccgg

SEQ ID NO: 204330 - DNA, 224 bp, Homo sapiens
  misc_feature: GYAE6OF01AM9Q8.38.28.C06.1.454.CMB.1.raw
  modified_base (177)..(181): a, c, t, g, unknown or other
  misc_feature (177)..(181): n is a, c, g, or t
  modified_base (183)..(186): a, c, t, g, unknown or other
  misc_feature (183)..(186): n is a, c, g, or t
  modified_base (189)..(224): a, c, t, g, unknown or other
  misc_feature (189)..(224): n is a, c, g, or t
tcagtcgatcacgtcacgaccggtgctcgatttagagctcacgtattgggtttgggggggaagaggaagactgacggtcctgctccaggagcacctccgagagcacagcggccctgggctgcctggtcaaggctacttccacgtgatcgactggagcgggctggcaaggcgcatagnnnnntnnnnagnnnnnnnnnnnnnnnnnnnnnnnnnnnnnnnnnnnn

SEQ ID NO: 204331 - DNA, 782 bp, Homo sapiens
  misc_feature: GYAE6OF01ELHFD.38.28.C06.1.454.CMB.1.raw
  modified_base (425)..(425): a, c, t, g, unknown or other
  misc_feature (425)..(425): n is a, c, g, or t
tcagtcgatcacgtcacgaccggtgctcgatttagagctcacgtattgggtttggggtctgagagaggagcccagccctgggattttcaggtcgttttcatttggtgatcaggactgaacagagagaactcaccagtggagtttgggcttgagcgtggtctttttcgtgtggcttaagttttaaaaggtgtaccagtgtgaggtgcaggtgtcggagtcgtgggggagtcttggtcacgtccgtcgggggtccctggacgactcgtcgtgtcgcgtagtctcgtaggtactttaaccgtttagtacgactagttgacctagtagtacgtcggtcgggtcccgacgtacggtcctaccgggaggggaacggggtcgtggaggttcgggtcgtacgtagacgtaaagtttaggtgggttaggggttnaactttacgaacctaagttacgtacacgtaacgtccggtaccggggtcgggggtcctacgaacgtactaccgaaccgaagaaccgaacctaacgtaccgaggactacgaacctactaacttactaaccgtaaacaaacgttcgaaccgacgaaacggtacccgtaggtaaaggtaacccggtagggtaaacccggaaccgggaacccggttcccggttaagttaccgtttaaggtttcggacggtaccggttaaggaaccgttaacccggtaccccggtaaacggttaaccccgtaaccgttaaccggtttacgggttacgtttacccgttttaaggttgttttccgggtaaccggg

SEQ ID NO: 204332 - DNA, 693 bp, Homo sapiens
  misc_feature: GYAE6OF01EIT4Z.38.28.C06.1.454.CMB.1.raw
  modified_base (186)..(186): a, c, t, g, unknown or other
  misc_feature (186)..(186): n is a, c, g, or t
  modified_base (213)..(213): a, c, t, g, unknown or other
  misc_feature (213)..(213): n is a, c, g, or t
  modified_base (282)..(282): a, c, t, g, unknown or other
  misc_feature (282)..(282): n is a, c, g, or t
  modified_base (359)..(359): a, c, t, g, unknown or other
  misc_feature (359)..(359): n is a, c, g, or t
tcagtcgatcacgtcacgaccggtgctcgatttagagctcacgtattgggtttgggctgagctggcttttcttgtggctattttaaaaggtgtccagtgtgaggtgcaggtgtcggagtctggggagcttggtcagcctgggggtccctgagactctcctgtgcagtctctggatttaaccttagngactatgccatgacttcgtcgggtccnccgagggcctaccgaggggaacggggtctgggagtcgggtctcgagtacaagtttaagtgggtagggtnattcaaccgtatataccgcagaccgtcggtcgggggtccgttcaccgtactcaccgagacgacactcgagtcgcacnctatactactacaatcgacacgcgacgtagaggtacgtacgacggacaccgggccttaggtattacgtgcgtacgagacgtactacccgtaagggtaccctaaccgtcccgtttagggtccttcgtttttacggttaacttttccggtaacgggttaccggacccgtaaacgggtaaccgtaagttcggttacccgaccggtttcgttaaccgtttccgacgtaccccgacccctaaccggaaccggtccctaccggttcccggttcccctccccgtcggtccccgcccgttacgccccgtacgacggtccacccgtcccgccggaagtaccgg

SEQ ID NO: 204333 - DNA, 911 bp, Homo sapiens
  misc_feature: GYAE6OF01DWVD7.38.28.C06.1.454.CMB.1.raw
  modified_base (359)..(359): a, c, t, g, unknown or other
  misc_feature (359)..(359): n is a, c, g, or t
tcagtcgatcacgtcacgaccggtgctcgatttagagctcacgtattgggtttgggctgagctggtctttttcttgtggcttaattttaaaaggtgtccagtgtgaggtgcgaggtgtcggagtcgtggggggagtcttggttcaggccgtggggggtccctgacgtactctcctgtgctagtctcgtaggtacttttaacctttagtgtacctagtcgaccgtagtcgtacgttcggtccgggtacccgccgaacgggtcccgtaccggaaagggggtaacggggtcgttacggggtaaggttccgggttactacgtaacggtaactaaacggtttaaaggtgggggttaacggggtntaacgttcctaaacgtaattaccggttacgacggtacgtccggtaccggggttcgggggtaccctaccggtaaccacgtaccgaaccgaggaaccgtaacgaaccgtaccggaaggtaaccgactaaactacgtaacttacgtaactaaacgtaaacgccggtaacaccgtacgtaacgtacggaacgtaccgtacggggaacgtaccggtacgggttaccgttaatttacgtaggttgggtacggtacgaacgaacgttaccgtaaccggtacgtacccgtaacccggtttcggttaggttttaccgtttcgttttaacggtttcgtttaccgtagggtaaccggtacgggaaaacgggtaccgttacggttaaccggttacccggtacccgttcccgttaccggttaacccgtaccgtaaccccggttacgaaaccccggtaccggttcccttacccgggtcccttttaccccgggaccccgtcgttaaccccggtccgtaccgtaccgtaccggccgtaaacctccggtaacccggtctaaacggcccg

SEQ ID NO: 204334 - DNA, 674 bp, Homo sapiens
  misc_feature: GYAE6OF01C31UU.38.28.C06.1.454.CMB.1.raw
  modified_base (203)..(203): a, c, t, g, unknown or other
  misc_feature (203)..(203): n is a, c, g, or t
  modified_base (225)..(225): a, c, t, g, unknown or other
  misc_feature (225)..(225): n is a, c, g, or t
  modified_base (410)..(410): a, c, t, g, unknown or other
  misc_feature (410)..(410): n is a, c, g, or t
  modified_base (556)..(556): a, c, t, g, unknown or other
  misc_feature (556)..(556): n is a, c, g, or t
  modified_base (583)..(583): a, c, t, g, unknown or other
  misc_feature (583)..(583): n is a, c, g, or t
  modified_base (668)..(668): a, c, t, g, unknown or other
  misc_feature (668)..(668): n is a, c, g, or t
tcagtcgatcacgtcacgaccggtgctcgatttagagctcacgtattgggtttgggctgagctggcttttctgtgctatttaaaggtgtccagtgtgagtgcaggtcgtcggagtcgtgggggagtcttcggttcacggtccgtggggggtccttggagtcctctcctgtgcagtctctagtacttaaccgtttagctactancgtcagtgacttcgcgggtccnccaggcctacggaggggacggtcgtaggcgtgggtactacgactagtaagttaggttagggtacggggtataccttacaacctagtacgttaccggacgtaccggtacggcccggggtaccgggggtaccttaccgaaccgttacgaacccgaccgaagacaacccgttaaccgacgaacggtanacctaacgtaaccttattactacccgtaaatacacgacctaggaacctacgtcgaagtaccgaggaccggaaccgtcgtacgtaggtttctagtcggccgtagacgtacgacctccggatccgtctagttggattcgttatctgtnacgtagacggtatacgtgaccttctancttaccgacctcgacccgtacgcgtcctaccggtcctccgtcccgtcgcttccgaccgtcgtacgtcggaccctccgaccgtcgngacccg

SEQ ID NO: 204335 - DNA, 1033 bp, Homo sapiens
  misc_feature: GYAE6OF01ELWSH.38.28.C06.1.454.CMB.1.raw
tcagtcgatcacgtcacgaccggtgctcgatttagagctcacgtattgggtttgggctgagctggtctttttcttgtggctattttaaaaggtgtccagtgtgaggtgcaggtgtcggagtcgtgggggagtcttggttcagccgtgggggtccctggagtactctcctgtgctagtctcgtggtaacttttaaccttttagtgtaacttatcgaccattgtacgttcgtcggggtcccgccgacgggtcctaccggaagggggtaacggggccttgggtaggttcggggtacctaccgaaggtactttaaaaggttttaaaggttaggggggttacgggggttacgtaacgttttacccgaaacccttaaagtttaacgtttaaccggaccgtaacgggtaacccggtttcccgggggttccgggggggtccccggtttaccaacccgtaattaccccaaccgaacggaaacgtaaacccgaaaccgttacccggaaggacggtaccctaacctaaacttaataacttaaacctaactaaaagtacgaacctaacgacgtacccgtaggtaacgtacggtacgggaacggaaccggtaccgggtacccggtttagtttaaacgtttaaggtttacgggttacggaaccggaaaggtaccgtaaaccccggtttaacccccggaaaaccgggttacccgtaaccccgttaaccgttttacggggtttccgtttttaccgtttttacgtttacgtttttacggtacggtttacccggggaaaccggttaacgggtaaacgttaacggttacccgggttaaccgttaccccgggttactttacccgtttcccgtaacccggttaccccgttaaccccggaaccccggtaaccgggtcccccgttaccgttaccccggtttcccccccggtttcccccgtaacggggtccccccgtacccccgttcgggtaccccgttaacccgggtaacggtacccccggacccgttaaccccggtacccgaaccggtaacccgg

SEQ ID NO: 204336 - DNA, 666 bp, Homo sapiens
  misc_feature: GYAE6OF01B6ED8.38.28.C06.1.454.CMB.1.raw
  modified_base (224)..(224): a, c, t, g, unknown or other
  misc_feature (224)..(224): n is a, c, g, or t
  modified_base (328)..(328): a, c, t, g, unknown or other
  misc_feature (328)..(328): n is a, c, g, or t
  modified_base (368)..(368): a, c, t, g, unknown or other
  misc_feature (368)..(368): n is a, c, g, or t
  modified_base (399)..(399): a, c, t, g, unknown or other
  misc_feature (399)..(399): n is a, c, g, or t
tcagtcgatcacgtcacgaccggtgctcgatttagagctcacgtattgggtttggggtctgagagaggagcccagccctgggattttcaggcgttttcatttggtgatcaggactgaacagagagaactcaccatggagtttgggctgagcgtggtcgtttttctaggtcggactaattttaaaaggtgtccagtgtgagtgctaggtgtcgagtcgtaggggngtcgttggttcagccgtgggggtccctgagacctctccgtgtgcagtctcgtgaactttaaccgtttagtatacgttagcgcctaatgacttcgtcgggtcccncgtacggtcctcgacggggaagggtcgtggaggttggtcncgaagtactaaagttaggtgggtaagggttntacttacgaccttaagtattacggcgtaacgacgttccggggacggggtccgtacacctagcgaccgtagacgaccaacgtcgaaggcgactacaagttctaactactaactaatcgaactcaacgtccgagtacgacggtcggaacgacgtacggaccgttgtaagtttacgttgcgaacggtaacgtaccgtaaccggtacccgtaacgggtaccgaaacccgttcgttacggtacttttcgtttacgtttgttcggttaacggg

SEQ ID NO: 204337 - DNA, 968 bp, Homo sapiens
  misc_feature: GYAE6OF01C5073.38.28.C06.1.454.CMB.1.raw
  modified_base (197)..(197): a, c, t, g, unknown or other
  misc_feature (197)..(197): n is a, c, g, or t
  modified_base (452)..(452): a, c, t, g, unknown or other
  misc_feature (452)..(452): n is a, c, g, or t
tcagtcgatcacgtcacgaccggtgctcgatttagagctcacgtattgggtttgggctgagctggctttttcttgtggctattttaaaaggtgtccagtgtgaggtgcaggtgtcggagtcgtgggggaggcttggttcaggccgtggggggtccctgagactctcctgtgcagtctcgtagactttaacctttagngactatgccatgattcgtcgggtcccgccgaggtccgtaccggaagggggaacgggggtcgttaggggtagggttcgggtacctacgacgtaacttaaagtttaaaggttagggggttagggggtatactttaccgaaccgttaataacgttaaccggacgtaacggtaccggtcccgggggtaccgggggtcccgttaccgaccccgtagtacccgaaccggaagaaccgtaaccgaaccgtaccggacggacncctaaacgtaacttaatactactaaaacgtaactacgaccgaataccggtactaggaacggtaggtaccgggaacggaaccgtacgggttacgttagttaagttttagttcgggtacgaacggtaacgacgttaaccgaaccccggtaagggtacccgtaaccgtttaccggtttgggtttccgttttacgtttttaggttacccgtttttacggggacggttacccggggtaaacccggtaaaacgggtaacgtttaacggttttcccggggtaaccccgtttacccggttttcccgttaacggtttaccccgaaaccccggttaccccccttacccgggaaaaccccgggttaaccccggggttccccttaccccggggtttttcccccggtaccccccggttttaccccccgtcgggtaaccccccggtttcccccgaccggtttaccccgtaaccccgggaaacgggttacccccggccctaaaaccccccgggtcggcgggaaacccccgg

SEQ ID NO: 204338 - DNA, 903 bp, Homo sapiens
  misc_feature: GYAE6OF01CO56N.38.28.C06.1.454.CMB.1.raw
  modified_base (236)..(236): a, c, t, g, unknown or other
  misc_feature (236)..(236): n is a, c, g, or t
  modified_base (894)..(894): a, c, t, g, unknown or other
  misc_feature (894)..(894): n is a, c, g, or t
tcagtcgatcacgtcacgaccggtgctcgatttagagctcacgtattgggtttgggctgagctggtctttttcttgtggctaattttaaaaggtgtccagtgtgaggtgcaggtgtcggagtcgtgggggagtcttggttcaggccgtgggggtccctgagcttctcctgtgcagtctctggtaactttaacctttgtgacttatcgacctagtagtacgttcgtcggggtacccnccgacggtccgtaccgggaaagggggaacggggtcgtggggtacggttcgggttacctacgaaggtacttaaagtttaaggtgggggttacggggtataccgtttacccaacgttaacttagtaacccggtacgtaaccggtaccgggttccgggggtccgggggggttaccccttaccgaaccctacgtaccccggaaccggaagtaaccaaaccgtacccgaccggaaggaccacctaaacgttaaccttaatacctaacgtaaaactaacgtccgaacctaagacgtcgaggaaggtcgtaaccggacggtaaccgtccggtacgtttagtttaacgttagtcgggtacggaaccggtaggtaaccgtaacccgtttacccccgggaaggttacccgttaacccgttagggttttccggttaggtttacttttacgggttaccgtttcggtacggttaacccgggaaacgggtaaccgtaaccgttaacgggttccgttaacccgttcccggttactttcccgtaaccggacccgtaaccccgtacccggtaaacccggtacccggttccctaacccgggtttcccggttccccgtcccgggtcgtacccccgtccgtacccgaccgttacgacgtaccccgaccgttacccggngacgtccgg

SEQ ID NO: 204339 - DNA, 870 bp, Homo sapiens
  misc_feature: GYAE6OF01EQQ4Q.38.28.C06.1.454.CMB.1.raw
  modified_base (292)..(292): a, c, t, g, unknown or other
  misc_feature (292)..(292): n is a, c, g, or t
  modified_base (388)..(388): a, c, t, g, unknown or other
  misc_feature (388)..(388): n is a, c, g, or t
  modified_base (415)..(415): a, c, t, g, unknown or other
  misc_feature (415)..(415): n is a, c, g, or t
tcagtcgatcacgtcacgaccggtgctcgatttagagctcacgtattgggtttgggctgagctggctttttcttgtggctattttaaaaggtgtccagtgtgaggtgcaggtgtcggagtctgggggagcttggtcagccgtggggggtccctgagactctcctgtgcagtctctaggtactttaacctttagtgactatgccatgtatcgtcgggtccgccgaggcctaccggaggggagggcgtgggtagtgggtccgtacagacgtaagtttaggtggggttaggggtntacgttaccaccttagttacttacggacacggtacggtccggggtcgggggtacccgttcaccgtatccaccgacgacgacctaactcggaagganaacctacaacttataactacaactaancgtacaacgacgtctagtaggacggtaccgggaaggaccgtaccgggcgtttagttaacggttttcggggtacgtacggaacgtacggtaaccgtacccggtaaacccgggtacgtaacccgttaaccgggttcggtttcggttttacggtttttacgtttaccgttttacgggttacggttacccggggtaaaccgggttaaccgggtaacgttaacgggttacccgtttaacccggtaccccgttttaccgttccccgtttacccgtaacccgggttacccccgtaaccccgaaccccgggtaacccggggttacccccttacccgggttcccccggttttaaccccccggttccccccgtacccggggttccccgtccccggtaccgtccccggtaccccggaacgggtacccgttaccccggaaccccgttcccgggccgtaaacccgggg

SEQ ID NO: 204340 - DNA, 760 bp, Homo sapiens
  misc_feature: GYAE6OF01EAXCX.38.28.C06.1.454.CMB.1.raw
  modified_base (392)..(392): a, c, t, g, unknown or other
  misc_feature (392)..(392): n is a, c, g, or t
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggatttaacctttagtgactatgccatgatcgtcgggtccgccaggctaccgaggggaacggggctgggagtgggtctcgagacaagtttaagtgggtaggggtgtattacacctataatacgcagacgtccgggtcggggggtccgttccacctactccaccgagagaccgactccgaggacacactactatactactaacaatcgacaacgacncgtagagaggtacgaggaccaccgggtcgtgttaagtttatggtgacgtaagacgtacgtaccccgaacgggtaccaaccgttaccggtttggtctttcgttttaggttactttcggttggtcggtaaccgaaaggggtactaacggtcggttaccctaccgttccttaccgtttaccaccggtaccccctaccccgggaacccgtaaacccggggtcccccttaacggttttcccccggggttacccccgtttccccccgggtacggggtccccccggttcccccgttaaccggtcccccggaaccccgggtaaccggggtaaccctcccccgtaaaccccggttacccggggaaccgtaacccggg

SEQ ID NO: 204341 - DNA, 902 bp, Homo sapiens
  misc_feature: GYAE6OF01BYAKI.38.28.C06.1.454.CMB.1.raw
tcagtcgatcacgtcacgaccggtgctcgatttagagctcacgtattgggtttgggctgagctggtctttttcttgtggcttagttttaaaacggtgtccagtgtgaggtgctaggtgtcggagttcgtggggggagcgttggttcaggccgtggggggtcccctggagtaccttcctcctggtgctagtcctagtagtaatttaacctttagtctactatcgacctagtcgacgttccggtcgggtccccgccgacgggtcccgtacccggaaggggggtacgggtacgtggggtaaggttcgggtacctacgacggtacgttaaagtttaaggttacgggggttagggggtacttaccgttaacctaccgtaactttacgttacgacgtaccggtaccggtccggggttacggggtcccgtttaccaccgtactccaaccgaagaccgaacaccgtaccgaggaccacactaatatataccaagtactcgaccacgacgtcgtaagagtacggtacggaacgaccgggtaccgggttacgttagttaacgttttacggtcggttaacgaccgggtaacaaccggttaaccgttaaccccgggaacggttacccgtaccccggtttaggttccgggtttacgttttaccgttttacggtagtttacccggtacgggtaaccggtaccgggtaaacggttaccgtacggtcccggttaaccgttaccccgttcttaccggttcccgaacccgttaccccgaacccgggaaccccggtaccggtcccccgttacccggtttacccccggtttaccccgcccccgggtcgtacccccggttccctccggttccccgttaaccgggacgtaacccccgccgtaaccccggaacgtacgtaccccg

SEQ ID NO: 204342 - DNA, 881 bp, Homo sapiens
  misc_feature: GYAE6OF01CX5SN.38.28.C06.1.454.CMB.1.raw
  modified_base (135)..(135): a, c, t, g, unknown or other
  misc_feature (135)..(135): n is a, c, g, or t
  modified_base (148)..(148): a, c, t, g, unknown or other
  misc_feature (148)..(148): n is a, c, g, or t
  modified_base (467)..(467): a, c, t, g, unknown or other
  misc_feature (467)..(467): n is a, c, g, or t
tcagtcgatcacgtcacgaccggtgctcgatttagagctcacgtattgggtttgggctgagctggtctttttcttgtggcttaattttaaaaggtgtccagtgtgaggtgcgaggtgtcggagttcggtgggggnggtcgttggttcnggccggtcgggggtccctgacgtcctctccgtggtgctagtcgttcgtaggttaactttaaccgtttagtacgtacttagcgtaccgtatcggtacgttcggtaccggtccgaccggacggccggtacgggaaggggacgggtcggtagggtaggtcggtaccgtagacgttaagtaaggttaggttggggtaggtacttactactactagtacgtacgacgtacggtccgggtccggggttcgggtccgtaccacgtacacgaacgagacaacaccgtaggagacactaacacgttaacgtaacttaacaaacgaacnccgtaacgccgtaagtaccgagggtaccggtactaacggggaccgtacggtaaccggttgtttaatttgttacgggttgacgacggaacgtaaccgtacccggttaacgtacggggttaccctaacgggttttcggttcgggtttacctttaggtttaccgttacggtttccggaacggtttacggaaccgggtaaggtcgttaacgggtcccgtttaaccgaccggttttcctaaccgtaccggtacccgtaacccgtaacccggtacccgggtaccctttccggtaccccgggttttcccccttaccccgggtaccccggttcccggacccggtcccccggtttaaccgaccccgggtttaaccgacccggttaccccgaacccgttacccggccgggaaacgttccccggg

SEQ ID NO: 204343 - DNA, 750 bp, Homo sapiens
  misc_feature: GYAE6OF01EOSWF.38.28.C06.1.454.CMB.1.raw
  modified_base (273)..(273): a, c, t, g, unknown or other
  misc_feature (273)..(273): n is a, c, g, or t
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagccgtggggggtccctgagactctcctgtgcagtctctggatttaacctttagtgactatgccatgatcgtgggtcccgccaggctccgaggggaaggggctggagtggtctcagcaagttagtgggtagggtnattcacatatacgcagacgtccggtgggggccgttcaccatcaccagacgacaactccgaggacgacaacactatactactaacaaatgacacgacgcctagaagacgtacggaaggaccgtaccgggtccgttagttagtttagttggtcgacggagaacgtaccgtaccccggtaacgggtaccgtacccgttaccgtttgggttccgtttcgtttttagtacgtttttcgtacgggtaccggaaccgtaaaggggtaacctaagggttccggttacccgtacccggttccgtttaccgtttacccgacccgtaccccgtacccggtaaccccgtaaccggggtacccccttaaccggtttcccccggtttccccgtttacccccccggtcgggcccccttacccccggttcggtacccccttaccggaacccgggtaccgtacccccgtaccccggttccggaacggaacccgg

SEQ ID NO: 204344 - DNA, 781 bp, Homo sapiens
  misc_feature: GYAE6OF01D5SIS.38.28.C06.1.454.CMB.1.raw
tcagtcgatcacgtcacgaccggtgctcgatttagagctcacgtattgggtttgggctgagctggcttttctgtggctatttaaaaggtgtccagtgtgaggtgcaggtgtcggagtctgggggagcttggtcagccgtgggggtccctgagactctcctgtgcagtctcgtgaacttaaccttagtgtactatgactagtgacttcgtcgggtaccgccgaaggtctaccggaaggggaacggggtctagggaggttcgggtctacgagtactaaagttaaggtgggtaggggtctacttacgaacctagttaactacgacgaacgtaccgtccggggtagggggtcccttacaacctactacgaaccgaaggaacaaccgtaacgtccgaaggtacgacctaactaacgttaactactaactaacgtaaaatcgaacctacgacgtaccgagtaacgacggtcgtaaacggacgacccggtaggttataagttacgttggacgtaacggtaacgaacgtaccgtaacccgtaagggtccaaacgttaccgttggttaacgttccttttagagtttcggaggtaaccgaaggtaacgtacgtaacgttcgggtacctaaaccccggttcttaaccgttaacaccggtttcccccgaacgttaaacccgggaagtcccgtaaccgtacccccgtttacccgtccccgtgggaacccctccggttacgaccggttaaaccggcggaccttaacccggtaccctaaggggaaaccgtacccgg

SEQ ID NO: 204345 - DNA, 630 bp, Homo sapiens
  misc_feature: GYAE6OF01DHP6C.38.28.C06.1.454.CMB.1.raw
  modified_base (522)..(522): a, c, t, g, unknown or other
  misc_feature (522)..(522): n is a, c, g, or t
  modified_base (531)..(531): a, c, t, g, unknown or other
  misc_feature (531)..(531): n is a, c, g, or t
  modified_base (534)..(534): a, c, t, g, unknown or other
  misc_feature (534)..(534): n is a, c, g, or t
  modified_base (542)..(542): a, c, t, g, unknown or other
  misc_feature (542)..(542): n is a, c, g, or t
  modified_base (544)..(545): a, c, t, g, unknown or other
  misc_feature (544)..(545): n is a, c, g, or t
  modified_base (560)..(560): a, c, t, g, unknown or other
  misc_feature (560)..(560): n is a, c, g, or t
  modified_base (565)..(565): a, c, t, g, unknown or other
  misc_feature (565)..(565): n is a, c, g, or t
  modified_base (577)..(577): a, c, t, g, unknown or other
  misc_feature (577)..(577): n is a, c, g, or t
  modified_base (579)..(579): a, c, t, g, unknown or other
  misc_feature (579)..(579): n is a, c, g, or t
  modified_base (584)..(584): a, c, t, g, unknown or other
  misc_feature (584)..(584): n is a, c, g, or t
  modified_base (588)..(588): a, c, t, g, unknown or other
  misc_feature (588)..(588): n is a, c, g, or t
  modified_base (593)..(593): a, c, t, g, unknown or other
  misc_feature (593)..(593): n is a, c, g, or t
  modified_base (602)..(603): a, c, t, g, unknown or other
  misc_feature (602)..(603): n is a, c, g, or t
tcagtcgatcacgtcacgaccggtgctcgatttagagctcacgtattgggtttgggtgccgaagttgctggaggtcacggttcaccatcaccagagacaactccaggagcacactatatctaacaatgcacagcctgagagtcggaggaccacggtccgttagtttatttagttgtcggcgaagacgtacttacccgaaggttcacctacgttttggtcgttctttttgattttcgtggtcggaaccgaagggacctaaggtcggtacctaccgtctctcaccgcctaccaccgacggcctacgtcccggttccctcccgtggcccgtcctcgccgtccgaacggcctaccctacccggtacgaacggaccgtacgaccggcggtcccggggtcccttggggaccctttcggaaccgtttgggtaacccgtaaggttccccttacggttaccgaggttcgacttacggacgtcgggacggggttccgggcgaacggaacgggtcaccggtaatacgggtctnacgcggtanagngtacgcgntnngcagcactcgtacgntgtgngctcgcgctcgngngtcgntcantacgngtacgtacnnactacgattcgcgtacagtcgtgtgtg

SEQ ID NO: 204346 - DNA, 840 bp, Homo sapiens
  misc_feature: GYAE6OF01D6GWF.38.28.C06.1.454.CMB.1.raw
  modified_base (185)..(185): a, c, t, g, unknown or other
  misc_feature (185)..(185): n is a, c, g, or t
tcagtcgatcacgtcacgaccggtgctcgatttagagctcacgtattgggtttggggtctgagagaggagcccagccctgggattttcaggcgttttcatttaggtgatcgaggactgaacagagagaactcaccatggtagtttggactgagctggtctttttcttgtggctattttaaaaggngtccagtgtgaggtgcaggtgtcggagtcgtgggggacgtcgttggttcagtccggtcgggggtccctggacgtacctctccgtgtgcgagtcgtgttaggtaacgtttaacctttagtacgtacgtacgtcgaccgtaatgagttccgacgggttcccgccgtacggtccgtaccggaggggtaacggggacgtgggtaacggttgggtccttacgacgtacgtaaaggttaggtacgggtagggtcgtacttacaacccgtagttaagtttaccgacgtaccgtaccggttcccgggcggggggttacccgttaacgtacccggtaactaccgtaaccggtaacggaacgtaaacctaaccgtaccggaacgggaactaaccccgtaaccgttaaacctttaaggttaacctttaaaccgtaaacggtaaaacccttcggaacccgacgtaacccgggtaccgttaagggaacgaaccgggttacggaaacgggaccgttaacccggtcgttaacgtttcgttaagtttaccgggtaccggacggtaaacggtaacggtaaccccgttaaccgggtaaccgggtcccgtaaacggttaccccgttttggttaacggtttccgttttttaggacccgtttttcggtaaccgggg

SEQ ID NO: 204347 - DNA, 743 bp, Homo sapiens
  misc_feature: GYAE6OF01C5BN0.38.28.C06.1.454.CMB.1.raw
  modified_base (288)..(288): a, c, t, g, unknown or other
  misc_feature (288)..(288): n is a, c, g, or t
  modified_base (304)..(304): a, c, t, g, unknown or other
  misc_feature (304)..(304): n is a, c, g, or t
  modified_base (331)..(331): a, c, t, g, unknown or other
  misc_feature (331)..(331): n is a, c, g, or t
tcagtcgatcacgtcacgaccggtgctcgatttagagctcacgtattgggtttgggctgagctggctttttcttgtggctattttaaaaggtgtccagtgtgaggtgcaggtgtcggagtctggggggaggcttggttcagcctggggggtccctgagctctcctgtgcagtctctggtattaacctttagtgactatgccatgatcgtgggtcccgccgtaggcctaccgagggggaacggggctgggaggttcgggtctcgagctaagttaagtggggtaggggtnattcaactataatacngagacgtccggtgggggccgtcaccanccacagacgacaacgccgaggacacaactactaatacgtactaacaatcgacaacgacgaccgtaggaacgtacgtacggaacggtaccgaccggggttccgttaaggttagtttagtcggttacggaccggtaagacgtaaccgttaccccgtaaacggggtacctaacccgttaccggtttagggttcggttttaccgtttttaggttaccgttttcggtacgggttaccggtaaccggaaacgggtaccgttaacggttccgggttacctacccggttcttacccttaccgaccgtacccctaccgaacccgtaccggccctacgttcccggttcccctcccccggtgaccccgtccgtcccgtccgtacccggacggtaccgtacccgaccgtcccggacggtacccg

SEQ ID NO: 204348 - DNA, 641 bp, Homo sapiens
  misc_feature: GYAE6OF01BF2J4.38.28.C06.1.454.CMB.1.raw
  modified_base (269)..(269): a, c, t, g, unknown or other
  misc_feature (269)..(269): n is a, c, g, or t
  modified_base (311)..(311): a, c, t, g, unknown or other
  misc_feature (311)..(311): n is a, c, g, or t
  modified_base (338)..(338): a, c, t, g, unknown or other
  misc_feature (338)..(338): n is a, c, g, or t
  modified_base (359)..(359): a, c, t, g, unknown or other
  misc_feature (359)..(359): n is a, c, g, or t
  modified_base (563)..(563): a, c, t, g, unknown or other
  misc_feature (563)..(563): n is a, c, g, or t
tcagtcgatcacgtcacgaccggtgctcgatttagagctcacgtattgggtttgggctgagctggcttttcttgtggctattttaaaaggtgtccagtgtgaggtgcaggtgtcggagtctggggggaggcttggttcagcctgggggggtccctgagactctcctgtgcagtctctggattaacctttagtgactatgccatgatctgggtccgccaggctcaggggaaggggctggagtgggtctcagcaattaagtggtaggggtnattcaccatattacgcagactccggtggggggccgttcaccntcaccagagacaactccaggagcaacnctatatctaacaaatgacacngccctgagagtcgaggacacgggcctgtattattggtgcgagagactacccaaacggtcgacctaccgtttggtcgttcttttaggatttctggtacggtaccgaagggtaaccgaagtcggttaccaccggttcttccttacgacgtccctacccgaccaacggggtccccctaaggttccccggttacccgtttccccccgnggggaccccttcccccgtacgggttcccctccggtaacggggaccgtacccaacccccggttcccggaaggtacccgg

SEQ ID NO: 204349 - DNA, 807 bp, Homo sapiens
  misc_feature: GYAE6OF01DBE1N.38.28.C06.1.454.CMB.1.raw
  modified_base (472)..(472): a, c, t, g, unknown or other
  misc_feature (472)..(472): n is a, c, g, or t
  modified_base (544)..(544): a, c, t, g, unknown or other
  misc_feature (544)..(544): n is a, c, g, or t
  modified_base (554)..(554): a, c, t, g, unknown or other
  misc_feature (554)..(554): n is a, c, g, or t
  modified_base (561)..(561): a, c, t, g, unknown or other
  misc_feature (561)..(561): n is a, c, g, or t
tcagtcgatcacgtcacgaccggtgctcgatttagagctcacgtattgggtttgggctgagctggctttttctgtggctattttaaaaggtgtccagtgtgaggtgcaggtgtcggagtcgtgggggagtcttggttcagtccgtggggggtccctggagactctcctgtgcgtagtctcgtaggtaacttttaaccgtttagtcgtactagtcgacctatgtactcggtcgggtccgaccgaggtcctaccgggagggggtaaggggtcgtagggtacgggttcgggtactccgtaagaccttaaaaggtttaggggtagggggttaggggtctaacttaccaaccgttaagttacgtaaccggtacgtaaccggttaccggttccggggggttccgggggtacccgttaccccaactaaccgaccgaaccgaagtaaccaacaccgtcgaacggacgaaccaacacttanaccgtaactaagaactcgactacgacgtaccgtagacggtaggaccggacggtacgaaccggtcgtttagtnttacgttggngacgganacgtaacgcccgtaacgggtacctaccgttcgttaggttctttctttgttacgtttcgagggtactaacccggaagtaccgtaaggttccgaccgttacccgttaacttcgtaacccgtaccgttcccgaacctaacccgggtacaccccggttaccgtcccgttacccccggtcccggtcccgtacccggtccctcccggtacccgtccggaacgtccccgaacggcccgttaaggaccggtccg

SEQ ID NO: 204350 - DNA, 950 bp, Homo sapiens
  misc_feature: GYAE6OF01CJ1D9.38.28.C06.1.454.CMB.1.raw
  modified_base (135)..(135): a, c, t, g, unknown or other
  misc_feature (135)..(135): n is a, c, g, or t
  modified_base (170)..(170): a, c, t, g, unknown or other
  misc_feature (170)..(170): n is a, c, g, or t
  modified_base (444)..(444): a, c, t, g, unknown or other
  misc_feature (444)..(444): n is a, c, g, or t
  modified_base (777)..(777): a, c, t, g, unknown or other
  misc_feature (777)..(777): n is a, c, g, or t
  modified_base (784)..(784): a, c, t, g, unknown or other
  misc_feature (784)..(784): n is a, c, g, or t
  modified_base (802)..(802): a, c, t, g, unknown or other
  misc_feature (802)..(802): n is a, c, g, or t
  modified_base (932)..(932): a, c, t, g, unknown or other
  misc_feature (932)..(932): n is a, c, g, or t
tcagtcgatcacgtcacgaccggtgctcgatttagagctcacgtattgggtttggggtctgagagaggacgcccagcccgtgggtattttcaggtcgttttctagttttggtgatcgaggtactagaacagaganaactcaaccgtaggtgggtaggtttcgggctaggngtcgttggtttcttttcgttggtaggttacttaaagttttaaaggtcgtcgtaggttggtaggtagggtgacggtcgggttaggtaccgggtgggtcggggttaggggggacggtttccggtttcgggttaccgaccggggttcccggggttccggggggtttcccctagggtaaccgtcccggttcccgttccgtaggtgtaaccgtacggtttccgttacggttaacggtttaacttttaacccggttagtccgttaagtacgttacccgtnttacggttaccggtacggttccgggtccccggggaccccgttaacgggaccggtacccgggttacccggggaaagggggggtttaccgggtaacgggttaggggtcgggtttaccgggtccgttaacgaacgggtttaaacttagggttaagggttagggggtacggttaacgtacgttacccgtaaaacgttacttaaccgtaacggtcccgtacggggttacccggggtcgggggttacccggtacgtccgtaaacgcccgtacgtaaaccgcggtaaacacctaccggacggtaacgactaccaacttaacgtatctaaacaaagacctnaaccggnttaacccgacggttaagngtaaccgggaggtaaccgtacgggtccttagggtagttaccgttggttaacggcggtaacgaacggtacccgttagaccccggtttacgaacccggtttcgttaccgggtttcgtcggtttaccgttttntgggttccggtaaacggg

SEQ ID NO: 204351 - DNA, 830 bp, Homo sapiens
  misc_feature: GYAE6OF01DZF1W.38.28.C06.1.454.CMB.1.raw
tcagtcgatcacgtcacgaccggtgctcgatttagagctcacgtattgggtttggggtctgagagaggagcccagccctgggtattttcaggtcgttttcatttggtgatcgaggactagaacagagagaactcaacagtggtaggtttgggctggagtcgttggttccttttttcgttggtggtactttaaagtttttaaaaggtcgtaccgtagttggtggaggtgcgtaggttggtacggtaggtcgggtgggggtacggtcgtttggttacgacgggtcccgggttacgggggttccctggacgtaccttcctaccgtgtcgtaccgtacgttctacgttacggttaacttttaaccgtttagttacgtacttatcgtactagtacgtagtccggtccggtaccggaccgacggtaccgtacgggaacggggtacgggtcggtagggtacggtcggttactacgacggtacgttaaaaggttagggtaggggttaagggttacgtacttaaccgaacgttacgttaacgtacgaccgtaaccggttacgggtcccggggtacggggtaccctacgacctacgtaccgagaacgtacaacgtaccgtacgagacgactaagtacttaactactaacctaacgaacgtcaactacgtactcggaagtacggacggtacgacgtacggtaccgtagttagttagtttacgtggtaacgacgggaacgtccggtaaaccgtacccggtaaaccgggttccgttaaacccggtttccggtttacggtttaccgttttaacgttttacggtttccctttacggggtaaccgg

SEQ ID NO: 204352 - DNA, 819 bp, Homo sapiens
  misc_feature: GYAE6OF01CT2VT.38.28.C06.1.454.CMB.1.raw
tcagtcgatcacgtcacgaccggtgctcgatttagagctcacgtattgggtttggggtctgagagaggagcccagccctgggattttcaggcgttttcatttggtgatcaggactgaacagagagaactcaccagtggaggtttgggctgagctggtcttttttctgtggtctaattttaaaaggtgtccagtgtgaggtgcgaggtgtcgggagtcgtgggggaggtcttggttcaggccgtcgggggtccctgacgactctcctgtgcagtctcgtaggtattaaccgtttagtgactatcgcctagtacgagtcgtcgggtcccgccgacggtctaccggaaggggaacggggtcgtaggggtaggttacgggtccttacgaacgtacgtaaagttttaaaggttaggggttaacgggggttagtaacgtttacccgaaaccttaacgtttaacgttaacccggtacgtaaccggtaccggttccgggggttacggggggtccccggtttaccgacccgtaaccgttacaacccgtaacggaacgtaacccgtaaccgtaccgaacgggacgtaccgaaaccgtacttaacgttaaacctacgttaaaccgtaaacgtcgaaccgaacgtacgtccgtaaggaaggtacgtaacgggacggaacggtaccgggttacgttagtttaagtttaacggtttggacggtacggtacggtaaacgttaccccgaacccgggttaaggtaacccggtaaccccgttaccgtttacgggtttactttacggtttttacgttacggttttccggtaaacgggg

SEQ ID NO: 204353 - DNA, 755 bp, Homo sapiens
  misc_feature: GYAE6OF01BFDVR.38.28.C06.1.454.CMB.1.raw
  modified_base (209)..(209): a, c, t, g, unknown or other
  misc_feature (209)..(209): n is a, c, g, or t
  modified_base (718)..(718): a, c, t, g, unknown or other
  misc_feature (718)..(718): n is a, c, g, or t
tcagtcgatcacgtcacgaccggtgctcgatttagagctcacgtattggggtttgggctgagcgtggtctttttctgtggctattttaaaaggtgtccagtgtgaggtgcagggtgtcggagtcgtggggggagtcttggtcaggtccgtggggggtccctagagactctcctggtcgctagtctctggtaatttaacctttgcacttncgcagtgactcgtcgggtccgcgacggcctccggagggggaacgggcgtgggtgttcgggtctccgagtaacttaagttaggtagggggtacgggtagtacttacgaacctattacgtaaccgacgaacggtaccggtaccggggtccggggggtcccgttaccaacctacgtaccaacgaacgtacggaacctaaccggacgaaggacaccactaacttactaactaacctaacaacggtcacaccgagtacgtacggaaggtcggtacggaacggacgtacgggtccgttagttaacttagtcggaccgtaggagtaccgtaccgtaaccgtaacgggtacccgaaccgttcggttacgtagtttcgtttacgtcgtttacgtcggtacggtaccggtaacgggtactacggtccgttacctaaccggttcctaccgtacccgtccgaccccgtacgtaaccgaccggttccctaccggttccctcccggtccccgcggttaccccncgtccgccgtacgaccgccaccgccgtcaccggaccg

SEQ ID NO: 204354 - DNA, 837 bp, Homo sapiens
  misc_feature: GYAE6OF01ENT9R.38.28.C06.1.454.CMB.1.raw
tcagtcgatcacgtcacgaccggtgctcgatttagagctcacgtattgggtttgggctgagctggtctttttcttgtggctattttaaaaggtgtccagtgtgaggtgcagggtggtcggagtcgtggggggaggtcttgggttcaggccgtggggggtccctggacgacctctcctggtgcagtctgtggtaactttaaacctttagtgtactagtcgaccatgtatccgtcgggtcccgaccgacggaccgtaccggaagggggaacggggtcgtagggtaggttgggtacctacgagactaaagttaaggtaggggtagggtatacttacaaccgtattaacgtacgacacggtacgtccggggtcgggggtacccgtaccaccgtactaccgaaccgagtaacgaaccgtacgtaccggaggaccgacctaactaccttaagttaacctacgtaaacaaacgtcgaacctaacgacggtcccgttaaggaaccggttaggtaaccggacggtaaaccggtccggggttacgtttaagttaacttttaggttgggtaacggtacggtaacgtaacggtaccgtaacccggtaacgggtaaccgtacccgttaaccggttggttacggtttcttttagttacgtttcggtacgggtaccggtaacggtaacggtacgtaacgtacggttacctacccgttccttaccgttccgacccgtaccctaccccgtaaccggccggtacccctacggttcccgttcccccgttacccggtcgtccccgttccctccgtacccttacccggcgacccgtacccgccggtaccgaggtaccc

SEQ ID NO: 204355 - DNA, 794 bp, Homo sapiens
  misc_feature: GYAE6OF01A25BC.38.28.C06.1.454.CMB.1.raw
tcagtcgatcacgtcacgaccggtgctcgatttagagctcacgtattgggtttgggctgagctggctttttcttgtggctattttaaaaggtgtccagtgtgaggtgcaggtgtcggagtcgtgggggaggcttggttcaggccgtggggggtcccctgagactctcctgtgcagtctctggtatttaacctttagtgactagtgccatgatcgtcgggtcccgccgaggcctccgaagggggaagggctagggaggtcggtcctcagtactaagttaagtggggtaaggggtctattcacctatagtacgcacgaccgtcggggtcggggccgttcaccactccaccagacgaacaccgtcgaggacgccacgactaatactactaacgaatgactacgacgccgtagacggtacgtacggacggaaccgtaccgggtacgttacgttagtttacgttaggtacggacgtaacggacgttaaccgtaccccgggtaaccggttacgtaaccctaccggtttgggttaccgtttagtttttaccgtcgttttacggtcgggttaccggaacccggtaaaggggtaacccttaggtacccgggttccctaaccgttccccgtttccgttaccgacttcccccgtacccgtaaacccggtaaccccggccccgtaccgtttccccgggtttaccccccttcccccgggtcccgggtcccccttccccggtccccggtacccgaccccgggtaccggtcccacccccggttaccccggtaacccgtacggaaccccg

SEQ ID NO: 204356 - DNA, 685 bp, Homo sapiens
  misc_feature: GYAE6OF01BWJYS.38.28.C06.1.454.CMB.1.raw
tcagtcgatcacgtcacgaccggtgctcgatttagagctcacgtattgggtttggggtgccgaagttgctggaggtcacggttcaccgatcaccaggacgacaactccaggagcgacactatatctacaaatgcacagcctgagagtcgaggacacggccgtgtattatgtcgcgagacgactcccaacggtgacccaccgtttgggtgacctttttgattttctggtggcccaaaggggtacaagttcgggtaccacccggttacttcttacgacgtcccttaccaaccgaaggggcccctaagtccggttccttaccccccgtaggcccggaccccgtcgaccttcccgagggtacgtccacccgttccggaggacgccaccgtacggccgggtccccgtggggaccgtcggcccgttagggtaccgaaacgggtaccttaaccgttccgacggttcggtacgtccggtacgttggaacgggtccgggtacttacggggaccgtaacgggaccgaccgtaatacgggactagcgtagacgtacagtatagtctactgttacactagtcgatagtactatcctcggtaagccgacggacacgtaacgtaacgtacgtagtacgtagtacgacgtacgacgtacgtacgtcgtctacgtcgtacgtacctcgtcgtctgtcgacg

SEQ ID NO: 204357 - DNA, 798 bp, Homo sapiens
  misc_feature: GYAE6OF01DOYCK.38.28.C06.1.454.CMB.1.raw
  modified_base (283)..(283): a, c, t, g, unknown or other
  misc_feature (283)..(283): n is a, c, g, or t
  modified_base (316)..(316): a, c, t, g, unknown or other
  misc_feature (316)..(316): n is a, c, g, or t
  modified_base (473)..(473): a, c, t, g, unknown or other
  misc_feature (473)..(473): n is a, c, g, or t
tcagtcgatcacgtcacgaccggtgctcgatttagagctcacgtattgggtttgggctgagctggtctttttcttgtggctaattttaaaaggtgtccagtgtgaggtgcaggtgtcggagtcgtgggggagtcttggtcaggccgtgggggtccctgagactctctgtgctagtctgtaggtaactttaaccgtttgagtactatcgacctagtgtactcggtcgggtcccgcgtacggccgtaccgggaaggggacgggtcgtgggtacggttcgggtacncgagtaacgtaaagttagggtaggggtagggtntactaccactaagttacgttaccgagtaccggtaccgggttccgggggcgggggtacccgtaaccaccgtacgaccgtaccgaagaccgtaaccaacgtccgaaggaccacgactactaacgtaactaccgtaaaactagacacgtacgacgtacgnggtaaacggcggtaacggacgtaaccggacggttaccgttaagttagttcgtgaacggagtacgaaacgtacccgtacggtaaccggtaccgtaccgttaccggttggttactttcggttacgtttaccgttggtacgggtcgaaacggaacggttaacctacggttcccgttaccgtacccgtttcgtttaacccccgtccgtacccgaacccgaaccggtacccggtccctaccggttccccgtcccgttccccgggcgacccggttccaccggggtccctaaaccgggcggtaaccccacccgtccggaaggtacctacccg

SEQ ID NO: 204358 - DNA, 716 bp, Homo sapiens
  misc_feature: GYAE6OF01D0QSN.38.28.C06.1.454.CMB.1.raw
  modified_base (189)..(189): a, c, t, g, unknown or other
  misc_feature (189)..(189): n is a, c, g, or t
  modified_base (452)..(452): a, c, t, g, unknown or other
  misc_feature (452)..(452): n is a, c, g, or t
  modified_base (696)..(696): a, c, t, g, unknown or other
  misc_feature (696)..(696): n is a, c, g, or t
tcagtcgatcacgtcacgaccggtgctcgatttagagctcacgtattgggtttggggtctgagagaggagcccagccctgggattttcaggtcgttttcatttggtgatcaggactgaacagagagaactcaccagtggtagtttgggctgagtctggtctttttctgtggtcttaattttaaaaggtntccagtgtgaggtgcgaggtgtcggagtcgtgggggagtcgttggtcgtaggtccggtcgggggtccctggacgtacgttcctccgtggttcgcgtagtccgtacgtaggttaacttttaaacgtttgtacgtaactagtcgtacctagtacgtacgttccggtacgggttcccacggacggtaccggtaccggaaggggtaacgggggtctaggggtacggttcggtactacgaagtagtaaacgttaggtagggtagggtntaacgttacaacgtaatacgtacgacgaagtaccgtcgggtcggggtacctacacgtactaccgacgtaacgaacgaaccacgtaccgaagacgaatactaactagtaactaacaacgtaactcgactaacgacgtccgtaaggacgtacggtaacggaagtaccgtacggtacgttagttaacgttagtgtaggacgaagtaaccgtacaccggaagtaccgtaccgttacggttgtactttnttacgttagttccggtaagg

SEQ ID NO: 204359 - DNA, 425 bp, Homo sapiens
  misc_feature: GYAE6OF02IZLDQ.38.28.C06.1.454.CMB.1.raw
  modified_base (305)..(305): a, c, t, g, unknown or other
  misc_feature (305)..(305): n is a, c, g, or t
  modified_base (394)..(425): a, c, t, g, unknown or other
  misc_feature (394)..(425): n is a, c, g, or t
tcagtcgatcacgtcacgaccggtgctcgatttagagctcacgtattggggtttgggtgccgaaggttgctggacggtcacggttcaccatcacccagtagacaactccaggagcacactatatctacaaatgcacagcctgtaggagtcgaggacacgggtcccgtgttattattgttagcggagagatccccaacggtgaccaccttggtgcgttttggatttctggtggccaagggcaatggtcgaccgtctctcagcctcaccagggcccatcggtcttcccctggcgccctgctccaggngcacctccggagcggcacaggcggccgtgggctgccgtggtcaaggctactccagtgatcgactgagcgggctggcaaggcgcagtagnnnnnnnnnnnnnnnnnnnnnnnnnnnnnnnn

SEQ ID NO: 204360 - DNA, 174 bp, Homo sapiens
  misc_feature: GYAE6OF02H8AAZ.38.28.C06.1.454.CMB.1.raw
  modified_base (174)..(174): a, c, t, g, unknown or other
  misc_feature (174)..(174): n is a, c, g, or t
tcagtcgatcacgtcacgaccggtgctcgatttagagctcacgtattgggtttgggggaagaggaagactgacggtcctgctccaggagcacctccgagagcacagcggccctgggctgcctggtcaaggactacttccacgtgatcgctgagcgggctggcaaggcgcatagn

SEQ ID NO: 204361 - DNA, 184 bp, Homo sapiens; identical to SEQ ID NO: 204207
  misc_feature: GYAE6OF02FQNMI.38.28.C06.1.454.CMB.1.raw
  modified_base (175)..(184): a, c, t, g, unknown or other
  misc_feature (175)..(184): n is a, c, g, or t

SEQ ID NO: 204362 - DNA, 615 bp, Homo sapiens
  misc_feature: GYAE6OF02G0ES2.38.28.C06.1.454.CMB.1.raw
  modified_base (217)..(217): a, c, t, g, unknown or other
  misc_feature (217)..(217): n is a, c, g, or t
  modified_base (273)..(273): a, c, t, g, unknown or other
  misc_feature (273)..(273): n is a, c, g, or t
  modified_base (336)..(336): a, c, t, g, unknown or other
  misc_feature (336)..(336): n is a, c, g, or t
tcagtcgatcacgtcacgaccggtgctcgatttagagctcacgtattgggtttgggctgagcgtgtcgtttctaggtggctaattttaaaaggtgtccagtgtgaggtgcaggtgtcggagtctgggggaggcttggttcagcctggggggtccctgagactctcctgtgcagtctctggatttaacctttagtgactatgccatgatctgggtccnccaggctccaggggaagggctgggagtgggtctcagctaattaagtgggtagggtnattcaccatattacgcagactccggtgggggccgttcaccatcaccagagacaactccaggancacactatatctaacaaatgacacagcctgagagtcgaagacacggccgtgtattattgtgcgagagactacccgaacggtgaccctacgttgggtcgtcgttttgacttttcgtgttggaccgaagggactaaagttcggtacacccgttctctttcgaacgtccctaccgaaccgtaacgggcccctagttccgggttccccttccccccggtgggtcccgcccctttcgcccgttacccgaacgggaccgtacccaaccccgttccggacgaacgg

SEQ ID NO: 204363 - DNA, 574 bp, Homo sapiens
  misc_feature: GYAE6OF02GIGMG.38.28.C06.1.454.CMB.1.raw
  modified_base (268)..(268): a, c, t, g, unknown or other
  misc_feature (268)..(268): n is a, c, g, or t
  modified_base (332)..(332): a, c, t, g, unknown or other
  misc_feature (332)..(332): n is a, c, g, or t
  modified_base (414)..(414): a, c, t, g, unknown or other
  misc_feature (414)..(414): n is a, c, g, or t
  modified_base (557)..(557): a, c, t, g, unknown or other
  misc_feature (557)..(557): n is a, c, g, or t
tcagtcgatcacgtcacgaccggtgctcgatttagagctcacgtattgggtttgggctgagcgtgcgtttctaggtggctatttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccgagggaaggggctggagtgggtctcagcaattaatgggtaggggtnattcaccatattacgcagactccggtggggggccgttcaccatcaccagagacaactccaggancacactatatctaacaaatgcacagcctgagagtcgaggacacgggccgttgtatttatgtgcgagagactcccgaacggtnacctaccttggtgtcttttgtattttcgtggtggtccgaaagggacaaagttgggtaccaccgttcttccgttcacgtccctccgaaccgaacgggccccagtccggttccttcccccgtggcccgccctgcctccgaggacnccacccgtccgagaccg

SEQ ID NO: 204364 - DNA, 550 bp, Homo sapiens
  misc_feature: GYAE6OF02JGL2U.38.28.C06.1.454.CMB.1.raw
  modified_base (272)..(272): a, c, t, g, unknown or other
  misc_feature (272)..(272): n is a, c, g, or t
  modified_base (427)..(427): a, c, t, g, unknown or other
  misc_feature (427)..(427): n is a, c, g, or t
tcagtcgatcacgtcacgaccggtgctcgatttagagctcacgtattgggtttgggctgagcgtgcgtttctaggtggctaattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccgagggaaggggctgggagtggggtctcagcaattaatgggtaggggtnattcaccatattacgcagactccggtggggggccgttcaccatcaaccagagacaactccaggagcaacactatatctaacaaatgacacagcctgagagtcgaggacacggcctgtattatgtgcgagagatcccgaacggtgaccacgttggntcttttgatttctgttcggccaagggacaagtggtacaccgtctcttcagcctccaccaacgggccctagtccggtccttcccccgtggccgtccctgcctccaggcgccacctccgagaccg

SEQ ID NO: 204365 - DNA, 406 bp, Homo sapiens
  misc_feature: GYAE6OF02FQ23P.38.28.C06.1.454.CMB.1.raw
  modified_base (403)..(406): a, c, t, g, unknown or other
  misc_feature (403)..(406): n is a, c, g, or t
tcagtcgatcacgtcacgaccggtgctcgatttagagctcacgtattgggtttgggctgagctggctttttcttgtggctattttaaaagactccgtgggggccggttcaccatcaccagagacaactccaggagcacactatatctacaaatgcacagcctgagagtcgaggacacggccgtgtattattgtgcgagagatcccaacggtgaccaccttggtgcttttgatttctgtggccaagggacaatggtcaccgtctcttcagcctccaccaagggcccatcggtcttccccctggcgccctgctccaggagcacctccgagagcacagcggccctgggctgcctggtcaaggctacttccacgtgatcgactgagcgggctggcaaggcgcatagnnnn

SEQ ID NO: 204366 - DNA, 799 bp, Homo sapiens
  misc_feature: GYAE6OF02JAARS.38.28.C06.1.454.CMB.1.raw
  modified_base (214)..(214): a, c, t, g, unknown or other
  misc_feature (214)..(214): n is a, c, g, or t
  modified_base (273)..(273): a, c, t, g, unknown or other
  misc_feature (273)..(273): n is a, c, g, or t
  modified_base (344)..(344): a, c, t, g, unknown or other
  misc_feature (344)..(344): n is a, c, g, or t
  modified_base (352)..(352): a, c, t, g, unknown or other
  misc_feature (352)..(352): n is a, c, g, or t
tcagtcgatcacgtcacgaccggtgctcgatttagagctcacgtattgggtttgggctgagcgtggcttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccnccaggctccgaggggaagggctgggagtgggtctcagcaaattaagtgggtagggggtntacttcacctattagttacgcagtaccgtccggggtcgggggtccgtaccaccatccaccgagacgacacncgaggacncaacactatactactaacaatcgacacacgtccgtaggaagacggtacggaacggaaccgaccgggtcgttagttaatttagttggtacgacggaaggacgacgtaccccggtaaacgggtaccgtaacccgtaccggtttgggtcgtttcgtttttacggttacgtttttcggtcgggttaccgggtaacccggtaaaaggggtaaccttaaacggttccgggttacccgttaacccggtttcctttaccgtttaccgtaacccggttcccccttaaacccggaaacccgggtaacccggggtaccccttaccggttttcccccgggtttaccccccgtttccccccgggttacggggtcccccggttacccccgttcccggtacccgttaccccggacggggtaacccgtacccccgtaaccccggttacccgggaacggcccgg

SEQ ID NO: 204367 - DNA, 536 bp, Homo sapiens
  misc_feature: GYAE6OF02GJITZ.38.28.C06.1.454.CMB.1.raw
tcagtcgatcacgtcacgaccggtgctcgatttagagctcacgtattgggtttgggctgagcgtgctttctagtggctatttaaaaggtgtccagtgtgaggtgcaggtgtcggagtctggggggaggcttggttcagcctgggggggtccctgagactctcctgtgcagtctctggattaacctttagtgactatgccatgatctgggtccgccaggctccaggggaaggggctggagtgggtctcagcaattaatgggtaggggtgattcaccatattacgcagactccggtggggggccgttcaccatcaccagagacaactccaggagcacactatatctacaaatgcacagcctgagagtcgaggacacggccgtgtattattgtgcgagagatcccaacggtcgaccaccttggtagtcttttgatttctgtggccaagggacaagtggtcaccgtctcttcagcctccaaccgacgggcccagtccgtccttcccctggccgccctgcctccaggcgcacctcgagacg

SEQ ID NO: 204368 - DNA, 540 bp, Homo sapiens
  misc_feature: GYAE6OF02HW3PV.38.28.C06.1.454.CMB.1.raw
tcagtcgatcacgtcacgaccggtgctcgatttagagctcacgtattgggtttgggctgagcgtgcgtttctaggtggctattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccagggaaggggctggagtgggtctcagcaattaatggtaggggtgattcaccatattacgcagactccggtggggggccgttcaccatcaccagagacaactccaggagcacactatatctacaaatgcacagcctgagagtcgaggacacggccgtgtattattgtgcgagagatcccaaggtgaccacttggtgtcttttgatttctgtgcaagggacaagtggtcaccgtctcttcacgccctcaaccgaagggcccagtccggtccttcccccgtggccgccctgcctccgacggacgccaaccgtccgagacg

SEQ ID NO: 204369 - DNA, 643 bp, Homo sapiens
  misc_feature: GYAE6OF02GUJRR.38.28.C06.1.454.CMB.1.raw
  modified_base (96)..(96): a, c, t, g, unknown or other
  misc_feature (96)..(96): n is a, c, g, or t
  modified_base (339)..(339): a, c, t, g, unknown or other
  misc_feature (339)..(339): n is a, c, g, or t
  modified_base (357)..(357): a, c, t, g, unknown or other
  misc_feature (357)..(357): n is a, c, g, or t
tcagtcgatcacgtcacgaccggtgctcgatttagagctcacgtattgggtttgggctgagcggtgtcgtttctaggtcggctaattttaaaaggngtccagtgtgaggtgcaggtgtcggagtctgggggaggcttggttcagcctggggggtccctgagactctcctgtgcagtctctggatttaacctttagtgactatgccatgatctgggtccgccaggctccagggaaggggctggagtgggtctcagcaattaatgggtagggtgattcaccattattacgcaagtctccggtgggggccgttcaccatcaccagacacaactccgaggacncactactatactactaanaagtcgacacgtacgcgtagagagacggacggacgacggtcgtagttagtttagttgtgacgagacgacgtaccgtacgtacgtaccgtacgttcggttcgttcgtttcgttacgtttcgttcgttcggtacgaacggtacgtagtacgtaccgtaccgttcttccttacgtaccgtcccgtacccgaccgaccggtacccgtaccgttcccgttccccgttccccgttccggtcccgtcccgtccgtccgtccgaccggaccgacccgtacccgtaccgacgacg

SEQ ID NO: 204370 - DNA, 620 bp, Homo sapiens
  misc_feature: GYAE6OF02F1H2Q.38.28.C06.1.454.CMB.1.raw
  modified_base (272)..(272): a, c, t, g, unknown or other
  misc_feature (272)..(272): n is a, c, g, or t
  modified_base (337)..(337): a, c, t, g, unknown or other
  misc_feature (337)..(337): n is a, c, g, or t
  modified_base (435)..(435): a, c, t, g, unknown or other
  misc_feature (435)..(435): n is a, c, g, or t
tcagtcgatcacgtcacgaccggtgctcgatttagagctcacgtattgggtttgggctgagcgtggcgttttcttagtggctaattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccaggggaagggctgggagtgggtctcagcaattaagtggtaggggtnattcaccatattacgcagactccggtggggggccggttcaccatcaccagagacaactccaggancacactatatctaacaaatgacacagcctgagagtcgaggacacgggccgtgtattattgtgcgagagatccccgaaggtcgaacctaccgtttgggngtctttttgattttctggtcggccgaaagggtacaagttcgggtacctacccgttcgttctttaccgacgtacccctacccgaacccgaaggggccccctagttcccggttaccctttccccccgtgggccccgtcccgttcgcccttacccgacgggtaccgccacccgttccggaagtaccgg

SEQ ID NO: 204371 - DNA, 597 bp, Homo sapiens
  misc_feature: GYAE6OF02G70AQ.38.28.C06.1.454.CMB.1.raw
  modified_base (275)..(275): a, c, t, g, unknown or other
  misc_feature (275)..(275): n is a, c, g, or t
  modified_base (341)..(341): a, c, t, g, unknown or other
  misc_feature (341)..(341): n is a, c, g, or t
  modified_base (558)..(558): a, c, t, g, unknown or other
  misc_feature (558)..(558): n is a, c, g, or t
tcagtcgatcacgtcacgaccggtgctcgatttagagctcacgtattgggtttgggctgagcgtgcgtttctaggtggctaattttaaaaggtgtccagtgtgaggtgcaggtgtcggagtctggggggaggcttggttcagcctggggggtccctgagactctcctgtgcagtctctggatttaacctttagtgactatgccatgatctgggtccgccaggctccgaggggaaggggctggagtgggtctcagacaattaagtgggtaggggtnattcacatattacgcagacgtccggtggggggccgttcaccatcaccagagaccaacgtcaggacnctaacactatatctaacaaatgacacacgctgagagtcgaggacacggcttgtatttatgtgcgaagagactcccgaacgggtcgacctaccgttggtacgtcttttgtacttttcgtggtggacccgtaaagggacctaagtcggtccaccggttctccttacgaccgtcctacccaacggaacggccctagtcccgtttacctccccgtggcccncccttgacctccgaggacgtccgtacccgtcgagaccgg

SEQ ID NO: 204372 - DNA, 642 bp, Homo sapiens
  misc_feature: GYAE6OF02F8LBM.38.28.C06.1.454.CMB.1.raw
  modified_base (214)..(214): a, c, t, g, unknown or other
  misc_feature (214)..(214): n is a, c, g, or t
  modified_base (591)..(591): a, c, t, g, unknown or other
  misc_feature (591)..(591): n is a, c, g, or t
tcagtcgatcacgtcacgaccggtgctcgatttagagctcacgtattgggtttgggctgagcgtgcgttttctaggtggctattttaaaaggtgtccagtgtgaggtgcaggtgtcggagtctgggggaggcttggttcagcctggggggtccctgagctctcctgtgcagtctctggattaacctttagtgactatgccatgatctgggtccnccaggctccaggggaaggggctgggagtgggtctcagcaattaagtgggtaggggtgattcaccatattacgcagactcggtggggggccgttcaccatcaccagagacaactccgaggagcacactatactctaacaaatgacaacagcctaggaagagtcggaaggaacctaccgggcccgttagttaatttagtttggtacgacggaaggacgtacttaccccgaaacgggttcgaaccctaccgtttgggtcgtcgttttttgacttttcgtggtcggacccaagggtactaagttcgggtacctaccgttccttacttccgacgtccctaccgaaccgaacgggtcccctagttcccggtcccttcccccgnggtcccgccccttagcccgtaccgaggtaccgcaccccgttccggaagtcg

SEQ ID NO: 204373 - DNA, 529 bp, Homo sapiens
  misc_feature: GYAE6OF02IVP48.38.28.C06.1.454.CMB.1.raw
  modified_base (349)..(349): a, c, t, g, unknown or other
  misc_feature (349)..(349): n is a, c, g, or t
  modified_base (420)..(420): a, c, t, g, unknown or other
  misc_feature (420)..(420): n is a, c, g, or t
tcagtcgatcacgtcacgaccggtgctcgatttagagctcacgtattgggtttggggtctgagagaggagcccagccctgggattttcaggcgttttcatttggtgatcaggactgaacagagagaactcaccatggagtttgggctgagctggctttttctgtggctattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccgaggggaaggggctgggagtgggtctcgagcaattaanggtaggggtgattcaccatattacgcagactcgtggggggccgttcaccatcaccagagacactccaggancacactatatctacaaatgcacagcctgacgagtcgaggacacggccgtgtaatattgtgcgagagtatcccgaaggtcgacctaccgttggtgtcttttgatttctgg

SEQ ID NO: 204374 - DNA, 536 bp, Homo sapiens
  misc_feature: GYAE6OF02F1C5J.38.28.C06.1.454.CMB.1.raw
  modified_base (67)..(67): a, c, t, g, unknown or other
  misc_feature (67)..(67): n is a, c, g, or t
  modified_base (77)..(77): a, c, t, g, unknown or other
  misc_feature (77)..(77): n is a, c, g, or t
  modified_base (91)..(91): a, c, t, g, unknown or other
  misc_feature (91)..(91): n is a, c, g, or t
  modified_base (409)..(409): a, c, t, g, unknown or other
  misc_feature (409)..(409): n is a, c, g, or t
  modified_base (497)..(497): a, c, t, g, unknown or other
  misc_feature (497)..(497): n is a, c, g, or t
  modified_base (521)..(521): a, c, t, g, unknown or other
  misc_feature (521)..(521): n is a, c, g, or t
tcagtcgatcacgtcacgaccggtgctcgatttagagctcacgtattgggtttgggctgagcggtgngtttctaggnggctatttaaaggntcagtgtgaggtgcaggtgtcggagtctgggggaggcttggttcagcctgggggggtccctgagactctcctgtgcagtctctggattaacctttagtgactatgccatgatctgggtccgccaggctccaggggaaggggctggagtgggtctcagcaattaatggtaggggtgattcaccatattacgcagactccggtggggggccgttcaccatcaccagagacaactccaggagcacactatatctaacaaatgcaacagcctgaagagtcgaggacacggccgtgtattatgtgcgagagatcccaagggtnaccaccttggtgcttttgatttctgtggccaagggcaagtggtcaccgtctctcagcctccacacgggcccatccggtccttccccgnggcccgccctgcctccgagggccnccaccgtccgagacg

SEQ ID NO: 204375 - DNA, 571 bp, Homo sapiens
  misc_feature: GYAE6OF02IOTLV.38.28.C06.1.454.CMB.1.raw
  modified_base (331)..(331): a, c, t, g, unknown or other
  misc_feature (331)..(331): n is a, c, g, or t
  modified_base (530)..(530): a, c, t, g, unknown or other
  misc_feature (530)..(530): n is a, c, g, or t
  modified_base (536)..(536): a, c, t, g, unknown or other
  misc_feature (536)..(536): n is a, c, g, or t
  modified_base (555)..(555): a, c, t, g, unknown or other
  misc_feature (555)..(555): n is a, c, g, or t
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccgagggaaggggctggagtgggtctcagcaattaagtgggtaggggtgattcaccatatacgcagactcggtgggggccgttcaccatcaccagagacaactccaggancacactatatctaacaaatgacacagcctgagagtcgagacacggcgtgtattagtgtgcgagagactcccgaaggtcgaccacgttggtgtcgttttgattttcgtggtcggacctaaaggggacctaagtcgggtaccaccggttctccttcacgtccctaccaaccgaacgggccctagtccggtcccttccccgnggcccnccctgcctaccgaggaccnccacccgtccgagacg

SEQ ID NO: 204376 - DNA, 563 bp, Homo sapiens
  misc_feature: GYAE6OF02IFIEW.38.28.C06.1.454.CMB.1.raw
  modified_base (214)..(214): a, c, t, g, unknown or other
  misc_feature (214)..(214): n is a, c, g, or t
  modified_base (425)..(425): a, c, t, g, unknown or other
  misc_feature (425)..(425): n is a, c, g, or t
  modified_base (481)..(481): a, c, t, g, unknown or other
  misc_feature (481)..(481): n is a, c, g, or t
  modified_base (520)..(520): a, c, t, g, unknown or other
  misc_feature (520)..(520): n is a, c, g, or t
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctgcattcacctttagtaactatttaatgagctgggtccncagcctccagggaagggctggagtgggtggccagcattaaccaagatggacgtgaaaaaatactatgtggactctgtgaagggccattcgccatctccagagacaacgccaaagaactcactgtggtgcacatgaacggcctgagaggcaacgacacggtctgtgtacttctgtgcgaagacgtcccccagtgagggctaacgagtggganctaacggactttgaacctagtggggccaagggaaccctggtaccacccgtctcctnacgcctccaaccgaagggcccaatcggtcccttcccccnggccctacccgtccctaccgaagcgcacccgtcgtggggaccc

SEQ ID NO: 204377 - DNA, 580 bp, Homo sapiens
  misc_feature: GYAE6OF02IL7SH.38.28.C06.1.454.CMB.1.raw
  modified_base (66)..(66): a, c, t, g, unknown or other
  misc_feature (66)..(66): n is a, c, g, or t
  modified_base (188)..(188): a, c, t, g, unknown or other
  misc_feature (188)..(188): n is a, c, g, or t
  modified_base (252)..(252): a, c, t, g, unknown or other
  misc_feature (252)..(252): n is a, c, g, or t
  modified_base (262)..(262): a, c, t, g, unknown or other
  misc_feature (262)..(262): n is a, c, g, or t
  modified_base (287)..(287): a, c, t, g, unknown or other
  misc_feature (287)..(287): n is a, c, g, or t
  modified_base (323)..(323): a, c, t, g, unknown or other
  misc_feature (323)..(323): n is a, c, g, or t
  modified_base (337)..(337): a, c, t, g, unknown or other
  misc_feature (337)..(337): n is a, c, g, or t
  modified_base (340)..(340): a, c, t, g, unknown or other
  misc_feature (340)..(340): n is a, c, g, or t
  modified_base (345)..(345): a, c, t, g, unknown or other
  misc_feature (345)..(345): n is a, c, g, or t
tcagtcgatcacgtcacgaccggtgctcgatttagagctcacgtattgggtttgggctgagcgtgngtttctagtggctatttaaaaggtgtccagtgtgaggtgcaggtgtcggagtctgggggagcttggtcagcctggggggtccctgagactctcctgtgcagtctctggatttaacctttagngactatgccatgatctgggccgcaggctcgagggagggctggagtgggtctcagctaattaagngggtagggtnacttcacatattacgcagactcggngggggccttcaccatcacaggacacaactccaaggncacatatatcaaanagncacancagagagagagacgacgtacgtagtatatgtgagagacgacgtaccgaacgtacgtaccgtacgttcgtcgttcgtttgttacgttcgttagtacggtacgaacggaacgtaacgtacgtacgtaccgtacgtctacgtacgtacctaccgaaccgaacgaccgtaccgtaccgtcccgtcccgtccgtccgtccgtccgtccgtaccgacgaccgaccgaccgtaccgacgacg

SEQ ID NO: 204378 - DNA, 559 bp, Homo sapiens
  misc_feature: GYAE6OF02I31OJ.38.28.C06.1.454.CMB.1.raw
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccagggaaggggctggagtggggtctcagcaattaatggtaggggtgattcaccatattacgcagactccggtggggggccggttcaccatcaccagagacaactccaggagcacactatatctacaaatgcacagcctgagagtcgaggacacggccgtgtattattgtgcgagagatcccgaacggtcgaccaccgttggtgtcttttgatttctggtggccaagggacaagtcggtcaccgtctcttcacgtcctccaccgaacggcccagtccggtccttccccgtcggcctaccccttcctacccgaagacgccaaccctccgtggggccacg

SEQ ID NO: 204379 - DNA, 549 bp, Homo sapiens
  misc_feature: GYAE6OF02I8BST.38.28.C06.1.454.CMB.1.raw
  modified_base (428)..(428): a, c, t, g, unknown or other
  misc_feature (428)..(428): n is a, c, g, or t
  modified_base (511)..(511): a, c, t, g, unknown or other
  misc_feature (511)..(511): n is a, c, g, or t
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccatgagactctcctgtgcagtctctggattaacctttagtgactatgccatgatctgggtccgccaggctccagggaaggggctggagtggggtctcagcaattaatggtagggggtgattcaccatattacgcagactccgtggggggccgttcaccatcaccagagacaactccaggagcacactatatctaacaaatgcacagcctgagagtcgaggacacggccgtgtatttattgtgcgagagatcccaaacggtgaacctacctttgggtntcgtttttgattttctggtggccaaagggcaagtggtcaccgtctcttcagcctccaccagggcccagtccggtccttccccnggtccgccctggcctccgaggcgaccacccgtccgacg

SEQ ID NO: 204380 - DNA, 629 bp, Homo sapiens
  misc_feature: GYAE6OF02JRK7R.38.28.C06.1.454.CMB.1.raw
  modified_base (213)..(213): a, c, t, g, unknown or other
  misc_feature (213)..(213): n is a, c, g, or t
  modified_base (254)..(254): a, c, t, g, unknown or other
  misc_feature (254)..(254): n is a, c, g, or t
  modified_base (263)..(263): a, c, t, g, unknown or other
  misc_feature (263)..(263): n is a, c, g, or t
  modified_base (270)..(270): a, c, t, g, unknown or other
  misc_feature (270)..(270): n is a, c, g, or t
  modified_base (278)..(278): a, c, t, g, unknown or other
  misc_feature (278)..(278): n is a, c, g, or t
  modified_base (298)..(298): a, c, t, g, unknown or other
  misc_feature (298)..(298): n is a, c, g, or t
  modified_base (323)..(323): a, c, t, g, unknown or other
  misc_feature (323)..(323): n is a, c, g, or t
  modified_base (347)..(347): a, c, t, g, unknown or other
  misc_feature (347)..(347): n is a, c, g, or t
  modified_base (381)..(381): a, c, t, g, unknown or other
  misc_feature (381)..(381): n is a, c, g, or t
tcagtcgatcacgtcacgaccggtgctcgatttagagctcacgtattgggtttgggcgtgagctggcttttcttgtggctatttaaaggtgtccagtgtgaggtgcaggtgtcggagtctgggggaggcttggttcagcctggggggtccctggagactctcctgtgcagtctctggattaacctttagtgactatgccatgatctgggtccnccaggctccagggagggctgggatgggtctcagcaattaanggtagggtnattcacntattacgnagactcggtggggggccttnaccatcaccagagacaactccaggncacactatatctaacaaatcgcanagcctagagagtcgagacacggcgtgtattatgngcgagagatacccgaggtcacctacttggctcgttttgacttttcgaggttcggacgtaaagggtaccaaagtcgggtaccaccgggttcttccgttacacggtccccttacccgaacccgaacggggtaccccctaggtttcccgggttccccgtttcccccccggttagggccccggtaccccccgttcggtaccccttacccggacgggtaaccgcccgtaacccccgttccggaacggtaccgg

SEQ ID NO: 204381 - DNA, 176 bp, Homo sapiens; identical to SEQ ID NO: 204210
  misc_feature: GYAE6OF02H4ICU.38.28.C06.1.454.CMB.1.raw
  modified_base (175)..(176): a, c, t, g, unknown or other
  misc_feature (175)..(176): n is a, c, g, or t

SEQ ID NO: 204382 - DNA, 561 bp, Homo sapiens
  misc_feature: GYAE6OF02HZ5WY.38.28.C06.1.454.CMB.1.raw
  modified_base (214)..(214): a, c, t, g, unknown or other
  misc_feature (214)..(214): n is a, c, g, or t
  modified_base (307)..(307): a, c, t, g, unknown or other
  misc_feature (307)..(307): n is a, c, g, or t
  modified_base (475)..(475): a, c, t, g, unknown or other
  misc_feature (475)..(475): n is a, c, g, or t
  modified_base (482)..(482): a, c, t, g, unknown or other
  misc_feature (482)..(482): n is a, c, g, or t
  modified_base (520)..(520): a, c, t, g, unknown or other
  misc_feature (520)..(520): n is a, c, g, or t
  modified_base (544)..(544): a, c, t, g, unknown or other
  misc_feature (544)..(544): n is a, c, g, or t
  modified_base (558)..(558): a, c, t, g, unknown or other
  misc_feature (558)..(558): n is a, c, g, or t
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccnccaggctccagggaaggggctggagtgggtctcagcaattaatgggtaggggtgattcaccatattacgcagactccggtggggggcccgttnaccatccaccagagacaactccaggagcacactatatactacaaatgacacagcctgagagtcgaaggacacggccgtagtattagttgtgcgagagactcccaaggtgacctacgttggtgtcttttgattttctggtgccgaagggtacaagttcggtacaccgtntcctcancctcaaccgtaagggcccagttccggtccttcccccgnggcccgccctgccctcgacggacnccgacctcccgganacg

SEQ ID NO: 204383 - DNA, 555 bp, Homo sapiens
  misc_feature: GYAE6OF02JDLHA.38.28.C06.1.454.CMB.1.raw
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccaggggaaggggctggagtgggtctcagcaattaatgggtaggggtgattcaccatattacgcagactccggtgggggccgttcaccatcaccagagacaactccaggagcacactatatctaacaaatgacacagcctgagagtcgaggacacggcctgtattatgtgcgagagatccaacggtgaccaccttggtcgtcttttgatttctgtggaccaagggacaagtggtacaccgtactcttcacgcctccaaccaacgggcccatccggtccttcccccgtggccgtaccccgtgccgtccacgggacgtcccacctacccggagacg

SEQ ID NO: 204384 - DNA, 711 bp, Homo sapiens
  misc_feature: GYAE6OF02GVX3Y.38.28.C06.1.454.CMB.1.raw
  modified_base (277)..(277): a, c, t, g, unknown or other
  misc_feature (277)..(277): n is a, c, g, or t
tcagtcgatcacgtcacgaccggtgctcgatttagagctcacgtattgggtttgggctgagcgtgcgttttctaggtggctattttaaaaggtgtccagtgtgaggtgcaggtgtcggagtctggggggaggcttggttcagcctgggggggtccctgagactctcctgtgcagtctctggattaacctttagtgactatgccatgatctggggtccgccaggctccgaggggaaggggctgggagtgggtctcagcaattaagtgggtagggggtntacttcactatatacgcagacgtcgggtcgggggtccgttcaacctactccaaccgaaggacgtaacctaaaccgtccgaagggacgaccaacctaacttaattaactaccgtaaactaaaactcgaccaacgacgtccgtaggaacggtacggtacggaaggaccgaccgggtaccgttagttaactttagttggtcggacggtaaggaggtacccgtaacccggaacgggtaccgtaacccgtacggtttggtacgttcgttttagtacttttcgtggtacggtacgtaagggtactaagttcggtacctaccgttcttacgtcgacgtccctaccgaaccgacggtccctacgttccggttcccgttccccgtcggccctcccgtcgtacccgtaccggacggtaccgacccgtacccgtaccggagtacg

SEQ ID NO: 204385 - DNA, 686 bp, Homo sapiens
  misc_feature: GYAE6OF02IUY9X.38.28.C06.1.454.CMB.1.raw
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccagggaagggctggagtgggtctcagcaattaatggtaggggtgattcaccatattacgcagactccggtgggggccgttcaccatcaccagagacaactccaggagcacactatatctacaaatgcacagcctgagagtcgaggacacggcctgtattatgtgcgagagactcccgaacggtcgaccctacgtttgggtcgtctttttaggactttttacgtcggttacggacccgtaaaggggtaactaaagttcgggttacctaaccccggtttctttaacccgttccgtaaccggttccccttaccccgtaaacccgtaaaccgggggtaccccctaacgtttccccggggtttaccccttttaccccccccggtgggtaccccgttccccccggttcggtccccttaccccggaagggtacccgccccgtaaccccgttacccgggaaccggaacccgg

SEQ ID NO: 204386 - DNA, 545 bp, Homo sapiens
  misc_feature: GYAE6OF02GBAMB.38.28.C06.1.454.CMB.1.raw
  modified_base (154)..(154): a, c, t, g, unknown or other
  misc_feature (154)..(154): n is a, c, g, or t
  modified_base (172)..(172): a, c, t, g, unknown or other
  misc_feature (172)..(172): n is a, c, g, or t
  modified_base (174)..(177): a, c, t, g, unknown or other
  misc_feature (174)..(177): n is a, c, g, or t
  modified_base (180)..(181): a, c, t, g, unknown or other
  misc_feature (180)..(181): n is a, c, g, or t
  modified_base (183)..(184): a, c, t, g, unknown or other
  misc_feature (183)..(184): n is a, c, g, or t
  modified_base (187)..(188): a, c, t, g, unknown or other
  misc_feature (187)..(188): n is a, c, g, or t
  modified_base (197)..(197): a, c, t, g, unknown or other
  misc_feature (197)..(197): n is a, c, g, or t
  modified_base (215)..(215): a, c, t, g, unknown or other
  misc_feature (215)..(215): n is a, c, g, or t
  modified_base (217)..(217): a, c, t, g, unknown or other
  misc_feature (217)..(217): n is a, c, g, or t
  modified_base (238)..(238): a, c, t, g, unknown or other
  misc_feature (238)..(238): n is a, c, g, or t
  modified_base (242)..(242): a, c, t, g, unknown or other
  misc_feature (242)..(242): n is a, c, g, or t
  modified_base (262)..(262): a, c, t, g, unknown or other
  misc_feature (262)..(262): n is a, c, g, or t
  modified_base (278)..(278): a, c, t, g, unknown or other
  misc_feature (278)..(278): n is a, c, g, or t
  modified_base (287)..(287): a, c, t, g, unknown or other
  misc_feature (287)..(287): n is a, c, g, or t
tcagtcgatcacgtcacgaccggtgctcgatttagagctcacgtattgggtttggggtctgagagaggagcccagccctgggattttcaggcgttttcatttggtgatcaggactgaacagagagaactcaccatggagtttgggctgagcggngtgttcagcgcattaagncnnnngtnngnngannggagctgtnagctggggcctgagctcncngtgcagtctctgataacttgngatncgcatgatcgtcggccacgngcgcgaggaggcgtgngtggtcgtnagataagtagtaggtaggtagtagtacactatatacgtacgacgtacgtacggtcggggtccggtaccgtaccacgtacgaccgacgacgaacaacgtacgacgacgacgactaactactactactaactaactacgacacacgacgtacgagacgtacgacggacgaccggtacgtagttagttagtgtgagagacgtaccgtaccgaccgtacgtaccgtaccgttacggttgttacgtttacgttacgttgtcgg

SEQ ID NO: 204387 - DNA, 601 bp, Homo sapiens
  misc_feature: GYAE6OF02GUA1X.38.28.C06.1.454.CMB.1.raw
  modified_base (577)..(577): a, c, t, g, unknown or other
  misc_feature (577)..(577): n is a, c, g, or t
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccgaggggaaggggctgggagtgggtctcagcaattaatgggtaggggtgattcaccatattacgcagactccggtggggggccggttcaccatcaccagagacaactccgaggagcacactatatctaacaaatgcacagcctgagagtcgaggacacggccgtagtattattgtgcgagagactacccgaacgggtcacccgtacgttgggtcgtcttttgtacttttcgtgtcggaccgaagggacaagtcggtacctaccgtctcttcacgtccctccaaccgaacgggcccctagtcccggttcccgttcccccgtcgggcccgtccccgtcgcccgtcccgacgggaccncccgaacccgtccggacggtaccg

SEQ ID NO: 204388 - DNA, 554 bp, Homo sapiens
  misc_feature: GYAE6OF02IYN6D.38.28.C06.1.454.CMB.1.raw
  modified_base (363)..(363): a, c, t, g, unknown or other
  misc_feature (363)..(363): n is a, c, g, or t
  modified_base (406)..(406): a, c, t, g, unknown or other
  misc_feature (406)..(406): n is a, c, g, or t
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccagggaagggctggagtgggtggcaactatatcatatgatggaagttttaaagactatgcggactccgtgaagggccgattcaccatctccagagacaattccaagagcacactctatttgacaaatgaacagcctggganctgagacacggctgtctattactgtgacgaaagaccggccctntagtgggtcgggagttagtgtcgtggggccagggaaccctggcccaccggtctccctcgacgccctccaaccgaacgggcccagtccggtccttcccccgtggcccgtccctgcctccgaggacgccaccgtccgagacgccacacgg

SEQ ID NO: 204389 - DNA, 615 bp, Homo sapiens
  misc_feature: GYAE6OF02JMEUG.38.28.C06.1.454.CMB.1.raw
  modified_base (216)..(216): a, c, t, g, unknown or other
  misc_feature (216)..(216): n is a, c, g, or t
  modified_base (292)..(292): a, c, t, g, unknown or other
  misc_feature (292)..(292): n is a, c, g, or t
  modified_base (345)..(345): a, c, t, g, unknown or other
  misc_feature (345)..(345): n is a, c, g, or t
  modified_base (398)..(398): a, c, t, g, unknown or other
  misc_feature (398)..(398): n is a, c, g, or t
  modified_base (406)..(406): a, c, t, g, unknown or other
  misc_feature (406)..(406): n is a, c, g, or t
  modified_base (408)..(408): a, c, t, g, unknown or other
  misc_feature (408)..(408): n is a, c, g, or t
tcagtcgatcacgtcacgaccggtgctcgatttagagctcacgtattgggtttgggctgagctggcttttcttgtggctattttaaaaggtgtccagtgtgaggtgcaggtgtcggagtctgggggaggcgttggttcagccgtggggggtccctggagactctcctgtgcagtctctggattaacctttagtgactatgccatgatctgggtccnccaggctccgaggggaaggggctgggagtggggtctcgagcaattaagtgggtaggggtgattcaccatattacgnagactccggtggggggccgttcaccatccgaccaggacgacaactccgaaggngcaacactatactctaacaaatcgacacagcctgagagtcgagacacggcgtntattatgngngagagactcccgaacggtcacctaccgttggtgttccttttagcgttttcgtggttcggaccaaaggggacctagtcggttaccacccggttcttccttacgacgtcccttaccgaaccgaccgggcccctagttcccggtcccttcccccggtggcccgtccccgttgacctcccggagggaccctacccgtacccgtccgaggac

SEQ ID NO: 204390 - DNA, 657 bp, Homo sapiens
  misc_feature: GYAE6OF02IMSV3.38.28.C06.1.454.CMB.1.raw
  modified_base (358)..(358): a, c, t, g, unknown or other
  misc_feature (358)..(358): n is a, c, g, or t
tcagtcgatcacgtcacgaccggtgctcgatttagagctcacgtattgggtttggggtctgagagaggagcccagccctgggattttcaggcgttttcatttggtgatcaggactgaacagagagaactcaccatggagtttgggctgagctggcttttcttgtggctattttaaaggtgtccagtgtgaggtgcaggtgtcggagtcgtgggggaggcttgggttcaggccgtggggggtccctggagactctcctgtgcagtctctggattaacctttagtgactatgcctatgatcgtgggtccgccaggctccgaggggaagggctgggagtgggtctcgaggcaaagttaagngggttaaggggtgtaagttccgaacctaagttactttaacggctaggaaccgtccgggttcggggggggcccggtttacgacctacgtaccgaacccgaggaacgaaccgaaacctcccgaaggaccgacaacacttatactactaacaaattcgacacagtcctaggaacgagtaccggaggaacagtcgggaccgttagttatttaacggttggttacgacggtaaggaacgtacgtacccggtaaacggtcgtaacccgtacgttcggttccgttacgtttttcgacgttttccgg

SEQ ID NO: 204391 - DNA, 620 bp, Homo sapiens
  misc_feature: GYAE6OF02IV7GH.38.28.C06.1.454.CMB.1.raw
tcagtcgatcacgtcacgaccggtgctcgatttagagctcacgtattgggtttgggctgagcgtggcgttttctgtggctattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccagggaaggggctggagtgggtctcagcaattaatggtaggggtgattcaccatattacgcagactccggtgggggccgttcaccatcaccagagacaactccaggagcacactatatctaacaaatgcacagcctagagagtcgaggacacggccgtgtattattgtgcgagagatccccgaaggtcacctaccttgggtcgtctttttaggattttcgtggttcggaccgtaaaggggtacctaaagtcgggttaccacccggttcttccgttcgaacgtccctacccgaccgaacgggtccccacgttccgggttccttccccccggtgggcccgtaccccgttcgcccgttcccgagggaacccgtcccgtaaccccgttcccggaagtaccgg

SEQ ID NO: 204392 - DNA, 551 bp, Homo sapiens
  misc_feature: GYAE6OF02HIWTR.38.28.C06.1.454.CMB.1.raw
  modified_base (533)..(533): a, c, t, g, unknown or other
  misc_feature (533)..(533): n is a, c, g, or t
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccagggaagggctggagtgggtctcagcaattaatggtaggggtgattcaccatattacgcagactccgtgggggccgttcaccatcaccagagacaactccaggagcacactatatctacaaatgacacagcctgagagtcgaggacacggccgtgtattattgtgcgagagactcccgaacggtgacctacgttggtgtcttttgtatttctgtggccaagggacaagtcggtcaccgtctcttcacgcctccaccaagggcccagtccggtccttcccccgtggcccgcccgtgcctcccgagggaccnccacccgtccgagaccgg

SEQ ID NO: 204393 - DNA, 536 bp, Homo sapiens
  misc_feature: GYAE6OF02FFSX3.38.28.C06.1.454.CMB.1.raw
  modified_base (409)..(409): a, c, t, g, unknown or other
  misc_feature (409)..(409): n is a, c, g, or t
  modified_base (420)..(420): a, c, t, g, unknown or other
  misc_feature (420)..(420): n is a, c, g, or t
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccaggggaaggggctgggagtggggtctcagcaattaatgggtagggggtgattcaccatattacgcagactccgtggggggccgttcaccatcaccagagacaactccaggagcacactatatctacaaatgcacagcctgagagtcgaggacacggcctgtattatgtgcgagagatcccaaggtnaccaccttggngcttttgatttctgtggccaagggacaagtggtcaccgtctcttcagcctccaccaagggcccagtcggccttcccccgtggccgccctgcctccgaggacgcaccctccgagacg

SEQ ID NO: 204394 - DNA, 719 bp, Homo sapiens
  misc_feature: GYAE6OF02GR23J.38.28.C06.1.454.CMB.1.raw
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccagggaaggggctggagtgggtctcagcaattaatggtaggggtgattcaccatattacgcagactccggtggggggccggttcaccatcaccagagacaactccaggagcacactatatctacaaatgacacagcctgagagtcgaggacacggccgtgtattatggtgacggagagactccccgaaacgggttcgaaccctaccgtttgggtcgttccgttttttaggaacttttttccgttgggttacgggtaccccgtaaaaggggggtaccctaaaaggtttcggggttacccgtaacccgggtttcctttacccgtttaccgaaccggtcccccttacccgaaaccccggtaaacgggggtcccccctaaggtttccccggggttacccctttccccccccggttaggggaccccgtccccccgttacggccccgttaccccgaacgggggtacccaccccgtaccccggttaccccggagggtaacccgg

SEQ ID NO: 204395 - DNA, 567 bp, Homo sapiens
  misc_feature: GYAE6OF02F2RWO.38.28.C06.1.454.CMB.1.raw
  modified_base (272)..(272): a, c, t, g, unknown or other
  misc_feature (272)..(272): n is a, c, g, or t
  modified_base (527)..(527): a, c, t, g, unknown or other
  misc_feature (527)..(527): n is a, c, g, or t
  modified_base (533)..(533): a, c, t, g, unknown or other
  misc_feature (533)..(533): n is a, c, g, or t
  modified_base (551)..(551): a, c, t, g, unknown or other
  misc_feature (551)..(551): n is a, c, g, or t
tcagtcgatcacgtcacgaccggtgctcgatttagagctcacgtattgggtttgggctggagctggcttttcttgtggctattttaaaaggtgtccagtgtcgaggtgcaggtgtcggagtctgggggagcttggttcagcctggggggtccctgagactctcctgtgcagtctctggattaacctttagtgacttatgccatggatctgggtcccgccaggctccaggggaagggctgggagtgggtctcgagcaattaagtggtagggtnattcaccatatacgcagactccggtgggggccgttcacatcaccagagacaactccaggacgcacactatatcaacaatgacacagcctgagagtcgaggacacggtccgtgtattatgtgcgagagataccccgaaggtcaccgtaccgttgggtacgtcttttgtatttcttgtcggaccaagggacaagtggtaccaccgttctccttcgacgtccctccgaaccgaacgggcccagtccggtccttcccgnggcccncccgtgcctcgaggaccnccacccgtcgagtacg

SEQ ID NO: 204396 - DNA, 620 bp, Homo sapiens
  misc_feature: GYAE6OF02GI50T.38.28.C06.1.454.CMB.1.raw
  modified_base (222)..(222): a, c, t, g, unknown or other
  misc_feature (222)..(222): n is a, c, g, or t
  modified_base (281)..(281): a, c, t, g, unknown or other
  misc_feature (281)..(281): n is a, c, g, or t
  modified_base (501)..(501): a, c, t, g, unknown or other
  misc_feature (501)..(501): n is a, c, g, or t
  modified_base (526)..(526): a, c, t, g, unknown or other
  misc_feature (526)..(526): n is a, c, g, or t
tcagtcgatcacgtcacgaccggtgctcgatttagagctcacgtattgggttgggtggccgaaggttgctggaggtcacggttcaccagtcaccagagacaactccaggagcacgactactatcttacaaatgcacagcctgagagtcgaggaccacggccgtgtattattggtgcgagtagatccccaaacggtgaccaccttggtgccttttggatttcngtggcccaagggacaatggtcaccgtctctcagcctccacaggccatcggtcttccccnggcgtcctgcctccgaggagccacctcccgagtacgcacacgccggacctgggctcggcccgtcgggtaccgaaggggtaccttaccgttcccgaacggttaggtaacgttccgggaaccttacgggaacggtcccgggggtacgttacggggacccgaaaacggggcccgtacccgtaaacgttaacgggccaagccgaacgcggacacgaccgacganacggagaccgtaatactagtcgcgngacgacgagagtagtagtgtcgtcgtcgcgcgacgtacgcgcgtacgtacgtcgcgacgaccgacgcgccgtccgtcgtcgtcgtcgtacgtcc

SEQ ID NO: 204397 - DNA, 592 bp, Homo sapiens
  misc_feature: GYAE6OF02IWG0Z.38.28.C06.1.454.CMB.1.raw
  modified_base (215)..(215): a, c, t, g, unknown or other
  misc_feature (215)..(215): n is a, c, g, or t
  modified_base (270)..(270): a, c, t, g, unknown or other
  misc_feature (270)..(270): n is a, c, g, or t
  modified_base (353)..(353): a, c, t, g, unknown or other
  misc_feature (353)..(353): n is a, c, g, or t
  modified_base (437)..(437): a, c, t, g, unknown or other
  misc_feature (437)..(437): n is a, c, g, or t
  modified_base (571)..(571): a, c, t, g, unknown or other
  misc_feature (571)..(571): n is a, c, g, or t
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggatttaacctttagtgactatgccatgatctgggtccnccaggctccagggaaggggctggagtgggtctcagcaattaagtgggtaggggtnattcacatattacgcagactccggtggggggccgttcaccatcaccagagaccaactccgaggacgcacactatactactaanaaatgacacacgcctgagagtcggaagacgacggccgtagtattagttgtgacgagagactcccgaaggtcacctacgttggtntcttttgattttcgtgtcggacaagggactaagtcggtccaccgtctcgttcacgtccctaccaccgaacgggccctagttcccggttacccgttcccccgtcggccctcccgtcgtcccgtaccgacggaccncccgtacccgtccggacacgg

SEQ ID NO: 204398 - DNA, 177 bp, Homo sapiens; identical to SEQ ID NO: 204214
  misc_feature: GYAE6OF02H4OMO.38.28.C06.1.454.CMB.1.raw
  modified_base (175)..(177): a, c, t, g, unknown or other
  misc_feature (175)..(177): n is a, c, g, or t

SEQ ID NO: 204399 - DNA, 539 bp, Homo sapiens
  misc_feature: GYAE6OF02HESKL.38.28.C06.1.454.CMB.1.raw
  modified_base (360)..(360): a, c, t, g, unknown or other
  misc_feature (360)..(360): n is a, c, g, or t
tcagtcgatcacgtcacgaccggtgctcgatttagagctcacgtattgggtttggggtctgagagaggagcccagccctgggattttcaggcgttttcatttggtgatcaggactgaacagagagaactcaccatggagtttgggctgagctggctttttctgtggctattttaaaaggtgtccagtgtgaggtgcaggtgtcggagtcgtgggggaggcttggttcagccgtggggggtccctgagactctcctgtgcagtctctggatttaaccttagtgactatgccatgatcgtggtccgcaggctccgagggaagggctggagtgggtctcagcaaagttaagtgggtaggggtnattcactatattacgcagactcggtggggggccgttcacatcacagagacactcgaggagcacactatatactaacaaatgacacacgcctagagacgtcgaaggacgacggtcgtagtaattagttgtgcgagagactcccgaaggtcgaccacgttggtgtcttttagtatttctgg

SEQ ID NO: 204400 - DNA, 558 bp, Homo sapiens
  misc_feature: GYAE6OF02IMSFG.38.28.C06.1.454.CMB.1.raw
  modified_base (257)..(257): a, c, t, g, unknown or other
  misc_feature (257)..(257): n is a, c, g, or t
  modified_base (267)..(267): a, c, t, g, unknown or other
  misc_feature (267)..(267): n is a, c, g, or t
  modified_base (331)..(331): a, c, t, g, unknown or other
  misc_feature (331)..(331): n is a, c, g, or t
  modified_base (397)..(397): a, c, t, g, unknown or other
  misc_feature (397)..(397): n is a, c, g, or t
  modified_base (419)..(419): a, c, t, g, unknown or other
  misc_feature (419)..(419): n is a, c, g, or t
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccagggaggggctgggagtgggtctcagcaattaanggtaggggtnattcaccatattacgcagactccggtggggggccgttcaccatcaccagagacaactccaggancacactatatctaacaaatgcacagcctgagagtcgaggacacggccgtagtattatgtgcgaganatcccaaggtgaccacttggtntctttgatttctgtcgcaagggacaagtggtcacgtctcgttcacgtcctccaacgaacgggtccccagttcccggtacccttcccccgtggcccgtccccgtgcccttaccgacggcgccacccgtccggagtaccgg

SEQ ID NO: 204401 - DNA, 590 bp, Homo sapiens
  misc_feature: GYAE6OF02I089E.38.28.C06.1.454.CMB.1.raw
  modified_base (266)..(266): a, c, t, g, unknown or other
  misc_feature (266)..(266): n is a, c, g, or t
  modified_base (329)..(329): a, c, t, g, unknown or other
  misc_feature (329)..(329): n is a, c, g, or t
tcagtcgatcacgtcacgaccggtgctcgatttagagctcacgtattgggtttgggctgagctggcttttcttgtggctattttaaaaggtgtccagtgtgaggtgcaggtgtcggagtctgggggaggcttggttcagcctggggggtccctgagactctcctgtgcagtctctggatttaacctttagtgactatgccatgatctgggtccgcaggctccagggaaggggctggagtgggtctcagcaattaatggtaggggtnattcaccatattacgcagactccggtgggggccgttcaccatcaccagagacaactccaggancacactatatactacaaatgacacagcctgagagtcgaaggacacggccgtgtattattgtgacgagagactccccgaacgggtcgacctacgttggtgtctttttagattttcgtgtcggacccgaagggacaagtggtaccaccgttctcttacacgtccctaccaaccgaacgggccctagtcccggttcccttcccccgtagggccccgtcccttgtcccgtaccgacggaccgcccgtacccgtccggagtaccgg

SEQ ID NO: 204402 - DNA, 783 bp, Homo sapiens
  misc_feature: GYAE6OF02J3RDV.38.28.C06.1.454.CMB.1.raw
tcagtcgatcacgtcacgaccggtgctcgatttagagctcacgtattgggtttggggtctgagagaggagcccagccctgggattttcaggcgttttcatttggtgatcaggactgaacagagagaactcaccatggagtttgggctgagctggcttttcttgtggctattttaaaaggtgtccagtgtgaggtgcaggtgtcggagtcgtggggagtcttggttcaggccgtggggggtccctggacgactctccgtgtgcgagtctcgtggtacttaaccgtttagtcgtactagttcgacctaagtcgactcgtcgggtcccgccgacggcctaccggagggaacgggtcgtgggtacggtcgggtctacgagtactaaagttaagtggggttacgggtgtacgttaccgaaccgtagttaacgttaccggacgaacggtaccggttccggggtacgggggggtcccttaccgaaccgtaacgtaccgaaaccgaggaaccgtaaccgtaaacccgtacccggagggaaccgacctaaaccgtaacgttaacgttaactaccgtaaaacgtaaacgttcggaaccaacgtaccggtacccgttaaggaacggtaccggttacgggaaacggacccgtaccggggtacccttaaggttaacgtttagttacggtacgaccggtaagtaaccggtaccgtaaccccggtaacggttccggaacccgttaccggttttcgggtaccgtttccgttttaacggttacgtttccggttaacgggg

SEQ ID NO: 204403 - DNA, 610 bp, Homo sapiens
  misc_feature: GYAE6OF02I133D.38.28.C06.1.454.CMB.1.raw
  modified_base (215)..(215): a, c, t, g, unknown or other
  misc_feature (215)..(215): n is a, c, g, or t
  modified_base (334)..(334): a, c, t, g, unknown or other
  misc_feature (334)..(334): n is a, c, g, or t
  modified_base (351)..(351): a, c, t, g, unknown or other
  misc_feature (351)..(351): n is a, c, g, or t
  modified_base (394)..(394): a, c, t, g, unknown or other
  misc_feature (394)..(394): n is a, c, g, or t
tcagtcgatcacgtcacgaccggtgctcgatttagagctcacgtattgggtttgggctgagcgtgcgttttcttagtggctattttaaaaggtgtccagtgtgaggtgcaggtgtcggagtctgggggaggcttggttcagcctggggggtccctgagactctcctgtgcagtctctggattaacctttagtgactatgccatgatctgggtccnccaggctccaggggaggggctggagtgggtctcagcaattaatgggtaggggtgattcacatattacgcagactccggtgggggccgttcaccatcaccagagacaactccgaaggacncacactatactactaanaaatgcacagcctgagagtcgagacacggcgtgtatttattgngcgagagactcccgaaggtcgacccgacgtttgggtcgtcgtttttagattttcctggttcggaccgaagggacaagttcggtccgtaccgtctcttcgacgtcctaccaccgtaacgggccctacgttcccggttaccctttcccccgtagggtcccgtccccgttccgtacccgttacccgacgggtaccgacccgacccgttccggacgaacg

SEQ ID NO: 204404 - DNA, 550 bp, Homo sapiens
  misc_feature: GYAE6OF02FI5IO.38.28.C06.1.454.CMB.1.raw
  modified_base (512)..(512): a, c, t, g, unknown or other
  misc_feature (512)..(512): n is a, c, g, or t
tcagtcgatcacgtcacgaccggtgctcgatttagagctcacgtattgggtttgggctgagcgtgcgtttctagtggctattttaaaaggtgtccagtgtgaggtgcaggtgtcggagtctgggggagcttggttcagcctggggggtccctgagactctcctgtgcagtctctggattaacctttagtgactatgccatgatctgggtccgccaggctccaggggaaggggctgggagtgggtctcagcaattaatgggtaggggtgattcaccatattacgcagactcggtgggggccgttcaccatcaccagagacaactccaggagcaacactatatcctaacaaaatgacacagcctagagagtcgaaggacacgggtcctgtaattattgtgcgagagactcccaacggtcgacctaccgttgggtgtcttttgatttctggtggaccaaggacatggtcaccgtctcttcgagccctcacgacggtcccagtcgtccttccccgnggccgtccctgcctcgacggcgccgacctccgagtacg

SEQ ID NO: 204405 - DNA, 590 bp, Homo sapiens
  misc_feature: GYAE6OF02HHYC2.38.28.C06.1.454.CMB.1.raw
tcagtcgatcacgtcacgaccggtgctcgatttagagctcacgtattgggtttgggctgagcgtggcttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccagggaaggggctgggagtgggtctcagcaattaatggtagggtgattcaccatatacgcagactccggtgggggccgttcaccatcaccagagacaactccaggacgcacactatatcctaacaaatgacacgagcctagagtagtcgaggacacggccgtgtattattgtggcgagagactacccgaacggtcgaccgtaccgttggtcgtcgttttgattttcgtggtggaccgtaagggacctaagtcggtacctacccgttcttccgttcacgtccctaccaccgaacggcccagttccggttacccttcccccgtaggtcccgcccgttcggccctaccgaggccgccacccgtcgacgacg

SEQ ID NO: 204406 - DNA, 693 bp, Homo sapiens
  misc_feature: GYAE6OF02IPC5S.38.28.C06.1.454.CMB.1.raw
  modified_base (266)..(266): a, c, t, g, unknown or other
  misc_feature (266)..(266): n is a, c, g, or t
  modified_base (332)..(332): a, c, t, g, unknown or other
  misc_feature (332)..(332): n is a, c, g, or t
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccagggaagggctggagtgggtctcagcaattaatggtaggggtnattcaccatattacgcagactccggtggggggccgttcaccgatcaccagagacaactccaggacncacactatatctaacaaatgacacagcctgagagtcgaggacacggctgtattattgtgacgagagactcccgaaacggtcgaacctaccgtttgggtgtctttttagactttttcgtggttacgggtacccgaaagggggtacctaaaggttcgggtaacccgtacccggtttaccgtaccttttaccgaaccggtccccgttacccgaaacccgtaacgggggtacccccaacggtttcccggggttccccttttacccccccggtcggggtcccgtaccccccgtttacgggccccgtttaccccggaacggggtaacccggtcccgttaaccccgtacccgggtaacggtacccggg

SEQ ID NO: 204407 - DNA, 658 bp, Homo sapiens
  misc_feature: GYAE6OF02FJO4Q.38.28.C06.1.454.CMB.1.raw
  modified_base (275)..(275): a, c, t, g, unknown or other
  misc_feature (275)..(275): n is a, c, g, or t
  modified_base (577)..(577): a, c, t, g, unknown or other
  misc_feature (577)..(577): n is a, c, g, or t
tcagtcgatcacgtcacgaccggtgctcgatttagagctcacgtattgggtttgggctgagcgtgcgttttctaggtggctattttaaaaggtgtccagtgtgaggtgcaggtgtcggagtctgggggaggcttggttcagcctgggggggtccctgagactctcctgtgcagtctctggatttaacctttagtgactatgccatgatctgggtccgccaggctccgaggggaaggggctgggagtgggtctcagcaattaagtgggtaggggtnattcaccatattacgcagactccggtggggggccgttcaccatcaccagagacaactccaggacgcaacactatatctaacaaatgcacagcctgagagtcgaggacacggcctgtattatgtgcgagagactccccaagggtcgaaccctaccgtttgggtcgtctttttggtacttttcttgggtcggacccgaaaggggtacctaaagttcgggtaccgaacccgttcttctttacccaagtccccttcccaaccgaaaccggggcccctagttcccgggttacccctttcccccccgngggtccccggtaccccctttcggccccgttacccggaacggggtacccgtaccctaaccccgttacccggaaggaacccgg

SEQ ID NO: 204408 - DNA, 634 bp, Homo sapiens
  misc_feature: GYAE6OF02JZWAM.38.28.C06.1.454.CMB.1.raw
  modified_base (194)..(194): a, c, t, g, unknown or other
  misc_feature (194)..(194): n is a, c, g, or t
  modified_base (213)..(213): a, c, t, g, unknown or other
  misc_feature (213)..(213): n is a, c, g, or t
  modified_base (267)..(267): a, c, t, g, unknown or other
  misc_feature (267)..(267): n is a, c, g, or t
  modified_base (314)..(314): a, c, t, g, unknown or other
  misc_feature (314)..(314): n is a, c, g, or t
  modified_base (346)..(346): a, c, t, g, unknown or other
  misc_feature (346)..(346): n is a, c, g, or t
  modified_base (351)..(351): a, c, t, g, unknown or other
  misc_feature (351)..(351): n is a, c, g, or t
  modified_base (359)..(359): a, c, t, g, unknown or other
  misc_feature (359)..(359): n is a, c, g, or t
  modified_base (369)..(369): a, c, t, g, unknown or other
  misc_feature (369)..(369): n is a, c, g, or t
  modified_base (378)..(378): a, c, t, g, unknown or other
  misc_feature (378)..(378): n is a, c, g, or t
  modified_base (478)..(478): a, c, t, g, unknown or other
  misc_feature (478)..(478): n is a, c, g, or t
  modified_base (595)..(595): a, c, t, g, unknown or other
  misc_feature (595)..(595): n is a, c, g, or t
  modified_base (630)..(630): a, c, t, g, unknown or other
  misc_feature (630)..(630): n is a, c, g, or t
tcagtcgatcacgtcacgaccggtgctcgatttagagctcacgtattgggtttgggctgagcgtggcgttttcttgtcggctatttaaaggtgtccagtgtgaggtgcaggtgtcggagtctggggaggcttggttcagctggggggtccctggagactctcctgtgcagtctctggattaacctttgtgactntgccatgatcgtgggtccncaggctcgaggggagggctgggagtgggtctcgagcaagttagtggtaggggtnattccaacctattattacgctagaccgtccggtggggggtccccttnacccgtatccgaccaggagacaacctcgaggncctanactattcnctaacaaagnacagacgcnggagagtcgaaggtacacggggtcctggtaactttgtgtgacgagaccgtaacgccgtaaccggtgaacccttcgttgggtctcgttttagacttttcgnggtcggaccgaaaggcccttaaagtccgggttccaacggttcctacgttaccgagtccctaccgaaccgtaacgggtccctgtccggttccccgttaacccggtcgctccccggttnaaccgttccgacggaccgcctaaccccttggaacnccgg

SEQ ID NO: 204409 - DNA, 594 bp, Homo sapiens
  misc_feature: GYAE6OF02F60DY.38.28.C06.1.454.CMB.1.raw
  modified_base (354)..(354): a, c, t, g, unknown or other
  misc_feature (354)..(354): n is a, c, g, or t
  modified_base (386)..(386): a, c, t, g, unknown or other
  misc_feature (386)..(386): n is a, c, g, or t
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccagggaaggggctggagtgggtctcagcaattaatgggtaggggtgattcaccatattacgcagactccgtgggggccgttcaccatcaccagagacaactccaggagcacactatatctaacaaatgcacngcctgagagtcgaggacacggccgtgtaattntgtgcgagagatccccaaggtcgaacctaccgttggtcgtctttttgatttctggtcgaccgaagggactaatggtaccaccgttcttacttcacgtccctaccgacctaacggggccctagtccggttcccgtttccccccgtgggcccctccccgttgtacccgtcccgtaacgggtcgacccctacccgttcccggagtaaccgg

SEQ ID NO: 204410 - DNA, 711 bp, Homo sapiens
  misc_feature: GYAE6OF02F5NFL.38.28.C06.1.454.CMB.1.raw
  modified_base (181)..(181): a, c, t, g, unknown or other
  misc_feature (181)..(181): n is a, c, g, or t
  modified_base (187)..(187): a, c, t, g, unknown or other
  misc_feature (187)..(187): n is a, c, g, or t
  modified_base (190)..(190): a, c, t, g, unknown or other
  misc_feature (190)..(190): n is a, c, g, or t
  modified_base (286)..(286): a, c, t, g, unknown or other
  misc_feature (286)..(286): n is a, c, g, or t
tcagtcgatcacgtcacgaccggtgctcgatttagagctcacgtattgggtttggggtctgagagaggagcccagccctgggattttcaggcgttttcatttggtgatcaggactgaacagagagaactcaccatggagtttgggctgagcggcgtgttctaggtcggctaatttaaaggngtcagngtnaggtgcagtgtgagtctggggagcttggttcagcctgggggtccctgagactctcctgtgcagtctctggtattaacctttattgactatgccatntatcgtcggtcgcgacgcgtcgagggagggcggtggtaggtcggtcgtacacgacgtaagttaaggttagggtaggggttaggtacgttactaacgtaacttaacgttacgtacgtacgtaccggtaccggggttccgggggtaccgggttaccgtaccgtacgtaccgtaaccgtaacgaacgtaaccgaaccgtaccgaacggacgacaactaactaactaacttaactaactaaacgtacgtacgacacgtaccgtacgaacggtacggtacggaacggaacggtaccggtaccggttacgttaagtttacgttacggtacggtacggtacggtaacggtaaccgtaacccggtaaccggttaaccgtaaccgttaccgttacggtttacgtttacgttttacgtttacgtttacgttacgg

SEQ ID NO: 204411 - DNA, 682 bp, Homo sapiens
  misc_feature: GYAE6OF02GDCGC.38.28.C06.1.454.CMB.1.raw
  modified_base (271)..(271): a, c, t, g, unknown or other
  misc_feature (271)..(271): n is a, c, g, or t
  modified_base (661)..(661): a, c, t, g, unknown or other
  misc_feature (661)..(661): n is a, c, g, or t
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcaggcctggggggtccctgagactctcctgtgcagtctctggattaacctttagtgactatgccatgatctgggtccgccaggctccgagggaagggctgggagtgggtctcagcaagttaatgggtaggggtnattcaccatattacgcagacctccggtgggggccgttcacctatcaccagacgaaccaactccgaggacgcacactatatctaacaaatgacctacgacgtcctggaagtacggtacggaacgggacgaccgggtccgttagttaacgtttagtttggtacggtacggaaggacgtaacgtacccccgtaaacggggtacgaaccccgttaccgtttgggtcgttcgtttttggtaacgttttccgttaggtcggacccgtaaaggggtaacctaagttccgggtacctaccggttcttccgttcacgtcccctcgaacccgacgggccctacggttccggtcccgtttccccggtaggtcccgcccgtcgtacccgtccgacgggtacncccgaaccgtccggagtaccg

SEQ ID NO: 204412 - DNA, 582 bp, Homo sapiens
  misc_feature: GYAE6OF02H49K8.38.28.C06.1.454.CMB.1.raw
  modified_base (394)..(394): a, c, t, g, unknown or other
  misc_feature (394)..(394): n is a, c, g, or t
  modified_base (566)..(566): a, c, t, g, unknown or other
  misc_feature (566)..(566): n is a, c, g, or t
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccgaggggaaggggctgggagtgggtctcagcaattaatgggtaggggtgattcaccatattacgcagactccggtgggggccgttcaccatccacagagacaactccaggagcacactatatctaacaaatgacacagcctgagagtcgaaggacacggcgtgtattattgngacgagagactacccgaacggtgaaccctacgttggtgtctttttaggattttcgtggttcggaccgaaaggggacctaagttcggtacctaccgttctcttcacgtccctacgaaccgaacgggccctagtccggttcctccccgtggcccgcccttgcctccgacggacncccacgtccgagaccg

SEQ ID NO: 204413 - DNA, 395 bp, Homo sapiens
  misc_feature: GYAE6OF02HIF3J.38.28.C06.1.454.CMB.1.raw
  modified_base (385)..(395): a, c, t, g, unknown or other
  misc_feature (385)..(395): n is a, c, g, or t
tcagtcgatcacgtcacgaccggtgctcgatttagagctcacgtattgggtttgggtgccgaagttgctggaggtcacggttcaccatcaccagagacaactccaggagcacactatatctacaaatgcacagcctgagagtcgaggacacggccgtgtattattgtgcgagagatcccaacggtgaccaccttggtgcttttgatttctgtggccaagggacaatggtcaccgtctcttcagcctccaccaagggcccatcggtcttccccctggcgccctgctccaggacgccacctccgagagcacaggcggcccctgggcctgcctggtcaaggactacttccacgtgatcgactgagcgggctgggcaaggcgcagtagnnnnnnnnnnn

SEQ ID NO: 204414 - DNA, 379 bp, Homo sapiens
  misc_feature: GYAE6OF02F7FP2.38.28.C06.1.454.CMB.1.raw
  modified_base (378)..(379): a, c, t, g, unknown or other
  misc_feature (378)..(379): n is a, c, g, or t
tcagtcgatcacgtcacgaccggtgctcgatttagagctcacgtattgggtttgggtgccgaagttgctggaggtcacggttcaccatcaccagagacaactccaggagcacactatatctacaaatgcacagcctgagagtcgaggacacggccgtgtattattgtgcgagagatcccaacggtgaccaccttggtgcttttgatttctgtggccaagggcaatggtcaccgtctcttcagcctccaccaagggcccatcggtcttccccctggcgcccctgctccaggagcacctccgagagcacagcggccctgggctgcctggtcaaggactacttccacgtgatcgactgagcgggctggcaaggcgcatagnn

SEQ ID NO: 204415 - DNA, 695 bp, Homo sapiens
  misc_feature: GYAE6OF02FPWX7.38.28.C06.1.454.CMB.1.raw
  modified_base (197)..(197): a, c, t, g, unknown or other
  misc_feature (197)..(197): n is a, c, g, or t
  modified_base (199)..(199): a, c, t, g, unknown or other
  misc_feature (199)..(199): n is a, c, g, or t
  modified_base (631)..(631): a, c, t, g, unknown or other
  misc_feature (631)..(631): n is a, c, g, or t
tcagtcgatcacgtcacgaccggtgctcgatttagagctcacgtattggggtttggggtctgagagaggagcccaggccctgggattttcaggcgttttcatttggtgatccaggactgaacagagagaactcaccatcggagttttgggctgagcggtgtgtttctaggtgctatttaaaggtgtcagtgtgagtncnggtgtcggatgtggggaggcgtaggttccgaggtcctgggggtccctggacgtactcgtccgtagtcgtccaggtctcgtaggtaacttaaccgttagtgtaagtattgcctagtgactcgtaggcccacgcggtactaccggagggtaacgggcgtagggtacggtcgggtacctagtacggtacctaaacgttaagtgggggttaaacggggtctagttaccgaactacgttaagttacccggatacggacctttccgggtcggggtacccggttacacccggtaattcccgaaccgtaggtacaaccgtaaccgtacgaacgggtccacgacctacgaacctttacgacctaacgaagttccgaacgtaccagcccgttagacgtacggtacgacggtaccaccgggtcttagttaacgttcgttaggngtaccgagtcgaacttacccgaaggtcaccggttacgttggactttacgtttgtattcggtcgg

SEQ ID NO: 204416 - DNA, 707 bp, Homo sapiens
  misc_feature: GYAE6OF02IBGA0.38.28.C06.1.454.CMB.1.raw
  modified_base (280)..(280): a, c, t, g, unknown or other
  misc_feature (280)..(280): n is a, c, g, or t
tcagtcgatcacgtcacgaccggtgctcgatttagagctcacgtattggggtttgggctgagctggctttttcttgtggctattttaaaaggtgtccagtgtgaggtgcaggtgtcggagtctgggggagcttgggttcagcctgggggggtccctgagactctcctgtgcagtctctggatttaacctttagtgactatgccatgatcgtgggtccgccaggctccgagggaaggggctgggagtgggtctcgagactaagttaagtgggtaggggttnattacacctatattacgcagaccgtccggtggggggaccgttccacagtcaccaggacgtacaacgtccgaggacacacaactataatactaacgaaatgacaacgacgtccgtagacgaggtccggaaggaccgacggccgttagtatttacgttggtacgacgaagacgtactacccgaacgggtcaacccgtacgttggtcgtttcttttagtacttttcagggtacggaccggtaaacgggtacctaagttccggtaccgtacccgttacttccgtttacgaccgttacccgtacccgaaacccgggtaaccgggaccctacggttccccgggttacccttccccggtcgggtcccctaccccgttcgtacccgtttaccggaacggcccgtacccggtaccccgttaccggaggtaacccgg

SEQ ID NO: 204417 - DNA, 629 bp, Homo sapiens
  misc_feature: GYAE6OF02GRW3X.38.28.C06.1.454.CMB.1.raw
  modified_base (215)..(215): a, c, t, g, unknown or other
  misc_feature (215)..(215): n is a, c, g, or t
  modified_base (272)..(272): a, c, t, g, unknown or other
  misc_feature (272)..(272): n is a, c, g, or t
  modified_base (336)..(336): a, c, t, g, unknown or other
  misc_feature (336)..(336): n is a, c, g, or t
  modified_base (351)..(351): a, c, t, g, unknown or other
  misc_feature (351)..(351): n is a, c, g, or t
  modified_base (400)..(400): a, c, t, g, unknown or other
  misc_feature (400)..(400): n is a, c, g, or t
tcagtcgatcacgtcacgaccggtgctcgatttagagctcacgtattgggtttgggctgagcgtgcttttctagtggctattttaaaaggtgtccagtgtgaggtgcaggtgtcggagtctggggggaggcttggttcagcctgggggggtccctgagactctcctgtgcagtctctggattaacctttagtgactatgccatgatctgggtccnccaggctccaggggaaggggctggagtgggtctcagcaaattaagtgggtaggggtnattcaccatattacgcagactccggtggggggccgttcaccatcaccagagacaactccaggancacactatatctaanaaatgacacagcctaggagagtcgaggacacggcgtagtatttagttgngacgagaagtactacccgaaacgggtcgaacctaccgttggtcgttcttttaggacttttcgtggtcggaccaaaggggacctaaagttcggtacctaaccgtcttcttacgacgtccctaccgaaccgacgggtaccctagtcccggttacccttcccccggtaggcccgtccccgttacgtcccgttaccgacgggtaccgacccgtacccgtcccggaagacccgg

SEQ ID NO: 204418 - DNA, 668 bp, Homo sapiens
  misc_feature: GYAE6OF02FU825.38.28.C06.1.454.CMB.1.raw
  modified_base (214)..(214): a, c, t, g, unknown or other
  misc_feature (214)..(214): n is a, c, g, or t
  modified_base (268)..(268): a, c, t, g, unknown or other
  misc_feature (268)..(268): n is a, c, g, or t
  modified_base (334)..(334): a, c, t, g, unknown or other
  misc_feature (334)..(334): n is a, c, g, or t
tcagtcgatcacgtcacgaccggtgctcgatttagagctcacgtattgggtttgggctgagcgtggcttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccnccaggctccaggggaagggctgggagtgggtctcagcaattaatggtaggggtnattcaccatattacgcagactcggtgggggccgttcaccgatcaccagagacaactcaggagccanactatatctacaaatgacacagcctagagagtcgaggacacggctgttacttattgtgcgaagagactccccgaaggtcgaccctaccgttgggtcgtctttttggacttttccgttgggtcggtacccgaaacggggtaacaaacggtttcgggtacctacccgtttaccgttcgtttaccgaacggtccccttacccgaaaccgtaaaccggggtcccctagttccccgggttacccgtttccccccgtaggggtcccccgttcccccgttaggtccctacccccggtaaggggacccgttacccctaccccggttacccggaagtacccgg

SEQ ID NO: 204419 - DNA, 606 bp, Homo sapiens
  misc_feature: GYAE6OF02H8YEF.38.28.C06.1.454.CMB.1.raw
  modified_base (217)..(217): a, c, t, g, unknown or other
  misc_feature (217)..(217): n is a, c, g, or t
  modified_base (280)..(280): a, c, t, g, unknown or other
  misc_feature (280)..(280): n is a, c, g, or t
  modified_base (353)..(353): a, c, t, g, unknown or other
  misc_feature (353)..(353): n is a, c, g, or t
  modified_base (418)..(418): a, c, t, g, unknown or other
  misc_feature (418)..(418): n is a, c, g, or t
  modified_base (457)..(457): a, c, t, g, unknown or other
  misc_feature (457)..(457): n is a, c, g, or t
  modified_base (602)..(602): a, c, t, g, unknown or other
  misc_feature (602)..(602): n is a, c, g, or t
tcagtcgatcacgtcacgaccggtgctcgatttagagctcacgtattgggtttgggctgagcgtggctttttcttgtggctattttaaaaggtgtccagtgtgaggtgcaggtgtcggagtctgggggaggcttggttcagcctggggggtccctgagactctcctgtgcagtctctggtattaacctttagtgactatgccatgatcgtgggtccnccgaggctccgaggggaaggggctgggaggtgggtctcgagctaattaagtgggtagggggtntattccaccattattacgcagacgtccgggtggggggtccgttcaccatccaaccagacgacaactccaggancacacatatctaacgaaatgacactagcctgagacgtacgaggacacgcgtagttattatttggngacgagagactacccgaaggtcgaacgtccgttgggttntttcgtttgttacgtttcgtggtacggaacgaaggtaactagttcgtactctcgttcctctacgcctcctaccgaaccgaccgccctacgttcccggtccctccccgcggccctccgacgccgccggacgcccgtccgtacccgngacg

SEQ ID NO: 204420 - DNA, 578 bp, Homo sapiens
  misc_feature: GYAE6OF02FOHHV.38.28.C06.1.454.CMB.1.raw
  modified_base (398)..(398): a, c, t, g, unknown or other
  misc_feature (398)..(398): n is a, c, g, or t
  modified_base (537)..(537): a, c, t, g, unknown or other
  misc_feature (537)..(537): n is a, c, g, or t
  modified_base (562)..(562): a, c, t, g, unknown or other
  misc_feature (562)..(562): n is a, c, g, or t
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccaggggaaggggctgggagtggggtctcagcaattaatgggtaggggtgattcaccatattacgcagactccggtggggggccgttcaccatcaccagagacaactccaggagcaacactatatctaacaaaatgcaacagcctgagagtcgaaggacacggccgtgtattattgngcgaagagactccccgaaacggttcgaaccctaccgtttggtcgtctttttgattttcgtggtcggccaagggacaagtggtccaccgtcttcttcacgtccctaccaaccgaagggcccagtccggtcccttccccgnggcccgtccctgccctccgaggacnccgacctccggagacg

SEQ ID NO: 204421 - DNA, 631 bp, Homo sapiens
  misc_feature: GYAE6OF02GCNJD.38.28.C06.1.454.CMB.1.raw
  modified_base (344)..(344): a, c, t, g, unknown or other
  misc_feature (344)..(344): n is a, c, g, or t
tcagtcgatcacgtcacgaccggtgctcgatttagagctcacgtattgggtttgggctgagcgtggctttttcttgtggctattttaaaaggtgtccagtgtgaggtgcaggtgtcggagtctgggggaggcttggttcagcctgggggggtccctgagactctcctgtgcagtctctggattaacctttagtgactatgccatgatctgggtccgccaggctccgaggggaaggggctgggagtggggtctcagcaattaagtgggtagggggtgattcaccattattacgcagactccggtggggggccgttcaccgatcaccgagagacaacctccaggancacactatatctaacaaatcgacacagcctgagagtcgaggacacggccgtgtattatgtgcgagagactacccgaacgggtcgaccctaccgttagggttcgtccgtttttgattttcgttgtacgggccgtaaacgggacctaagttcggtacctaccgttccgttctttccgactccctacccaccgaaccgggcccacgttccgtccccgttccccggttcggccccgtcccgtacggtccttacccggtagggacccgtccaccccgtacggaccgtaaccg

SEQ ID NO: 204422 - DNA, 591 bp, Homo sapiens
  misc_feature: GYAE6OF02GIBII.38.28.C06.1.454.CMB.1.raw
  modified_base (392)..(392): a, c, t, g, unknown or other
  misc_feature (392)..(392): n is a, c, g, or t
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccagggaaggggctgggagtggggtctcagcaattaatgggtaggggtgattcaccatattacgcagactccggtggggggccgttcaccatcaccagagacaactccaggagcacactatatctacaaatgcacagcctgagagtcgaggacacggccgtgtattattgngcgagagactcccgaaacggtgaaccctaccgttgggtcgtcgttttgaattttctggtcggaccaaagggacaaagtggtaccaccgttcttccttcgacgtccctacccacgaacgggtcccagttccggtcccgtttcccccgtggtcccgccctcgtcctacccgagggaccgcctaccccgtccggaagacccg

SEQ ID NO: 204423 - DNA, 602 bp, Homo sapiens
  misc_feature: GYAE6OF02J0GCO.38.28.C06.1.454.CMB.1.raw
  modified_base (259)..(259): a, c, t, g, unknown or other
  misc_feature (259)..(259): n is a, c, g, or t
  modified_base (269)..(269): a, c, t, g, unknown or other
  misc_feature (269)..(269): n is a, c, g, or t
  modified_base (306)..(306): a, c, t, g, unknown or other
  misc_feature (306)..(306): n is a, c, g, or t
  modified_base (314)..(314): a, c, t, g, unknown or other
  misc_feature (314)..(314): n is a, c, g, or t
  modified_base (320)..(320): a, c, t, g, unknown or other
  misc_feature (320)..(320): n is a, c, g, or t
  modified_base (326)..(326): a, c, t, g, unknown or other
  misc_feature (326)..(326): n is a, c, g, or t
  modified_base (333)..(333): a, c, t, g, unknown or other
  misc_feature (333)..(333): n is a, c, g, or t
  modified_base (336)..(336): a, c, t, g, unknown or other
  misc_feature (336)..(336): n is a, c, g, or t
  modified_base (360)..(360): a, c, t, g, unknown or other
  misc_feature (360)..(360): n is a, c, g, or t
  modified_base (484)..(484): a, c, t, g, unknown or other
  misc_feature (484)..(484): n is a, c, g, or t
tcagtcgatcacgtcacgaccggtgctcgatttagagctcacgtattgggtttgggctgagctggcttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccagggaagggctgggagtgggtctacgagcaattaagnggtaggggtnattcgacatatacgcagctcggtgggggccgttcacntcacaganacaacncaggancacactntanctaacaatgacacagtcctgaagngtcgagacacggtcctgtatattgacgcgagagatccccgaaggtcaacctaccgttggtcgtcttttagtagttttccgagtcggtaccgaagggtacctaagttcgggtaccacccggtttntacgttccgacgccctaccaccggtaacggccctacgtcggtttcccctaccccggtgggaccctcccgttaggcccttacccggaggtccgacccgtaaccgttcccggatacccgg

SEQ ID NO: 204424 - DNA, 541 bp, Homo sapiens
  misc_feature: GYAE6OF02FVXRL.38.28.C06.1.454.CMB.1.raw
  modified_base (271)..(271): a, c, t, g, unknown or other
  misc_feature (271)..(271): n is a, c, g, or t
  modified_base (503)..(503): a, c, t, g, unknown or other
  misc_feature (503)..(503): n is a, c, g, or t
  modified_base (508)..(508): a, c, t, g, unknown or other
  misc_feature (508)..(508): n is a, c, g, or t
tcagtcgatcacgtcacgaccggtgctcgatttagagctcacgtattgggtttgggctgagctggctttttcttgtggctattttaaaaggtgtccagtgtgaggtgcaggtgtcggagtctggggggaggcttggttcagcctgggggggtccctgagactctcctgtacagtctctggattaacctttagtgactatgccatgatctgggtccgccaggctccagggaaggggctgggagtgggtctcagcaattaatgggtaggggtnattcaccatattacgcagactccgtggggggccgttcaccatcaccagagacaactccaggagcacactatatctaacaaatgcacagcctgagagtcgaggacacggcgtgtattattgtgcgagagatcccaacggtgaccaccttggtgtcttttgatttctgtgccaagggacatgtcaccgtctcttcagcctccaccgaagggcccagttccggtccttcccccgnggccnccctgcctccgaggcgccacccgtccgagagcc

SEQ ID NO: 204425 - DNA, 700 bp, Homo sapiens
  misc_feature: GYAE6OF02HEQP5.38.28.C06.1.454.CMB.1.raw
  modified_base (271)..(271): a, c, t, g, unknown or other
  misc_feature (271)..(271): n is a, c, g, or t
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccgagggaagggactggagtgggtctcgagacaattaagtgggtagggtnattcacatacttacgcagacgtcggtggggggccgttcaccgatccaaccgagacgaaccaaccgtccgaaggacgaccaacgactaatactactaaaccaaaatcgaccaacagtcctggaacgacgtaccggaagggaccgaccggggtacccttggttaatttacgtttggtacgacggaagaacggacctaccccgaacgggtcgaccctaccgtttgggtcgttcgttttaggtacttttcgtggttacggacccgtaaagggactaaggttcgggtacctacccggttcttccgttacgaccgtccctacccgaacccggaaccgggtcccctacgttcccgggtacccctttcccccggtcggtccccgtcccgtccgcccgtaccggacgggacctcccgaacccgtaccggacgtaccgg

SEQ ID NO: 204426 - DNA, 628 bp, Homo sapiens
  misc_feature: GYAE6OF02HDLQ5.38.28.C06.1.454.CMB.1.raw
  modified_base (482)..(482): a, c, t, g, unknown or other
  misc_feature (482)..(482): n is a, c, g, or t
tcagtcgatcacgtcacgaccggtgctcgatttagagctcacgtattgggtttgggctgagcgtgcgttttctaggtggctattttaaaaggtgtccagtgtgaggtgcaggtgtcggagtctgggggaggcttggttcagcctggggggtccctgagactctcctgtgcagtctctggatttaacctttagtgactatgccatgatctgggtccgccaggctcgaggggagggctggagtgggtctcgagcaattaagtgggtaggggtgattccaacattattacgcagtacctccgggtggggggccgttacaccaatccaaccaggacgaaccaactccgaggataccacactatatctaacaaatgacaacagcctagagagtcgacggacgacggccgtagttaattagtttggacgcgaggtagactacccgaaggtcgacccgtacgttggtacgttcctttagtattttccgnggtacgaccgtaaagggctaagtcggtacctaccgtcttcgttacacgtcccaccgtaaccgaacgggtcccctaggttaccggtccccttcccgtggccctacccgtgccctacggacggtaccgcccgtaccgtaccgagaccg

SEQ ID NO: 204427 - DNA, 546 bp, Homo sapiens
  misc_feature: GYAE6OF02GHPFY.38.28.C06.1.454.CMB.1.raw
  modified_base (372)..(372): a, c, t, g, unknown or other
  misc_feature (372)..(372): n is a, c, g, or t
  modified_base (417)..(417): a, c, t, g, unknown or other
  misc_feature (417)..(417): n is a, c, g, or t
  modified_base (481)..(481): a, c, t, g, unknown or other
  misc_feature (481)..(481): n is a, c, g, or t
tcagtcgatcacgtcacgaccggtgctcgatttagagctcacgtattgggtttgggctgagcgtggcttttcttgtggctattttaaaaggtgtccagtgtgaggtgcaggtgtcggagtctgggggaggcttggttcagcctggggggtccctgagactctcctgtgcagtctctgcattcaccttttagtaactatttaatgagctgggtccgccagcctccgagggaaggggctgggagtgggtggccagcattaaccaagatggacgtgaaaaaatctaatgtggactctgtgaagggccgattcgccatctccagagacaacgccaagaactcactgtggctgcacatgaacgctgagagcgacganacggctgtgtactttcagtgcgagacgcccccagtgaggctacgngtgggagctacgtactttgactacgtggggccacgggaccctggtccaccgtctcctcacgccnccgaccacgggcccagtccggtcctccccgtgcctacccgtccaccgacgcgccaccgtgtcggg

SEQ ID NO: 204428 - DNA, 618 bp, Homo sapiens
  misc_feature: GYAE6OF02HSFKO.38.28.C06.1.454.CMB.1.raw
  modified_base (307)..(307): a, c, t, g, unknown or other
  misc_feature (307)..(307): n is a, c, g, or t
  modified_base (326)..(326): a, c, t, g, unknown or other
  misc_feature (326)..(326): n is a, c, g, or t
  modified_base (340)..(340): a, c, t, g, unknown or other
  misc_feature (340)..(340): n is a, c, g, or t
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccagggaaggggctgggagtgggtctcagcaattatggtaggggtgattcacatattacgcagactcggtgggggccgttcaccgntcaccagagacaactcagncacacatatctaanaaatcgacaacacgcctgagagtcgaaggacacggctagttattagtgtgcgagagactaccgaacggtacgacctaccttggtcttctttagtacttttcgtgtacggacgaagggaactaagtcggtactaccgttctacgttacgacgtcccctaccgaacccgtaacgggccctacgttcccggttccgttaccccccggtggtcccgtccccgttaccggtccccttaccggaccgggtaacgccccgtaacccggtcccggacggaacccgg

SEQ ID NO: 204429 - DNA, 180 bp, Homo sapiens
  misc_feature: GYAE6OF02HFCWN.38.28.C06.1.454.CMB.1.raw
  modified_base (175)..(180): a, c, t, g, unknown or other
  misc_feature (175)..(180): n is a, c, g, or t
tcagtcgatcacgtcacgaccggtgctcgatttagagctcacgtattgggtttgggggaagaggaagactgacggtcctgctccaggagcacctccgagagcacagcggccctgggctgcctggtcaaggactacttccacgtgatcgactgagcgggctggcaaggcgcatagnnnnnn

SEQ ID NO: 204430 - DNA, 630 bp, Homo sapiens
  misc_feature: GYAE6OF02IJQ15.38.28.C06.1.454.CMB.1.raw
  modified_base (193)..(193): a, c, t, g, unknown or other
  misc_feature (193)..(193): n is a, c, g, or t
  modified_base (271)..(271): a, c, t, g, unknown or other
  misc_feature (271)..(271): n is a, c, g, or t
  modified_base (297)..(297): a, c, t, g, unknown or other
  misc_feature (297)..(297): n is a, c, g, or t
  modified_base (333)..(333): a, c, t, g, unknown or other
  misc_feature (333)..(333): n is a, c, g, or t
  modified_base (479)..(479): a, c, t, g, unknown or other
  misc_feature (479)..(479): n is a, c, g, or t
  modified_base (513)..(513): a, c, t, g, unknown or other
  misc_feature (513)..(513): n is a, c, g, or t
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctgggggggtccctgagactctcctgtgcagtctctggatttaacctttagngactatgccatgatctgggtccgccaggctccgagggagggctggagtggtctacagctaattaagtgggtaggggtnattccgacatattacgcagactcggngggggccttcaccatcaccagagacaactccaggancacaactataatctaaacaaatgacacacgtcctagagtagtacggaaggaccacgggccttagttaactttagtttggtagacgaggacgtacgtacccgaaacgggtgaaccctaccgttggttacgtcgttttagattttcgngttacggtaccgaaagggtacaagtcggttaccnccgtttctcttccgaacgccctaccacccgtaacggcccgtacgtccgttacccgttccccgtccggcccggtcccgtcgtccgtccgacggtaccggcctaccgcccgtagaccgg

SEQ ID NO: 204431 - DNA, 181 bp, Homo sapiens
  misc_feature: GYAE6OF02FKMGU.38.28.C06.1.454.CMB.1.raw
  modified_base (175)..(181): a, c, t, g, unknown or other
  misc_feature (175)..(181): n is a, c, g, or t
tcagtcgatcacgtcacgaccggtgctcgatttagagctcacgtattgggtttgggggaagaggaagactgacggtcctgctccaggagcacctccgagagcacagcggccctgggctgcctggtcaaggactacttccacgtgatggactgagcgggctggcaaggcgcatagnnnnnnn

SEQ ID NO: 204432 - DNA, 636 bp, Homo sapiens
  misc_feature: GYAE6OF02GQDHJ.38.28.C06.1.454.CMB.1.raw
tcagtcgatcacgtcacgaccggtgctcgatttagagctcacgtattgggtttgggctgagcgtggcgttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccagggaagggctggagtgggtctcagcaattaagtggtaggggtgattcaccatattacgcagactccggtgggggccgttcaccatcaccagagacaactccaggagcacactatatctaacaaatgacacagcctgagagtcgaggacacggctgtattattgtgcgagagactcccgaaacggtgaccctaccgttgggtctcgttttgattttcgtggtcggaccaaaggggtacctaaagttcgggtacctaacccggttcgttacctttacgacgtccccgttacccgaaacccgtaacgggtccccagttcccgggttccccgtttccccccgtagggccccgtcccccgttacggtcccttacccggtacgggaccgaccccgtacccgtcccggaaggtacccg

SEQ ID NO: 204433 - DNA, 672 bp, Homo sapiens
  misc_feature: GYAE6OF02JYJ3R.38.28.C06.1.454.CMB.1.raw
  modified_base (359)..(359): a, c, t, g, unknown or other
  misc_feature (359)..(359): n is a, c, g, or t
  modified_base (374)..(374): a, c, t, g, unknown or other
  misc_feature (374)..(374): n is a, c, g, or t
tcagtcgatcacgtcacgaccggtgctcgatttagagctcacgtattgggtttggggtctgagagaggagcccagccctgggattttcaggcgttttcatttggtgatcaggactgaacagagagaactcaccatggagtttgggctgagcgtggcgttttctagtggctattttaaaggtgtccagtgtgaggtgcaggtgtcggagtcgtgggggaggcttggttcaggccgtggggggtccctgagactctcctgtgcagtctctggattaaccttagtgactatgccatgatctgggtaccgccaggcctccgaggggaagggcctgggagtgggtctacgagactaagttaagngggttaacgggggtnagttaccacgtaattacgttacgactaacgtaccgttcccggggttgggggggtaccccgtttacgaaccctagttcccgaaccgaggtaaccgaaccgtaacctacccgaaggacgacaacctaactactaactacctaacaaacgttcgacaacacgaccgttgaacggagtaccggaggaccgacgggtaccgttggtaacttagttgtacgtaggacggtaacgtaccgtacccggtaacggttacgaacccgtaacggtttcggtcgtttccgtttagttactttcgtacggg

SEQ ID NO: 204434 - DNA, 612 bp, Homo sapiens
  misc_feature: GYAE6OF02IK0JY.38.28.C06.1.454.CMB.1.raw
  modified_base (334)..(334): a, c, t, g, unknown or other
  misc_feature (334)..(334): n is a, c, g, or t
  modified_base (396)..(396): a, c, t, g, unknown or other
  misc_feature (396)..(396): n is a, c, g, or t
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctgggggggtccctgagactctcctgtgcagtctctggattaacctttagtgactatgccatgatctgggtccgccaggctccgagggaaggggctggagtgggtctcagcaattaagtgggtaggggtgattcaccatattacgcagactccggtgggggccgttcaccatcaccagagacaactccaggancacactatatctaacaaatgacacagcctggagagtcgaaggacacggcgtagtattattgngcgagagactacccgaacggtcgacctaccgttgggtcgttcttttgtattttcgtggtcggaccgaaaggggactaagttcggtacacccgttcttcttacacgtccctcccgaaccgacgggtccccacgttcccgggttccctttccccccgtagggccccgtccccgttcgcccgttcccgaagggaccgaccctacccgtccggagtaccg

SEQ ID NO: 204435 - DNA, 609 bp, Homo sapiens
  misc_feature: GYAE6OF02FQCX5.38.28.C06.1.454.CMB.1.raw
  modified_base (388)..(388): a, c, t, g, unknown or other
  misc_feature (388)..(388): n is a, c, g, or t
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccagggaaggggctggagtgggtctcagcaattaagtgggtaggggtgattcaccatattacgcagactccggtggggggccgttcaccatcaccagagacaactccaggagcacactatatctacaaatgcacagcctgagagtcgaggacacggctgtattatgngcgagagatcccaaggtcacctaccgttggtgtcttttgatttctgtcggccaagggacaagttcggtactaccgtcttcttcacgtccctaccaaccgaacgggcccctagttcccgggtaccctttcccccccggtagggtcccccgtcccccgttcggcccttaccccggaaggggtacccgtcccctaacccccggttacccgggaacgtaacccgg

SEQ ID NO: 204436 - DNA, 980 bp, Homo sapiens
  misc_feature: GYAE6OF02JE10Q.38.28.C06.1.454.CMB.1.raw
  modified_base (185)..(185): a, c, t, g, unknown or other
  misc_feature (185)..(185): n is a, c, g, or t
  modified_base (207)..(207): a, c, t, g, unknown or other
  misc_feature (207)..(207): n is a, c, g, or t
tcagtcgatcacgtcacgaccggtgctcgatttagagctcacgtattgggtttgggctgagctggcttttcttgtggctatttaaaggtgtccagtgtgaggtgcaggtgtcggagtctggggagcttggttcagcctgggggtccctgagactctcctgtgcagtctctggattaacctttagngactatgccatgatctggtccncaggctccgaggggaacgggctgggacgtgggtcctcgaggcaaatttaagtggggtaacgggggttgacgtttcaaccgtattaacgtttaccggctaggaaccttcccgggtggggggggtccccggtttcaacccgtaagttccgaacccgaggaacggaacctaaaccgttcccaaggggacaccaacctaaccgttaagttaactccgttaaaccaaaaattcggacctaaaccgaacggtccccttagggaaacgtaacggttacccggaaacggggaaccgaacccggggtaccccggtttaggtaaaccgtttttaaacgtttgggttcgggaacccgggtaaagggtaacggtaaaccgtttacccccccggaaaaggggtttaccggaaaccccgtttaacccgtttgggggttccgttaccgtttttttttaacggggaacttttttttaccccggttgggtttacccggggaacccttaaaaacgggggggtaacccttaaaaggtttccgggggtttaaccctaacccgggtttcctttacccggttttacccgaaaccggttcccccttacccgtaaaccccggtaaaacgggggtcccccccttaaaggttcccccgggggtttaaccccctttttcccccccccgggaggggttacccccggtaccccccgttacgggttccccgtttacccccggaacgggggtttacccgaccccgttaaccccccggtttaccccggggaacggttaaccccgg

SEQ ID NO: 204437 - DNA, 671 bp, Homo sapiens
  misc_feature: GYAE6OF02FY4VX.38.28.C06.1.454.CMB.1.raw
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccagggaagggctggagtgggtctcagcaattaatggtaggggtgattcaccatattacgcagactccggtgggggccgttcaccatcaccagagacaactccaggagcacactatatctaacaaatcgcacagcctgagagtcgaggacacggcgtgtattagttgtgcgagagactaccccgaagggttcgaaccctaccgtttgggtcgtcgtttttggactttttcgtggttacgggacccgtaaaggggtacctaaagttcgggtacctacccggttccttcgtttaccacgtccccttacccgaacccgaaacggggtccccaagtttccccgggtacccttttcccccccggagggtccccgtaccccccgtttggtacccccgttcccggaaccggggtacccgtaccccgtaacccccggttacccggaaggtaaccccgg

SEQ ID NO: 204438 - DNA, 645 bp, Homo sapiens
  misc_feature: GYAE6OF02H2OY7.38.28.C06.1.454.CMB.1.raw
  modified_base (214)..(214): a, c, t, g, unknown or other
  misc_feature (214)..(214): n is a, c, g, or t
  modified_base (245)..(245): a, c, t, g, unknown or other
  misc_feature (245)..(245): n is a, c, g, or t
  modified_base (256)..(256): a, c, t, g, unknown or other
  misc_feature (256)..(256): n is a, c, g, or t
  modified_base (267)..(267): a, c, t, g, unknown or other
  misc_feature (267)..(267): n is a, c, g, or t
  modified_base (326)..(326): a, c, t, g, unknown or other
  misc_feature (326)..(326): n is a, c, g, or t
  modified_base (401)..(401): a, c, t, g, unknown or other
  misc_feature (401)..(401): n is a, c, g, or t
  modified_base (407)..(407): a, c, t, g, unknown or other
  misc_feature (407)..(407): n is a, c, g, or t
  modified_base (444)..(444): a, c, t, g, unknown or other
  misc_feature (444)..(444): n is a, c, g, or t
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttgtgactatgccatgatcgtgggtccnccaggctcgagggaagggctggagtgggtcncagcaaattangggtaggggtnattcacatattagcagactcggtgggggccgttcacatcaccgagagacaactcaggancactactatatctaacaaagtcgacaacacgtcctagacgtaagcgaaggaccacggtcctagtaacttagttgngacganagtacctaacccgacggtcaaccgtaccgtttgggtnttcgtttgttacttttcgaggttcggaaccgtaaggtaacgtaagttcggtacctacccgtcttccgttacgacgtcccctaccgaaccggaacgggccctaacggttcccggttccccttaccccggtcggtccccggtacccttccggtaccgttacccggagggttaccaccccgtacccgtacccggacgaacccgg

SEQ ID NO: 204439 - DNA, 614 bp, Homo sapiens
  misc_feature: GYAE6OF02J2LQL.38.28.C06.1.454.CMB.1.raw
  modified_base (258)..(258): a, c, t, g, unknown or other
  misc_feature (258)..(258): n is a, c, g, or t
  modified_base (309)..(309): a, c, t, g, unknown or other
  misc_feature (309)..(309): n is a, c, g, or t
  modified_base (457)..(457): a, c, t, g, unknown or other
  misc_feature (457)..(457): n is a, c, g, or t
  modified_base (555)..(555): a, c, t, g, unknown or other
  misc_feature (555)..(555): n is a, c, g, or t
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccgagggaagggctgggagtgggtctcagcaattaangggtagggtgattcacatattacgcagactccggtggggggccgttcaccntccaccagagacaactccgaggagcacactatactctaacaaatgaccacagcctagacgagtcggaaggaccgacggtccgtagtattagtgtgacgagagactacccgaacggtcaacctcgttggtacgtctttagacttttcgnggtcggaccgtaagggactaagtcggtacctaccggttctacgttcacgtccctaccgaaccgtacgggccctagttcccggttacccgttcccccgnggtccgtccccgtcgcccgttacccggaggacccgtcccgacccgtacggagtacccgg

SEQ ID NO: 204440 - DNA, 591 bp, Homo sapiens
  misc_feature: GYAE6OF02HWB6Y.38.28.C06.1.454.CMB.1.raw
  modified_base (361)..(361): a, c, t, g, unknown or other
  misc_feature (361)..(361): n is a, c, g, or t
  modified_base (500)..(500): a, c, t, g, unknown or other
  misc_feature (500)..(500): n is a, c, g, or t
tcagtcgatcacgtcacgaccggtgctcgatttagagctcacgtattgggtttggggtctgagagaggagcccagccctgggattttcaggcgttttcatttggtgatcaggactgaacagagagaactcaccatggagtttgggctgagcgtggcttttctgtggctattttaaaaggtgtccagtgtgaggtgcaggtgtcggagtctgggggaggcttggttcagcctgggggggtccctgagactctcctgtgcagtctctggtattaacctttagtgactatgccatgatcgtggtccgcaggctccgagggaaggggctggagtgggtctcgagctaattaagtgggtaggggtnagttcacctatattacgcagacgtccgggtgggggccgttcaccatccacgagtagaacaactccgaggagacactactaatatactaacaaatcgaccactacgcctaggagaggtccggaagacgaccggtccggtnttaatttagttgtgacggtaagcggtaacctacccggaaacggttcgaacccgttccgttggtccggttactttttgacttttcggtcggg

SEQ ID NO: 204441 - DNA, 852 bp, Homo sapiens
  misc_feature: GYAE6OF02HB74K.38.28.C06.1.454.CMB.1.raw
  modified_base (214)..(214): a, c, t, g, unknown or other
  misc_feature (214)..(214): n is a, c, g, or t
  modified_base (269)..(269): a, c, t, g, unknown or other
  misc_feature (269)..(269): n is a, c, g, or t
tcagtcgatcacgtcacgaccggtgctcgatttagagctcacgtattgggtttgggctgagcgtggcttttcttgtggctattttaaaaggtgtccagtgtgaggtgcaggtgtcggagtctgggggaggcttggttcagcctggggggtccctgagactctcctgtgcagtctctggatttaaccttagtgactatgccatgatctgggtccncaggctcagggagggctggagtgggtctcagctaaagttaagtgggtagggggtnacttcgaacctataattaccgcaggaccgttcccgggtgggggggcccgttacaccgatccaccgagagaccaactccgaaggactcacactactatctaacaaatcgaccacgagcctagtacgaggtacgaagggtaccaaccggggtccgttagttacgtttaagttcggtaggacggtacgtaacggaaccgttaccccgtaaacggggttcccgtaaacccgttacccggtttacggggttaccgtttacccgttttttaggttaaaccgttttttcgttacgggttaccggggtaacccgggttaaacgggggtaaaccttaacgggtttacggggttacccccttaacccgggtttcccgtttacccttttaccggaaccggttacccccctaaaccccggtaaaccccgggtaaaccgggggtcccccttaaaccggtttcccggggttttaaccccctttccccccgggttaacggggggccccccttcccccggttcgggtaacccccgttaccccggaaggggtaccccgccccggttaaaccccggttaccccggggaactaaccccgggg

SEQ ID NO: 204442 - DNA, 527 bp, Homo sapiens
  misc_feature: GYAE6OF02FSEYI.38.28.C06.1.454.CMB.1.raw
  modified_base (301)..(301): a, c, t, g, unknown or other
  misc_feature (301)..(301): n is a, c, g, or t
  modified_base (369)..(369): a, c, t, g, unknown or other
  misc_feature (369)..(369): n is a, c, g, or t
  modified_base (421)..(421): a, c, t, g, unknown or other
  misc_feature (421)..(421): n is a, c, g, or t
  modified_base (424)..(424): a, c, t, g, unknown or other
  misc_feature (424)..(424): n is a, c, g, or t
  modified_base (513)..(513): a, c, t, g, unknown or other
  misc_feature (513)..(513): n is a, c, g, or t
  modified_base (523)..(523): a, c, t, g, unknown or other
  misc_feature (523)..(523): n is a, c, g, or t
tcagtcgatcacgtcacgaccggtgctcgatttagagctcacgtattgggtttgggggtctgagagaggagcccagccctgggattttcaggcgttttcatttggtgatcaggactgaacagagagaactcaccatggagtttgggctgagctggcttttcttgtggctattttaaaggtgtccagtgtgaggtgcaggtgtcggagtctgggggaggcttggttcagcctggggggtccctgagactctcctgtgcagtctctggattaacctttagtgactatgccatgatctggtccncaggctccgagggagggctggagtgggtctcagcaattaatgggtaggggtgattcaccatattacgnacgactccggtggggggccgttcaccatcaccgagacgacaactccaggacncanactatatacacaaatgacacagctgagagtcgaggacacggcctagtattagttgtgcgagagactcccgaaggtcgacctcgtgtcgnttttcgattntcgg

SEQ ID NO: 204443 - DNA, 683 bp, Homo sapiens
  misc_feature: GYAE6OF02IKUUY.38.28.C06.1.454.CMB.1.raw
tcagtcgatcacgtcacgaccggtgctcgatttagagctcacgtattgggtttgggctgagcgtggcgttttcttagtggctattttaaaaggtgtccagtgtgaggtgcaggtgtcggagtctggggggaggcttggttcaggcccggggggtccctgagactctcctgtgcagtctctggatttaacctttagtgactatgccatgattcgtgggtcccgccaggcctccgaggggaacggggtctgggaggtgggtctcgagactaattaagtgggtaggggtgacttcaccatattacgcagactccggtgggggtccgtcgaccatcaccgaggacgacaactccgaggagcacactatatactaacaatcgacaacgacgcctagaggtacggtacggaaggaccgacgggtccgttagttaagttacgtttaggtcgacgtagagtaacctccccggaacggtacgaccctacgttggtacttcgtttgtatttcgtagtggaccgaagggtactaacggttcgtcctaccgttcttaccgtttacgccgtaccctacccgaacccggtaaaccgggcccctacggttcccgttccccgtttacccgccgggtccccgtcccgtcgaccccgttcggacgggtactacccctaacccggtcggaacgcggtacccg

SEQ ID NO: 204444 - DNA, 819 bp, Homo sapiens
  misc_feature: GYAE6OF02H6ZTS.38.28.C06.1.454.CMB.1.raw
tcagtcgatcacgtcacgaccggtgctcgatttagagctcacgtattgggtttgggctgagcgtggcgttttctggtggctattttaaaaggtgtcagtgtgaggtgcaggtgtcggagtctgggggaggcttggttcaggccgtggggggtccctgagactctcctgtgcagtctctggattaacctttagtgactatgccatgatcgtgggtccaccgaggtctccgaaggggaaggggcctgggaggttggggtcctacgaggacaaatttaaagtggggttaagggggctaattccaacctaattaattacggacaaggtacctccgggtggggggggcccgtttacaacccataccgaaccaggagaaccaaacttcccggaaggagaccacctaacttaataggttactaaacaaaagttggaacccattaaacggccctttagaacggtagtaccgggaaggaccaaacgggttcccgggtagtactttaaagttttccggtaggacggaaggttaacgaacttaccccggtaaaacgggtcggaaaccctaacccgtttaggggtacggtttccgtttttagaactttttcgtttaggtcgggaacccgtaaagggggaacccttaaagttcggggtaccctaaccggtccttaccgtttacacggaacccttccccgaaacgtaaaccggggccctaacggttcccgggtttaaccccttttccccccggacgggcccggtttaccccgcggtttcccgtaccggtaaccgggtacggtaacccaccccgtttacccggaggaaacccgg

SEQ ID NO: 204445 - DNA, 431 bp, Homo sapiens
  misc_feature: GYAE6OF02F2WYE.38.28.C06.1.454.CMB.1.raw
  modified_base (385)..(385): a, c, t, g, unknown or other
  misc_feature (385)..(385): n is a, c, g, or t
  modified_base (419)..(431): a, c, t, g, unknown or other
  misc_feature (419)..(431): n is a, c, g, or t
tcagtcgatcacgtcacgaccggtgctcgatttagagctcacgtattgggtttgggctgagctggctttttcttgtggctattttaaaagactccgtggggggccggttcaccatcaccagagacaactccaggagcacactatatctacaaatgcacagcctgagagtcgaggacacggccgtgtattattgtgcgagagatcccaacggtgaccaccttggtgcttttgatttctgtggccaagggacaatggtcaccgtctcttcagcctccaccaagggcccatcggtcttcccccctggccgcccctgcctcccgaggacgccacctccgagagcacagccggcccgtgggcctgcctggtcaacggctacttccacgtnatcgactgagcgggctgggcaacggcgcagtagnnnnnnnnnnnnn

SEQ ID NO: 204446 - DNA, 559 bp, Homo sapiens
  misc_feature: GYAE6OF02G9LY1.38.28.C06.1.454.CMB.1.raw
  modified_base (521)..(521): a, c, t, g, unknown or other
  misc_feature (521)..(521): n is a, c, g, or t
  modified_base (541)..(541): a, c, t, g, unknown or other
  misc_feature (541)..(541): n is a, c, g, or t
tcagtcgatcacgtcacgaccggtgctcgatttagagctcacgtattgggtttgggctgagctggctttttcttgtggctattttaaaaggtgtccagtgtgaggtgcaggtgtcggagtctggggggaggcttggttcagcctggggggtccctgagactctcctgtgcagtctctggattaacctttagtgactatgccatgatctgggtccgccaggctccagggaggggctgggagtgggtctcagcaattaatgggtaggggtgattcaccatattacgcagactccgtggggggccgttcaccatcaccagagacaactccaggagcacactatatctacaaatgacacagcctgagagtcgaggacacggccgtgtattatgtgcgagagatccccaaggtcgaccacttgggtgtcgttttgattttctgttcggccgaagggactaagtggtccaccgtctcttcacgcctaccaccgaacgggcccagtccggtccttcccccgtggcccncccgtgccctccgacggacnccgtaccgtccgagaccg

SEQ ID NO: 204447 - DNA, 422 bp, Homo sapiens
  misc_feature: GYAE6OF02FITOY.38.28.C06.1.454.CMB.1.raw
  modified_base (305)..(305): a, c, t, g, unknown or other
  misc_feature (305)..(305): n is a, c, g, or t
  modified_base (408)..(422): a, c, t, g, unknown or other
  misc_feature (408)..(422): n is a, c, g, or t
tcagtcgatcacgtcacgaccggtgctcgatttagagctcacgtattgggtttgggctgagctggctttttcttgtggctattttaaaagactccgtggggggccggttcaccatcaccagagacaactccaggagcacactatatctacaaatgcacagcctgagagtcgaggacacggccgtgtattattgtgcgagagatcccaacggtgaccaccttggtgcttttgatttctgtggccaagggacaatggtcaccgtctcttcagcctccaccaagggcccatcggtcttccccctggcnccctgctccaggagcaccctccgagagcacagccggccctgggctgcctgggtcaaggctacttcccacgtgatcgactgagcgggctggcaaggcgcatagnnnnnnnnnnnnnnn

SEQ ID NO: 204448 - DNA, 655 bp, Homo sapiens
  misc_feature: GYAE6OF02FFMS1.38.28.C06.1.454.CMB.1.raw
  modified_base (331)..(331): a, c, t, g, unknown or other
  misc_feature (331)..(331): n is a, c, g, or t
  modified_base (340)..(340): a, c, t, g, unknown or other
  misc_feature (340)..(340): n is a, c, g, or t
  modified_base (349)..(349): a, c, t, g, unknown or other
  misc_feature (349)..(349): n is a, c, g, or t
tcagtcgatcacgtcacgaccggtgctcgatttagagctcacgtattgggtttggggtctgagagaggagcccagccctgggattttcaggcgttttcatttggtgatcaggactgaacagagagaactcaccatggagtttgggctgagctggctttttcttgtggctattttaaaaggtgtccagtgtgaggtgcaggtgtcggagtctgggggaggcttggttcagccgtggggggtccctgagactctcctgtgcagtctctggattaacctttagtgactatgccatgatctggtccgcaggctccagggaggctggagtgggctngctaattangggtagggngattcgacatactacgcagacgtccggtggggggcccgttcaccgatccaccagacgaccaacgtccgaggacgacaaccgactaagttactacctaaactaaagtcgaccaacgacgtacccgtaggaacggacggttaccgaagggaacctacggggtcccgttagttaagttttagttcggttacggaccggtaacggaacggtaaccgtaaccccggtaaaccggggttaccgaaccccgttaacccgggtttagggttaccggtttacgttttttacggtaccgtttttccgttaacgggg

SEQ ID NO: 204449 - DNA, 661 bp, Homo sapiens
  misc_feature: GYAE6OF02HD5WX.38.28.C06.1.454.CMB.1.raw
tcagtcgatcacgtcacgaccggtgctcgatttagagctcacgtattgggtttgggctgagctggcttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccgagggaaggggctgggagtgggtctcagcaattaagtgggtaggggtgattcaccatattacgcagactccggtggggggccgttcaccatccaccagagacaactccgaggagcacactatactctaacaaatcacacagcctgagagtcggaggacgacggccgtagttacttagttgtgacgagagactaccccgaaacgggtcaaccctaccgttgggtcttcttttagtacttttcgtaggtcggtaccgtaaaggggtactaagttcggtacctacccgttcttaccgttcgaccgtcccctacccgaacccggtaaccgggcccctacgttcccggggtttcccttccccccggtcgggtcccctccccgttcggtaccccttacccggaacgggtcccgaccccggtacccgttcccggaacggtacccgg

SEQ ID NO: 204450 - DNA, 833 bp, Homo sapiens
  misc_feature: GYAE6OF02HLITS.38.28.C06.1.454.CMB.1.raw
  modified_base (220)..(220): a, c, t, g, unknown or other
  misc_feature (220)..(220): n is a, c, g, or t
  modified_base (281)..(281): a, c, t, g, unknown or other
  misc_feature (281)..(281): n is a, c, g, or t
tcagtcgatcacgtcacgaccggtgctcgatttagagctcacgtattggggtttgggctgagcgtggctttttcttgtggctaattttaaaaggtgtccagtgtgaggtgcaggtgtcggagtctgggggaggcttggttcagccgtggggggtccctgagactctcctgtgcagtctctggatttaacctttagtgactatgccatgatcgtgggtccncgaggctccgagggaggggctgggagtgggtctcgagactaaattaagtgggtagggggtntattaccaacctaattaagttaaccggcaacggtaccgttcccggggtaggggggggacccgtttaccaaccaagtaccaaccgaaggtacgaaccaaaccgtccgaagggacgaccaacaacttaatactacctaaacaaatcgacctaacgacgccgtagaagtacgtacggaacggtaaccgacggggtaccgttagttagtttaacgtttcggaggacggtaacgacgtaaccgttacccccggtaaacgggttaccgaacccgttaaccggtttcgggttacggtttaccttttttaggttacgtttttacgtggggtaccggtaaccgtaaagggtacctaaaggttcggtaccgtaacccggttctttaccgttacgaccgtaccccgtaacccgaaacccgtaaccggggtacccctaaggttccccgggtttacccccgtttccccccggtaacggggtcccccgtacccccgtacggttaccctacccgggaacgggtaccgtacccccggtaaccccgttacccgggaacggtaaccccgg

SEQ ID NO: 204451 - DNA, 613 bp, Homo sapiens
  misc_feature: GYAE6OF02IWEEM.38.28.C06.1.454.CMB.1.raw
  modified_base (329)..(329): a, c, t, g, unknown or other
  misc_feature (329)..(329): n is a, c, g, or t
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggccgcaggctcgagggagggctggagtgggtctcagcaaattaagtgggtaggggtgattcaccatattacgcagactcggtggggggccgttcaccatcaccagagacaactccaaggncacactatatctaacaatgacaacgagcctagagagtcgaaggaccacggcgtagttattagtttcgtgacgagacgactaccccgaaggtcaaccgtacttggtcgttcttttgacttttcgtgtggtaccgaagggaactaagtacggtacctaaccggttctccttactacgtccctaccgaacccgaacggccctacgttccggttaccccgttccccccgtgggcccgtacccgcggtcccgtaccgacggacgtcccgtaccccgtacggacgaccgg

SEQ ID NO: 204452 - DNA, 622 bp, Homo sapiens
  misc_feature: GYAE6OF02GP3UK.38.28.C06.1.454.CMB.1.raw
  modified_base (353)..(353): a, c, t, g, unknown or other
  misc_feature (353)..(353): n is a, c, g, or t
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccgaggggaaggggctgggagtgggtctcagcaattaagtgggtaggggtgattcaccatattacgcagacgtccggtgggggccgttcaccatcaccagagacaactcgaggacgcacactatatactaanaaatgacacacgcctagagagtcgaggacgacggtcgtagtattatgtgcgagagactacccgaacggtcgaaccctacgttggtcgttcgttttgtacttttcgtaggtcggacccgaaaggggactaaagttcggtacctacccgttccttcgttaccgacgtccccttaccgaaccgaacgggtccctacgttcccggttcccgttcccccgtggcccgtcccgttcgccctccggacggtacgacccgtaccgtaccgaggtacg

SEQ ID NO: 204453 - DNA, 577 bp, Homo sapiens
  misc_feature: GYAE6OF02F2OHB.38.28.C06.1.454.CMB.1.raw
  modified_base (267)..(267): a, c, t, g, unknown or other
  misc_feature (267)..(267): n is a, c, g, or t
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccagggaaggggctggagtgggtctcagcaattaatggtaggggtnattcaccatattacgcagactccggtggggggcccggttcaccatcaccagagacaactccaggacgcaacactatatctaacaaatgcacagcctgagagtcgaggacacggccgtgtattatgtgcgagagactcccaacgggtcaacctaccgttggtcgtcttttgattttcgtggtcggcaaagggacaaagttggtcacccgttcttccttcacgtccctccaaccgaacgggccctagtccggtccttcccccgtggccctcccgttgccctccgaggaccgcctacccgtccggagtaccgg

SEQ ID NO: 204454 - DNA, 637 bp, Homo sapiens
  misc_feature: GYAE6OF02H4RKU.38.28.C06.1.454.CMB.1.raw
  modified_base (212)..(212): a, c, t, g, unknown or other
  misc_feature (212)..(212): n is a, c, g, or t
  modified_base (268)..(268): a, c, t, g, unknown or other
  misc_feature (268)..(268): n is a, c, g, or t
  modified_base (332)..(332): a, c, t, g, unknown or other
  misc_feature (332)..(332): n is a, c, g, or t
  modified_base (339)..(339): a, c, t, g, unknown or other
  misc_feature (339)..(339): n is a, c, g, or t
  modified_base (343)..(343): a, c, t, g, unknown or other
  misc_feature (343)..(343): n is a, c, g, or t
  modified_base (354)..(354): a, c, t, g, unknown or other
  misc_feature (354)..(354): n is a, c, g, or t
tcagtcgatcacgtcacgaccggtgctcgatttagagctcacgtattgggtttgggctgagctggcttttcttgtggctattttaaaaggtgtccagtgtgaggtgcaggtgtcggagtctgggggagcttggttcagcctggggggtccctgagactctcctgtgcagtctctggattaacctttagtgactatgccatgatctgggtccnccaggctccgaggggaagggctggacgtgggtctcagcaagttaatggtaggggtnattcgaccatatcgcagacgtccggtgggggccgttcaccatcacagagacaactcagatcaanactatanctanaaatgacacanccgtagagagtcggagaccgaggtccgtagtaattacgtggttacgagacgagtactacccgaacggtcgaactaccgtttggcttacttttagacttttcgacggtacgtacgaagggtaactaaggttcggtaacctaccgttcttaccgttacgacgttcccgtaccaaacgggtacggacccctagttaccccggttccgtaaccccccggttggccccgtaccgtccggcccgttaccgtaacgggcccgtaaccttaccccggtaccggagacccgg

SEQ ID NO: 204455 - DNA, 205 bp, Homo sapiens
  misc_feature: GYAE6OF02HPHH4.38.28.C06.1.454.CMB.1.raw
  modified_base (175)..(205): a, c, t, g, unknown or other
  misc_feature (175)..(205): n is a, c, g, or t
tcagtcgatcacgtcacgaccggtgctcgatttagagctcacgtattgggtttggggggaagaggaagactgacggtcctgctccaggagcacctccgagagcacagcggccctgggctgcctggtcaaggactacttcacgtgatcgactgagcgggctggcaaggcgcatagnnnnnnnnnnnnnnnnnnnnnnnnnnnnnnn

SEQ ID NO: 204456 - DNA, 607 bp, Homo sapiens
  misc_feature: GYAE6OF02HZK5M.38.28.C06.1.454.CMB.1.raw
  modified_base (215)..(215): a, c, t, g, unknown or other
  misc_feature (215)..(215): n is a, c, g, or t
  modified_base (358)..(358): a, c, t, g, unknown or other
  misc_feature (358)..(358): n is a, c, g, or t
  modified_base (405)..(405): a, c, t, g, unknown or other
  misc_feature (405)..(405): n is a, c, g, or t
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatcgtgggtccnccaggctccgagggaagggctggagtgggtctcagctaaagttaagtgggtaggggtgtattcacctattacttacgcagacgtccggtgggggtccgttcaccatcaccagagacaactccgaggagcacactatatactanaaatgacacagcctgagacgtcgacggacacggcgtgtatttagtgngcgagagactcccgaaggtcgacctacgtggtcgttcttttgtactttcgttggtcggtaccgtaaagggtactaagttcggtaccgaccgttcttccttcgacgtccctaccaaccgtacggccctacgtccggttacccttccccgtcggtccgtccctcgcccgtccggacggtaccgaccgacccgtccggagtaccg

SEQ ID NO: 204457 - DNA, 182 bp, Homo sapiens
  misc_feature: GYAE6OF02GFUGM.38.28.C06.1.454.CMB.1.raw
  modified_base (175)..(182): a, c, t, g, unknown or other
  misc_feature (175)..(182): n is a, c, g, or t
tcagtcgatcacgtcacgaccggtgctcgatttagagctcacgtattgggtttgggggaagaggaagactgacggtcctgctccaggagcacctccgagagcacagcggccctgggctgcctggtcaaggactacttccacgtgatcgactgagcgggctggcaaggcgcatagnnnnnnnn

SEQ ID NO: 204458 - DNA, 640 bp, Homo sapiens
  misc_feature: GYAE6OF02G7M0Z.38.28.C06.1.454.CMB.1.raw
  modified_base (276)..(276): a, c, t, g, unknown or other
  misc_feature (276)..(276): n is a, c, g, or t
  modified_base (520)..(520): a, c, t, g, unknown or other
  misc_feature (520)..(520): n is a, c, g, or t
  modified_base (615)..(615): a, c, t, g, unknown or other
  misc_feature (615)..(615): n is a, c, g, or t
tcagtcgatcacgtcacgaccggtgctcgatttagagctcacgtattgggtttgggctgagctggctttttcttgtggctattttaaaaggtgtccagtgtgaggtgcaggtgtcggagtctggggggaggcttggttcagcctggggggtccctgagactctcctgtgcagtctctggattaacctttagtgactatgccatgatctgggtccgccaggctccgaggggaaggggctgggaggtgggtctcagctaattaagtggggtaggggtnattcaaccatattacgcaggtacctcgggtggggggccgttcaccatcaccagagaccaacgtccgaggcgcacactatactctaacaatgacaacagcctggacgtaggtcgaaggacgacggtccgttagtactttagttgtggcgagacgactaccccgaacggtacgtacccgtacgtttcggtgttcgttttgttacttttcgttggtacggtacgaagggactaacgtcggttaaccnccgttcctcttacacgtccctaccaaccgacggccctacgtcccggtccctttcccccggcggtcccgtcccgtccgtacctcccgacgggaccncccgtacccgtccggacgtaccggg

SEQ ID NO: 204459 - DNA, 653 bp, Homo sapiens
  misc_feature: GYAE6OF02GNQRM.38.28.C06.1.454.CMB.1.raw
  modified_base (214)..(214): a, c, t, g, unknown or other
  misc_feature (214)..(214): n is a, c, g, or t
  modified_base (272)..(272): a, c, t, g, unknown or other
  misc_feature (272)..(272): n is a, c, g, or t
  modified_base (367)..(367): a, c, t, g, unknown or other
  misc_feature (367)..(367): n is a, c, g, or t
  modified_base (406)..(406): a, c, t, g, unknown or other
  misc_feature (406)..(406): n is a, c, g, or t
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccnccaggctccgaggggaagggctgggagtgggtctcgagcaattaagtgggtaggggtnattcaccatacttacgcagactccggtggggggccgttcaccatcaccagagaccaactccaggacgcacactaatactactaacaaatgcaacncgcctgagagtcgaggacaccggcgtgtactttagtggngcgagacgactaccccgaaggtcaaccgtacgttggtacgttcttttaggtacttttcgttggttcggacccgtaagggtaacctaagttcggtacctaccgtttctccttacgaccgtcccttaccgaaacccgaacgggtcccctaggttcccggttccccgtttaccccccggtggccccgtccccgttcggccccctcccggaagggacccgcccggttaaccccgtcggaaccgtaacccgg

SEQ ID NO: 204460 - DNA, 663 bp, Homo sapiens
  misc_feature: GYAE6OF02F5D15.38.28.C06.1.454.CMB.1.raw
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccgaggggaaggggctgggagtgggtctcgagcaattaagtggtaggggtgattcaccatattacgcagactccggtgggggccgttcaccatcaccgagagacaactccaggagcacactatatactaacaaatgacacagcctgagagtcgaggacacggccgtgtatttagttgtgcgagagtactacccgaacggtcgaaccctacgttgggtcgtctttttggacttttcgtggtcgggacccgtaaagggtacaagttcggacctacccggttcttcgttcaccgtccctacccgaacccgaaccgggtcccctaacgttcccggttaccccctttcccccgggtcgggtacccccgtacccccgttggtacccccgttacccggtaaccgggtacccggtaccccgtaccccggttaccccggaaggtaccccgg

SEQ ID NO: 204461 - DNA, 718 bp, Homo sapiens
  misc_feature: GYAE6OF02F088A.38.28.C06.1.454.CMB.1.raw
  modified_base (278)..(278): a, c, t, g, unknown or other
  misc_feature (278)..(278): n is a, c, g, or t
  modified_base (326)..(326): a, c, t, g, unknown or other
  misc_feature (326)..(326): n is a, c, g, or t
  modified_base (353)..(353): a, c, t, g, unknown or other
  misc_feature (353)..(353): n is a, c, g, or t
tcagtcgatcacgtcacgaccggtgctcgatttagagctcacgtattgggtttgggctgagcgtgtcgtttctaggtggctaattttaaaaggtgtccagtgtgaggtgcaggtgtcggagtctgggggaggcttggttcagcctggggggtccctgagactctcctgtgcagtctctggtattaacctttgtgactatgcatgatctgggtccgccaggcctccgagggaagggtctgggaggtgggtctcgagactaaattaagtgggtaggggtntattcaacctattactacgcagaccgtccgggtgggggtccttcaccntaccacaggagaccaactccgaggacnctaactactatactacgtaactaaacgtcgacaaccgacgtcctaggaggtaacgtcggaacggaaccgaccgggtaccgttagtttaagtttagtttcggtacggaccggtaaggaacgtaccgtaaccccggtaaacggggttaccaacccgttaccgtttgggttcgttccgttttggttaactttcggtagtcgggaaccgtaaacgggtactaaggttccggtacctaccgttccgttacttcgacgtccctaccaaccggtaccgcccttacgtcccggttcccttcccccgggtaggccccgtacccgtcgcccgttaccggacggtaccgtacccgtaccccgtaccggagtacccg

SEQ ID NO: 204462 - DNA, 617 bp, Homo sapiens
  misc_feature: GYAE6OF02FH4XH.38.28.C06.1.454.CMB.1.raw
  modified_base (215)..(215): a, c, t, g, unknown or other
  misc_feature (215)..(215): n is a, c, g, or t
  modified_base (268)..(268): a, c, t, g, unknown or other
  misc_feature (268)..(268): n is a, c, g, or t
  modified_base (398)..(398): a, c, t, g, unknown or other
  misc_feature (398)..(398): n is a, c, g, or t
tcagtcgatcacgtcacgaccggtgctcgatttagagctcacgtattgggtttgggctgagcgtggcttttcttgtggctattttaaaaggtgtccagtgtgaggtgcaggtgtcggagtctgggggaggcttggttcagcctgggggggtccctgagactctcctgtgcagtctctggattaacctttagtgactatgccatgatctgggtccncaggctccagggaagggctggagtggggtctcagcaattaagtggtaggggtnattcaccatattacgcaagactccggtggggggccgttcaccatccaccagagacaactcccaggacgcaacactatacgtctacaaatgcacagcctgagagtcgaggacacgggcctagtattactgngcgagagctacccaacggtgaccctaccgttggtgtcttttagtactttactcgttcggccaaaggggtacaaagttcggtacctacccgtcttccttacgacgcccttacccaaccgtaacggggtacccctagtacccggttcccgttaccccccgtcggacccgtccccgtcgcccgttcccgacggaccggcctacccgttcccggacgtaccgg

SEQ ID NO: 204463 - DNA, 715 bp, Homo sapiens
  misc_feature: GYAE6OF02JNTTX.38.28.C06.1.454.CMB.1.raw
  modified_base (244)..(244): a, c, t, g, unknown or other
  misc_feature (244)..(244): n is a, c, g, or t
  modified_base (255)..(255): a, c, t, g, unknown or other
  misc_feature (255)..(255): n is a, c, g, or t
  modified_base (319)..(319): a, c, t, g, unknown or other
  misc_feature (319)..(319): n is a, c, g, or t
  modified_base (361)..(361): a, c, t, g, unknown or other
  misc_feature (361)..(361): n is a, c, g, or t
tcagtcgatcacgtcacgaccggtgctcgatttagagctcacgtattgggtttgggctgagctggcttttcttgtggctatttaaaggtgtccagtgtgaggtgcaggtgtcggagtctgggggaggcttggttcagcctgggggggtccctgagactctcctgtgcagtctctggattaacctttagtgactatgccatgatctgggtccgcaggctccaggggagggctgggagtgggtctnagcaattaagngggtaggggtcgattcaccatattacgcagactccggtggggggccgttcgacccagtccaccngacgaccaacgtccaggagtcactactatatcctaacaaatnaccaactacggcctaggagagtccggaagctaacgggtcccgtgttaacttatttcgggagtacggacgacggtacgtcccaaacgggtccgaacccgtaacttcggggtctcgttttacgtacgttttacgttcggttccggtaccgaaggggaaccttaaggtcgggttcccttaaccgggttcccttaccgttaccgtaccgtacccccggttaaccgaacccgtaaccgggggaccccttagggtaaccccggtttcccgtttcccccccggttaagggaccccggtacccccgttcgtccccgttacccggaacggttaccgcccgaccccggttcgaacggttaccgg

SEQ ID NO: 204464 - DNA, 436 bp, Homo sapiens
  misc_feature: GYAE6OF02FIYP8.38.28.C06.1.454.CMB.1.raw
  modified_base (423)..(436): a, c, t, g, unknown or other
  misc_feature (423)..(436): n is a, c, g, or t
tcagtcgatcacgtcacgaccggtgctcgatttagagctcacgtattgggtttgggtgccgaagttgctggaggtcacggttcaccatcaccagagacaactccaggagcacactatatctacaaatgcacagcctgagagtcgaggacacggccgtgtattattgtgcgagagatcccgaacggtgaccaccttggtgctttttgattttctgtggccaagggacaatggtcaccgtctcttcagccctccaccgaggcccatccggtcttccccctggccgtcccctgcctccgagggacgccaccctcccgagacgccaccgcggccggcccgtggggcctggcccgttgggtcgaaggtccttaccttccgacggtgactccggactggacggcgggctgggccaagggccgacatagnnnnnnnnnnnnnn

SEQ ID NO: 204465 - DNA, 592 bp, Homo sapiens
  misc_feature: GYAE6OF02IUEI8.38.28.C06.1.454.CMB.1.raw
  modified_base (215)..(215): a, c, t, g, unknown or other
  misc_feature (215)..(215): n is a, c, g, or t
  modified_base (388)..(388): a, c, t, g, unknown or other
  misc_feature (388)..(388): n is a, c, g, or t
  modified_base (551)..(551): a, c, t, g, unknown or other
  misc_feature (551)..(551): n is a, c, g, or t
tcagtcgatcacgtcacgaccggtgctcgatttagagctcacgtattgggtttgggctgagcgtggcttttcttgtggctattttaaaaggtgtccagtgtgaggtgcaggtgtcggagtctggggggaggcttggttcagcctggggggtccctgagactctcctgtgcagtctctggattaacctttagtgactatgccatgatctgggtccncaggctccagggagggctggagtgggtctcgagcaattaagtgggtagggtgattcacctataattacgcagtactccggtggggggccgttcaccgtatcaaccgagacgacacctcgaggacgcacactaatatactaacaaatgacacacgctggaagagtcgaaggacncgggaccgttagtactttagttgtgacgagagactacccgaacgggtcacctacgttggtacgttgttttagttacttttacgtggttcggaccgtaagggaactagtcggtacctaccgttctcttcacgtcaccacgacggcctacgtcgtccgttcccgnggtccgtcctacgcctaccgcggaccgctaccgtcgatacg

SEQ ID NO: 204466 - DNA, 616 bp, Homo sapiens
  misc_feature: GYAE6OF02I5XDY.38.28.C06.1.454.CMB.1.raw
  modified_base (265)..(265): a, c, t, g, unknown or other
  misc_feature (265)..(265): n is a, c, g, or t
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggatttaacctttagtgacttatgccatgatctgggtccgcaggctccaggggagggctggagtggtctcagcaattagtgggtagggngattcaccgatatacgcagacgtcggtgggggccgttcacatcaccagacgacactccaggcacacactatatctaacaatgcagacgctgagagtcggacgacgacgcgtagtatttatgtgacgagtagaactcccgaacggtacgaccgtaccgttgggtacgtcgtttttagttacttttcgttggtaccggaccgtaaagggacgtaaagttcggtactacccgttcttccttaccgaccgtccgtacccaaccgtacgggacccctacgttcccggtcccgtttccccggtcggcccgtccccgtcgtaccgtcccgaggccgacctacccgtacggacgtacgg

SEQ ID NO: 204467 - DNA, 669 bp, Homo sapiens
  misc_feature: GYAE6OF02HCVH3.38.28.C06.1.454.CMB.1.raw
  modified_base (188)..(188): a, c, t, g, unknown or other
  misc_feature (188)..(188): n is a, c, g, or t
  modified_base (243)..(243): a, c, t, g, unknown or other
  misc_feature (243)..(243): n is a, c, g, or t
  modified_base (267)..(267): a, c, t, g, unknown or other
  misc_feature (267)..(267): n is a, c, g, or t
  modified_base (316)..(316): a, c, t, g, unknown or other
  misc_feature (316)..(316): n is a, c, g, or t
  modified_base (337)..(337): a, c, t, g, unknown or other
  misc_feature (337)..(337): n is a, c, g, or t
  modified_base (351)..(351): a, c, t, g, unknown or other
  misc_feature (351)..(351): n is a, c, g, or t
tcagtcgatcacgtcacgaccggtgctcgatttagagctcacgtattgggtttgggctgagctggcttttctgtggctattttaaaaggtgtccagtgtgaggtgcaggtgtcggagtctgggggagcttggttcagcctggggggtccctgagactctcctgtgcagtctctggattaaccttagtnactatgccatgatcgtgggtcccgcaggctcgagggaagggctgggagtgggtcncgagcaagttaagtggtaggggtntattcactatattacgcagtacgtccgggtggggggtccgttcacctancaccagacgacacctcagganacacatatatcaanaatcgacacagtcctaggacgacgtacgacggaccaacggtcgtagttaagtttcgttggtcggacgaacgtaggtaacctaacccggacggtaccgtacccgtacgttcgggttacgtttcgtttcggttaacgtttcggttagtcggaaccggtaaggtacgtagtcggtaccgtaccgttacgttcgttaccgtaccgttaccctccgaaaccgtacgggtaccctacgttcccggttcccgttccccggtccgtacccggtccccttacgtcccgtaccgacggtcccgacccgtaccggtccgtaacggcccg

SEQ ID NO: 204468 - DNA, 608 bp, Homo sapiens
  misc_feature: GYAE6OF02JLCMC.38.28.C06.1.454.CMB.1.raw
  modified_base (324)..(324): a, c, t, g, unknown or other
  misc_feature (324)..(324): n is a, c, g, or t
  modified_base (352)..(352): a, c, t, g, unknown or other
  misc_feature (352)..(352): n is a, c, g, or t
  modified_base (357)..(357): a, c, t, g, unknown or other
  misc_feature (357)..(357): n is a, c, g, or t
  modified_base (398)..(398): a, c, t, g, unknown or other
  misc_feature (398)..(398): n is a, c, g, or t
tcagtcgatcacgtcacgaccggtgctcgatttagagctcacgtattgggtttgggctgagcgtggcgttttctagtggctattttaaaaggtgtccagtgtgaggtgcaggtgtcggagtctgggggaggcttggttcagcctggggggtccctgagactctcctgtgcagcctctgcattccacctttagtaacttatttaatgagctgggtccgccagcctaccagggaggggctgggagtgggtggccagcacttaaccaagatggacgtagaaaaatctatgtggactctgtgaagggccgattcgcccatcctccagngtaacacgccaagactcactgtgctgcnctagngaacgctgagaggccgagacgtcgactgtacgtactttcgngtagcgagtaccgcccccgtaagcggacgggtactacggaggtcgggaggttccacggtacttacgacttacggtcgggaccgtacgggaaccctgggtccaccgttcaccttcgacgccctccgaaccgacggtaccacgttccggtaccttcccccgtcgacccgtacccctcccgttaccgacgtacgccctcgttccggaccgggg

SEQ ID NO: 204469 - DNA, 605 bp, Homo sapiens
  misc_feature: GYAE6OF02IWZJ2.38.28.C06.1.454.CMB.1.raw
  modified_base (92)..(92): a, c, t, g, unknown or other
  misc_feature (92)..(92): n is a, c, g, or t
  modified_base (214)..(214): a, c, t, g, unknown or other
  misc_feature (214)..(214): n is a, c, g, or t
  modified_base (217)..(217): a, c, t, g, unknown or other
  misc_feature (217)..(217): n is a, c, g, or t
  modified_base (269)..(269): a, c, t, g, unknown or other
  misc_feature (269)..(269): n is a, c, g, or t
  modified_base (281)..(281): a, c, t, g, unknown or other
  misc_feature (281)..(281): n is a, c, g, or t
  modified_base (284)..(284): a, c, t, g, unknown or other
  misc_feature (284)..(284): n is a, c, g, or t
  modified_base (286)..(286): a, c, t, g, unknown or other
  misc_feature (286)..(286): n is a, c, g, or t
  modified_base (303)..(303): a, c, t, g, unknown or other
  misc_feature (303)..(303): n is a, c, g, or t
  modified_base (373)..(373): a, c, t, g, unknown or other
  misc_feature (373)..(373): n is a, c, g, or t
  modified_base (377)..(377): a, c, t, g, unknown or other
  misc_feature (377)..(377): n is a, c, g, or t
  modified_base (386)..(386): a, c, t, g, unknown or other
  misc_feature (386)..(386): n is a, c, g, or t
tcagtcgatcacgtcacgaccggtgctcgatttagagctcacgtattgggtttgggctgagcggtgtcgtttctaggtggctatttaaaggngtcagtgtgaggtgcaggtgtcggatcgtgggggaggcttggttcagccgtggggggtccctgagctctcctgtgcagtctcgtggattaacctttgtgcctatcgctagtgacttgcggcncgngctccagggagggtctggagtcggctgaagtctaattagtggtggtatcttnaccaggtactcngancnccgggtggggaaccttnaaacgctcgaccaaggcaccttaacggccaggaacgcccaattaccttaaggtctcctaaggggaacganacanaacgtccanagacgacgaagacgacgccggtaatatagtttacggtgagagtacgacgtacgtacgtacgtacgtacgttacgtgttcgttagttgtcgtgtacgtacgtagtacgtagtcgtacgtacgtactctacgtacgtccacgacgtacgtaccgacgtccgtaccgtccgtccgtaccgtccgtacctacgacgacgtaccgtacgtacggtacgacgacg

SEQ ID NO: 204470 - DNA, 706 bp, Homo sapiens
  misc_feature: GYAE6OF02FSX6Y.38.28.C06.1.454.CMB.1.raw
  modified_base (339)..(339): a, c, t, g, unknown or other
  misc_feature (339)..(339): n is a, c, g, or t
  modified_base (360)..(360): a, c, t, g, unknown or other
  misc_feature (360)..(360): n is a, c, g, or t
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccgagggaagggctggagtgggtctcgagcaattaagtggtaggggtgtattcaccatattacgcagactccggtggggggtccgttcgaccattcaccagagacaacctccaggacncacactatatctaacaaatcncacgagcctgagacgtcgaaggacgacggccgtgtactttagtttggtgacgtagacgtacgtaccccgaacgggttcgaacccgtaccgtttgggtacgttctttttcgggaactttttcgttggttcgtacccggaaacggggtaaccaagttcgggttacctacccggttccttaccgtttccgaacgtcccccttacccgaaaccccgtaaccgggtacccccagttcccgggtttaaccccgttttcccccccggacgggtacccccggtccccgtttaccggtccccgttacccgtaacgggaacccggtcctaacccccggtttccggaacggacccgg

SEQ ID NO: 204471 - DNA, 803 bp, Homo sapiens
  misc_feature: GYAE6OF02FFMCC.38.28.C06.1.454.CMB.1.raw
  modified_base (219)..(219): a, c, t, g, unknown or other
  misc_feature (219)..(219): n is a, c, g, or t
  modified_base (280)..(280): a, c, t, g, unknown or other
  misc_feature (280)..(280): n is a, c, g, or t
  modified_base (390)..(390): a, c, t, g, unknown or other
  misc_feature (390)..(390): n is a, c, g, or t
tcagtcgatcacgtcacgaccggtgctcgatttagagctcacgtattgggtttgggctgagctggctttttcttgtggctaattttaaaaggtgtccagtgtgaggtgcaggtgtcggagtctgggggaggcttggttcagcctgggggggtccctgagactctcctgtgcagtctctggatttaacctttagtgactatgaccatgatcgtgggtccnccaggctccgagggggaagggctagggagtgggtctcagcaattaacgtgggtaaggggtnattcaacctattagttacgctacggtaccgtacccgggtgggggggtcccgtttaccaacccgactacccgaacccgaggtaacgaacctaaaccgtcccgaaagggacnccaacctaactaataacttacctaaacaaatcggacctaacgacggtaccctagaacggtaacggtacgggaacggaacccggtaccgggacccggtttgttaaacggttttatttgggtaccgtacggtaacggaacggttaaccttacccccggtaaacgggttaccgaaaccccgttaacccggtttggggtacttccggttttttaggtacttttcgtttcggtacgggtacgaaacggggtacctaaggttcgtacgtacccggtttcttaccgttaccgaccgtaccctacccgaaccgtaaccgggcccttagtcccggttccccgtttcccccggcgggtccccgtaccccgttcgtacccgtccgaaccgggtaccgtaccctaccccggtacgacggtaccgg

SEQ ID NO: 204472 - DNA, 760 bp, Homo sapiens
  misc_feature: GYAE6OF02ILLDV.38.28.C06.1.454.CMB.1.raw
  modified_base (218)..(218): a, c, t, g, unknown or other
  misc_feature (218)..(218): n is a, c, g, or t
  modified_base (279)..(279): a, c, t, g, unknown or other
  misc_feature (279)..(279): n is a, c, g, or t
  modified_base (382)..(382): a, c, t, g, unknown or other
  misc_feature (382)..(382): n is a, c, g, or t
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctgggggggtccctgagactctcctgtgcagtctctggatttaacctttagtgacttatgccatgatcgtgggtccnccaggctccgagggagggctgggagtgggtctcgagactaaagttaagtggggtaggggtntacttcaactattattaccgcagaccgttccgggtcggggggtccgttcaacctatcaaccaggacgaacaacctccaggacaccacaactatactacgtaanaaactgacaacgagtccgtagaagacggtacggacggtaccgacggtccgttagttactttaagtttggtacggacggtaagtaacgtaccgttaccccgaaacgggttactaaacccgttaccgtttagggttcgtttaccgtttttaggttaacctttttcggttacggttccgggaaaccgtaacgggaaccgttaaggttccggttacccttacccggttcctttcgttacccgtaccgtaccccgtacccgaaaccggtacccggtccctacgtttccccggttaccccttcccccggttccggaccccgtcccgtccggtaccccgtccggaaccggtacccgtaccccgtacccgttcccggaagtacccg

SEQ ID NO: 204473 - DNA, 182 bp, Homo sapiens; identical to SEQ ID NO: 204457
  misc_feature: GYAE6OF02I5XUD.38.28.C06.1.454.CMB.1.raw
  modified_base (175)..(182): a, c, t, g, unknown or other
  misc_feature (175)..(182): n is a, c, g, or t

SEQ ID NO: 204474 - DNA, 661 bp, Homo sapiens
  misc_feature: GYAE6OF02G5PLY.38.28.C06.1.454.CMB.1.raw
  modified_base (213)..(213): a, c, t, g, unknown or other
  misc_feature (213)..(213): n is a, c, g, or t
tcagtcgatcacgtcacgaccggtgctcgatttagagctcacgtattgggtttgggctgagctggcttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccnccaggctccgaggggaagggctgggagtgggtctcagcaaattaagtgggtaggggtgattcacctatattacgcagactccggtggggggccgttcaccatcaccagacgacactccaggacgcacactaatactactaacaaatcgacaacagcctgaagagtcgaggacacggcgtagtattactggtgcgagagacgtcccgaaacgggttcgaacccgtaccgttgggttacgttccgtttttagttaacgttttccgttggtacgggtacccgtaaaggggaacctaaagttcgggtacctacccggttacttaccgttcaccgtccctacccgaaccgtaaccgggtacccctacgttccccgggttcccttcccccggtggccccgtccccgttcgcccgtacccgaggaccgtccctaaccccggtccgaacgtaccgg

SEQ ID NO: 204475 - DNA, 684 bp, Homo sapiens
  misc_feature: GYAE6OF02JKLLZ.38.28.C06.1.454.CMB.1.raw
  modified_base (214)..(214): a, c, t, g, unknown or other
  misc_feature (214)..(214): n is a, c, g, or t
  modified_base (286)..(286): a, c, t, g, unknown or other
  misc_feature (286)..(286): n is a, c, g, or t
  modified_base (292)..(292): a, c, t, g, unknown or other
  misc_feature (292)..(292): n is a, c, g, or t
  modified_base (321)..(321): a, c, t, g, unknown or other
  misc_feature (321)..(321): n is a, c, g, or t
  modified_base (346)..(347): a, c, t, g, unknown or other
  misc_feature (346)..(347): n is a, c, g, or t
tcagtcgatcacgtcacgaccggtgctcgatttagagctcacgtattgggtttgggctgagctggcttttcttgtggctattttaaaaggtgtccagtgtgaggtgcaggtgtcggagtctggggggaggcttggttcagccgtggggggtccctgagctctcctgtgcagtctctggattaacctttagtaactatttaatgagctgggtccnccagcctccgaggggaaggggctgggagtgggtggccagcaataaccagatggacgtagaaaaatctatcgnggactntgtggaagggccattcgccatctccaganacacgacaagactcatgtgctgcannagaacgctagagcggacacgacgacggtctcgtgttactcgtagtcgcgaggaccgccccctaagtcgggacgggtctaaccggtaggtcggggaactaccgtacggttacgtttacgaccgtaacgggttcggggacccgtaaacggggtacccttacgggtcctaacccggtttccacccgttaccgaaccggtcccctacccgaaacccggtaacggtccccgtaccggtttcccggttaccccgttaccccccgtagggcccctaaccccggttcccttaacccggaacgtaccggcccctaaccggttccgggtacggggaccctaacccgg

SEQ ID NO: 204476 - DNA, 189 bp, Homo sapiens
  misc_feature: GYAE6OF02FP2GZ.38.28.C06.1.454.CMB.1.raw
  modified_base (176)..(189): a, c, t, g, unknown or other
  misc_feature (176)..(189): n is a, c, g, or t
tcagtcgatcacgtcacgaccggtgctcgatttagagctcacgtattgggtttggggggaagaggaagactgacggtcctgctccaggagcacctccgagagcacagcggccctgggctgcctggtcaaggactacttccacgtgatcgactgagcgggctggcaaggcgcatagnnnnnnnnnnnnnn

SEQ ID NO: 204477 - DNA, 729 bp, Homo sapiens
  misc_feature: GYAE6OF02HRBZM.38.28.C06.1.454.CMB.1.raw
  modified_base (219)..(219): a, c, t, g, unknown or other
  misc_feature (219)..(219): n is a, c, g, or t
  modified_base (270)..(270): a, c, t, g, unknown or other
  misc_feature (270)..(270): n is a, c, g, or t
  modified_base (352)..(352): a, c, t, g, unknown or other
  misc_feature (352)..(352): n is a, c, g, or t
tcagtcgatcacgtcacgaccggtgctcgatttagagctcacgtattgggtttgggctgagctggctttttcttgtggctattttaaaaggtgtccagtgtgaggtgcaggtgtcggagtcgtgggggaggcttggttcagccgtgggggtccctgagactctcctgtgcagtctcgtggtactttaacctttagtgactatcgccatgatcgtggccncagctcgagggaagggctggagtggtctcagactaattaagtggtagggtnacttcactattacttacgcgacgacgtccgggtgggggtccgttacaccacgtccaaccgtagacgaaccacctcgaggacncacgaactatactactaaacaaagtcgacacgacgccgtagacggtacgtacggaacggaaccgtaccgggaccgtttagttaacgttttagtttacggtggaacggtaacggtaacgtaaccccgttaccccggaaacgggttacgaaccccttaccgggtttgggtaccgttttaccgttttggttacctttttcgtacgggttaccggaacggtaaacgggtactaacggttccggtacccttaaccgttcttacctcgaaccctccctacccgaaccggtacgcccctagttccccggttacccctccccggtacggtccctccccgttgccccgtacggtacggacccgtaccgccggttaccgaaggaccg

SEQ ID NO: 204478 - DNA, 777 bp, Homo sapiens
  misc_feature: GYAE6OF02H0T4R.38.28.C06.1.454.CMB.1.raw
tcagtcgatcacgtcacgaccggtgctcgatttagagctcacgtattgggtttggggtctgagagaggagcccagccctgggattttcaggcgttttcatttggtgatcaggactgaacagagagaactcaccatggtaggtttgggctgagcgtgtcgttttctagtcggcttaagttttaaaggtgtcctagtgtgaggtgcgaggttgtcggagtcggtgggggaggcgtttgggttaccaggcccggttcggggggtcccttggacggaccttccgtccgtgtcgtcagttctacgttaggtaacttttaaccgtttaagtgtacttaactcgtacctaagtgtacgttcggttacgggtacccgtccgaacgggtccgtacccgggaagggggaagggggtcgttagggacgggttcggggtactacgagtactaaagtttaaggtagggtagggtacgtacgttacaccaagttactaaccgcgtaacggtaccggttccggggtacggggggttacccggttacgaaccctacgttactaaccgaacggaacgaacccaaccgtaacgtacggaacgaccaaccgtactaaacttactaaccgttaactaaaacgtacgaacgaacgtacgaccgtagtaacgtacggtacggaacggacgtaccgggtacgtagttaagttgttaaaaaaaagtcgagacgacgtacgtaccgtaaccggtacgtaccgttaccgttcggtacgttagttttacgttacgtttgtacgg

SEQ ID NO: 204479 - DNA, 754 bp, Homo sapiens
  misc_feature: GYAE6OF02HLMHT.38.28.C06.1.454.CMB.1.raw
  modified_base (187)..(187): a, c, t, g, unknown or other
  misc_feature (187)..(187): n is a, c, g, or t
  modified_base (211)..(211): a, c, t, g, unknown or other
  misc_feature (211)..(211): n is a, c, g, or t
  modified_base (238)..(238): a, c, t, g, unknown or other
  misc_feature (238)..(238): n is a, c, g, or t
  modified_base (260)..(260): a, c, t, g, unknown or other
  misc_feature (260)..(260): n is a, c, g, or t
  modified_base (275)..(275): a, c, t, g, unknown or other
  misc_feature (275)..(275): n is a, c, g, or t
  modified_base (334)..(334): a, c, t, g, unknown or other
  misc_feature (334)..(334): n is a, c, g, or t
tcagtcgatcacgtcacgaccggtgctcgatttagagctcacgtattgggtttgggctgagcgtggtcttttctgtggctattttaaaaggtgtccagtgtgaggtgcaggtgtcggagtctgggggagcttggtcagcctggggggtccctgagactctcctgtgcagtctctggattaaccttgngactatgccagtgatcgtgggccncagctcgagggaggctggagtcggctnagactaattaggtggtagggtntatcaacatatacgnagtacctcggggtcggggtccggttcaacctataccgacgaacggaggtaacctaaccnccgaaggacgtacaacaacttatacgtacttaaacgaaattcgacgaacacgtcgtaggaagtacggtacggaacgacgacggtcccgttagttaacttagttcgtgaacgtacggaactaaccgtacccgtaaacgggtccgaaaccgttccggttacgggttacgtttacgttttacggtttaacctttgggtttacgggttaccgggtaccgaaacggggtaacgtacggtaaccggttcccgtaacccggtttacctcgtttaaccgaaccggtaccctaaacccgtaaccgggtaacggtacccccgtacggttccggttttacccccgtttccccggtcgggtaacccctcccggttaaccgttcccgaccgggtaacgggaccgtacccgttaccccggacgtaccggaccgg

SEQ ID NO: 204480 - DNA, 777 bp, Homo sapiens
  misc_feature: GYAE6OF02FV3XJ.38.28.C06.1.454.CMB.1.raw
tcagtcgatcacgtcacgaccggtgctcgatttagagctcacgtattgggtttggggtctgagagaggagcccagccctgggattttcaggcgttttcatttggtgatcaggactgaacagagagaactcaccatggagtttgggctgagctggctttttcttgtggctattttaaaaggtgtccagtgtgaggtgcaggtgtcggagtctgggggaggcttgggttcaggcctggggggtccctggacgactctcctgtcgcagtctcgtggtattaacctttagtgtactatcgccatgatcgtgggtccgccgaggcctccgaggggaagggcgtggaggtggggtctcgagtacaattaacgtggggtaggggtgtaacgttcaaccgtattactacggtactaacgggtaccgttacccggggtcgggggggtacccgtttaccgaccggtatacccgaaccgtaacgggaacgaacccgtaacccgtacccgaacgggtaacgaccctaaaccgtaaccgttaaactaacgtttacctaaaaccgaaaagttaccggacccgttaaccgaaacggtcccgtaacggacggtacgtacggggaaaccggtaaccgaacccggggttccccggttaggtttaacgtttaacgtttcgggacggtaccgaagggttaacggtacgtttaacccgaccgttaaacggggtaacccgttaaccccgttaacggtttacggggtacgttttacggtttttaggtccgtttttacggg

SEQ ID NO: 204481 - DNA, 778 bp, Homo sapiens
  misc_feature: GYAE6OF02G1TPS.38.28.C06.1.454.CMB.1.raw
  modified_base (186)..(186): a, c, t, g, unknown or other
  misc_feature (186)..(186): n is a, c, g, or t
  modified_base (210)..(210): a, c, t, g, unknown or other
  misc_feature (210)..(210): n is a, c, g, or t
tcagtcgatcacgtcacgaccggtgctcgatttagagctcacgtattgggtttggctgagctggctttttctgtggctattttaaaaggtgtccagtgtgaggtgcaggtgtcggagtctgggggagcttggttcagcctgggggtcctgagctctcctgtgcagtctctggaactttaaccttgngactatgccatgatcgtgggtccncgagtcctaccgaagggaacgggctaggagtcgggtctacaggctaaagttaggtagggtaggggtatacgttaccaaccgtaaagttacgttaaccggcgtaagaccggttcccggggtgggggggtcccttcgaaccctagtacccgaaccgaggacgaacctaaccctcgaagacgctaaaccgactagtacgtactaaacgtaaatcgaacacgtaccgacgtacgaacgtacggtccgaacggtacaaccggttcccgttaatttaagtttcttacgggtaccggacgtaacggtacggttaacccgaaccccggtacggtacccgtaaccgttacccggttacggttcgttcgttttaacggttcgttttcgtagggtccgtaacggtaacggtaacgtaaccgggttcgtaccgtaccgttccgtaccgtaccgtacgttaccctaccgtaaccggtaccggcccgttacgttccggttacccgtcccggtaccggtcccgtacccgtccggtaccccgtacgtaccgggaccttaccgtacccggtcggtaaccgaccgg

SEQ ID NO: 204482 - DNA, 732 bp, Homo sapiens
  misc_feature: GYAE6OF02F3PVV.38.28.C06.1.454.CMB.1.raw
  modified_base (94)..(94): a, c, t, g, unknown or other
  misc_feature (94)..(94): n is a, c, g, or t
  modified_base (192)..(192): a, c, t, g, unknown or other
  misc_feature (192)..(192): n is a, c, g, or t
  modified_base (206)..(206): a, c, t, g, unknown or other
  misc_feature (206)..(206): n is a, c, g, or t
  modified_base (220)..(220): a, c, t, g, unknown or other
  misc_feature (220)..(220): n is a, c, g, or t
  modified_base (470)..(470): a, c, t, g, unknown or other
  misc_feature (470)..(470): n is a, c, g, or t
  modified_base (542)..(542): a, c, t, g, unknown or other
  misc_feature (542)..(542): n is a, c, g, or t
  modified_base (626)..(626): a, c, t, g, unknown or other
  misc_feature (626)..(626): n is a, c, g, or t
tcagtcgatcacgtcacgaccggtgctcgatttagagctcacgtattgggtttgggctgagcggtgtcgtttctaggcggctattttaaaaggngtccagtgtgaggtgcaggtgtcggagtcgtggggaggcttggtcagcctgggggtcctgagctctctgtgccagtctcgtgtatttaccgtttaggnactagtgccatggnttcgtcgggtaccncgaggcgtaccgaggggtagggccttgggaagttggggtcctcgagtactaagttagtagggtaaggggtctacgtactacccaaggtttactaccgacgagtacccggtccggggttacgggggcccttacacctacggtaccaaccggagtaccgaacctaaacctccgggaacggcgacgtaacccgtataaccttacttaccgaaactactgggacaagactcgaagctaggtaccgagtacccgngtcttagtacttcggtgacgtagacgtagtaccaccggtacgacgtacctacggtttgtcgttacggtttanacgttttcggacgttgggaaacgttacgggactaggttacggccttaccgtacctcgtaacgtcccgtaaccctcgtaaacggntaccccggtgtcccggttcccgttcccggacggtcccttaaacccgggtccgtaacgtcccgttagggacccccttaccggttaccgacccgttaaggcccccggg

SEQ ID NO: 204483 - DNA, 695 bp, Homo sapiens
  misc_feature: GYAE6OF02HCOVZ.38.28.C06.1.454.CMB.1.raw
  modified_base (214)..(214): a, c, t, g, unknown or other
  misc_feature (214)..(214): n is a, c, g, or t
  modified_base (276)..(276): a, c, t, g, unknown or other
  misc_feature (276)..(276): n is a, c, g, or t
  modified_base (385)..(385): a, c, t, g, unknown or other
  misc_feature (385)..(385): n is a, c, g, or t
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccnccgaggcctccgaggggaagggctgggagtcgggtctcgagacaattaagtgggtaggggtnattcaccaatacttacgcagacgtccgggtgggggccgttcacctatccaccagacgaccaacctccgaaggacgacactaactatactactaacaaatcgacacgacnccgtagacggtacgtacgaaggaccgacggtccgttagttacttagttgagacgtagacgtaccttaccccgaacgggttacgacccgtaaccgtttgggttacgtttccgtttttaggttactttttccgttaggtacgggtaccaaaggggtacctaagttcgggtacctaccgttccgttccgttacaccgttccctcccgaaacccgtaccgggcccctaggttcccggttcccgttcccccggtggtaccccgtcccgtccgcccgtaccggaacggtacccgcctaaccccggtacgacgtacg

SEQ ID NO: 204484 - DNA, 721 bp, Homo sapiens
  misc_feature: GYAE6OF02F4RG2.38.28.C06.1.454.CMB.1.raw
  modified_base (214)..(214): a, c, t, g, unknown or other
  misc_feature (214)..(214): n is a, c, g, or t
tcagtcgatcacgtcacgaccggtgctcgatttagagctcacgtattgggtttgggctgagctggctttttcttgtggctattttaaaaggtgtccagtgtgaggtgcaggtgtcggagtctgggggagcttggttcagcctggggggtccctgagactctcctgtgcagtctctggattaacctttagtgactatgccatgatcgtgggtccncaggcctccgagggaagggctggagtgggtctcgagactaattaagtgggtaggggtgtattcaccattacttacgcagtacctccgggtggggggcccttcaaccgatacaccgaggacgtaaccaaaccgtccgaagggacaccaacgtaccttaatactactaacaaaagtcgacacacgcctaggaacgtaggtacggaacggaccgacgggtcccgttaaggttatttacgttaggtcgacggacgagtacctaacccggaacggttacacccgttacgttcgggttacgttccgttttacgttactttcgtggttacgggtaaccgtaaacgggtactaagttcggtacctacgttcgttcctcgtactccctaccgaacccgtaaccgggccctacgttaccccgggttccctttcccccgggtacggtcccccggtacccttccggtaccgtacccgggtacggtaccgtaccccgtacccggttaccgaccggaaccg

SEQ ID NO: 204485 - DNA, 641 bp, Homo sapiens
  misc_feature: GYAE6OF02GY6HW.38.28.C06.1.454.CMB.1.raw
  modified_base (294)..(294): a, c, t, g, unknown or other
  misc_feature (294)..(294): n is a, c, g, or t
  modified_base (319)..(319): a, c, t, g, unknown or other
  misc_feature (319)..(319): n is a, c, g, or t
  modified_base (346)..(346): a, c, t, g, unknown or other
  misc_feature (346)..(346): n is a, c, g, or t
  modified_base (394)..(394): a, c, t, g, unknown or other
  misc_feature (394)..(394): n is a, c, g, or t
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtcccgcaggtctccgaggggaaggggtctgggagtgggtctcgagcaattaagtgggtaggggtgattcacctatacttacggnagactccggtgggggtccgttcacnctcaccgagacgacaactccgaggacncactacgtatatactaacaatcgacacagcctagacgtagcgacgacnccggtcgtagttattattggtcggacgtaagacgtacgtaccccgtaacgggtcaaccgtcgttaggtcgttctttagttactttcgttggtcgtacgaagggtactacgttggtactccgtacttcgtcacgtcctaccgaccgacggtccctgttcccggttaccttccccggtacggtccccgtacccgttcggaccgttacccggacgggtacccgtaccgtacccggtcggacgtaacccgg

SEQ ID NO: 204486 - DNA, 595 bp, Homo sapiens
  misc_feature: GYAE6OF02HW2LD.38.28.C06.1.454.CMB.1.raw
  modified_base (191)..(191): a, c, t, g, unknown or other
  misc_feature (191)..(191): n is a, c, g, or t
  modified_base (339)..(339): a, c, t, g, unknown or other
  misc_feature (339)..(339): n is a, c, g, or t
  modified_base (429)..(429): a, c, t, g, unknown or other
  misc_feature (429)..(429): n is a, c, g, or t
  modified_base (447)..(447): a, c, t, g, unknown or other
  misc_feature (447)..(447): n is a, c, g, or t
  modified_base (460)..(460): a, c, t, g, unknown or other
  misc_feature (460)..(460): n is a, c, g, or t
  modified_base (554)..(554): a, c, t, g, unknown or other
  misc_feature (554)..(554): n is a, c, g, or t
  modified_base (560)..(560): a, c, t, g, unknown or other
  misc_feature (560)..(560): n is a, c, g, or t
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagngactatgccatgatctgggtccgccaggctccgaggggaagggctgggagtgggtctcagctaataagtgggtaggggtgattcacatattacgcagactcggtcggggggccgttacaccatccaaccgagagacaacctcgaagancaacactatatctaacaaatgacacagctagagagtcgagtacgacgtccgtagtacttagtgtacgcgaagagacgcccgtaaacggtnactaaccgttggtacgtnttttgattttcgngtacggactaagggactaagtcgtaccgaccgtctcttcgactccgccaaacggaacggtcccagttccgggtacccttccccttcgggacccncccgtntccgtaccaggaccgcctaacccggtcgacggtac

SEQ ID NO: 204487 - DNA, 463 bp, Homo sapiens
  misc_feature: GYAE6OF02GZTZF.38.28.C06.1.454.CMB.1.raw
  modified_base (308)..(308): a, c, t, g, unknown or other
  misc_feature (308)..(308): n is a, c, g, or t
  modified_base (441)..(463): a, c, t, g, unknown or other
  misc_feature (441)..(463): n is a, c, g, or t
tcagtcgatcacgtcacgaccggtgctcgatttagagctcacgtattgggtttgggtgccgaagttgctggaggtcacggttcaccatcaccagagacaactcaggagcacactatatctacaaatgcacagcctgagagtcgaggacacggccgtgtattattgtgcgagagactccccaaaggtgaccaccgttggtgtctttttgattttctggtggccgtaaagggcaaagtggtaccaccggtctcttcaacgccctaccaaccgaacgggcccaattccgggtccttccccccgtagggccnccccgtagcctccgaggacgcacctcgacgagcacgagccggcctagggctcgccgtaggaccaaacggaccttaccttccgaacgtgaactccgacgtggacggtcgggacgtggaaccaggcgacatacgnnnnnnnnnnnnnnnnnnnnnnn

SEQ ID NO: 204488 - DNA, 780 bp, Homo sapiens
  misc_feature: GYAE6OF02FUB9W.38.28.C06.1.454.CMB.1.raw
  modified_base (218)..(218): a, c, t, g, unknown or other
  misc_feature (218)..(218): n is a, c, g, or t
  modified_base (287)..(287): a, c, t, g, unknown or other
  misc_feature (287)..(287): n is a, c, g, or t
tcagtcgatcacgtcacgaccggtgctcgatttagagctcacgtattgggtttgggctgagctggcttttcttgtggctatttaaaaggtgtccagtgtgaggtgcaggtgtcggagtctgggggagcttggttcagccctgggggggtccctgacgactctcctgtgcagtctctggtattaacctttagtgactatgccatgatcgtcgggtcccnccaggtcctccgaaggggaacgggctgggaggtcgggtctcgagactaaagtttaagtgggtaggggtnacttaccacctattattaccggcaacggtaccgttccgggtggggggtacccttaccaccataccaaccgagtacgaacctaacctccgaaggtacgcaacgtactaatactactaaccaaacgttgacctacacgtcccgtaggaacgtacggtacggaacgggaaccgtaccgggtacccgttaggttaaatttaggttcggtcggtacggaaccggtacgtaccgtaccccgtaaacgggtaccgtaacccgttacccgggttggtccgtttacgttttcgtacgttttcgtcgggtaccggaaccgtaacgggtaaccttaagggttccggtaccgttaacccgttccgttaccgttccgaaccggtaccctaaccccgaaacggtacccggtccctacgttcccggtacccttcccccggcggtacccgtcccgttaccgccgttacccgtagggaccctacccgtaccggtacccggagtaacccgg

SEQ ID NO: 204489 - DNA, 468 bp, Homo sapiens
  misc_feature: GYAE6OF02I5L89.38.28.C06.1.454.CMB.1.raw
  modified_base (303)..(303): a, c, t, g, unknown or other
  misc_feature (303)..(303): n is a, c, g, or t
  modified_base (437)..(468): a, c, t, g, unknown or other
  misc_feature (437)..(468): n is a, c, g, or t
tcagtcgatcacgtcacgaccggtgctcgatttagagctcacgtattgggtttgggtgccgaagttgctggaggtcacggttcaccatcaccagagacaactccaggagcacactatatctacaaatgcacagcctgagagtcgaggaccacggccgtgtattattgtgcgagagatccccaacggtgacccaccttggtgtcttttgatttctgtggccaagggacaagtggtcaccgtctcttcagcctccacgaacggcccatccggtccttccccctggccgtccctgcctccgaggcncctacccgtccggagacgccacgacggccggcccgtcgggtccttcccgtggtaccaaacggtaccttaccttcccgaacgtgtactcgacgtggaggccgggtcgtagggaccaaggggcctacaagtagcannnnnnnnnnnnnnnnnnnnnnnnnnnnnnnn

SEQ ID NO: 204490 - DNA, 852 bp, Homo sapiens
  misc_feature: GYAE6OF02FVOM4.38.28.C06.1.454.CMB.1.raw
tcagtcgatcacgtcacgaccggtgctcgatttagagctcacgtattgggtttggggtctgagagaggagccccagccctgggtattttcgaggtcgttttcatttggtgatcaggactgaacagagagaactcaccatggagtttggcgtgagcgtggtcgttttcttgtgcttaagttttaaaaggtgtccagtgtgaggtgcgaggtgtcggtacggtcggtggggtaggtcgttggttcgacggtccggttcgggggtccctggtaacgtaccgttccgtccgttggtcgtcgtacggttctcgtaggtaacgtttaaccgtttagtacgtaacttagtcgaccgtagtcgacgttccggtccggtacccgtaccgacggtaccgtaccgggtaacggggtacggggtcggtcgggtaggtccggttcgtaacgaacgtacttaaacggttaaggttggggttagggtacgtttaaccgttcgtaaaccgttaacgttaacgttaccggacgtaaccgggtacccggtttacccgggggtccgggggttaccccgttaaccgtacccgtaacgtacccgtaaccgtaacggaacctaaacccgaaccgtaaccccggaaggaacccgaaccgtaacgtaaaccgtaccgttaaccttaacgtaaacgtaaacgtacccgtacgtaaaccgtacggtaccgtaggtaaaccggtacgtaaccgggaaccgaacccggttacggtccgttagtttaacgttacgttcggtagtacggtagtaacgaccgttaccgaaccggttacacccggttacgtttcggtacgtttcgtttacggtacgttgtacgg

SEQ ID NO: 204491 - DNA, 730 bp, Homo sapiens
  misc_feature: GYAE6OF02HSWAH.38.28.C06.1.454.CMB.1.raw
  modified_base (275)..(275): a, c, t, g, unknown or other
  misc_feature (275)..(275): n is a, c, g, or t
  modified_base (304)..(304): a, c, t, g, unknown or other
  misc_feature (304)..(304): n is a, c, g, or t
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatcgtgggtccgccaggctccgagggaacggggctgggagtgggtctcagctaaattaagtgggtaggggtntattcacctatattacgcagacgtccggnggggggtccgttacaccatccaaccgagacgaccaactccgaaggacgaccaactactaatactactaacaactcgacacgacgtacctaggagacggtacggaggaccgaacgggtccgttagttatttagttcgtacgacggagtacgtacctaccccgaaacgggtccgaacccgttaccggttggtcgtttacgttttgtactttttcgaggttaccggaacgtaaacgggtaactaacgttcggtacccgtaccgttccttaccgttacgaccgttcccctaccgaaacccggtaccgggacccctacgggtttccccggttaacccctttccccccgggtcgggtcccctcccccgttggtaccccgttacccggacgggtacccctaacccgtaaccccggttcccggaacggaacccg

SEQ ID NO: 204492 - DNA, 779 bp, Homo sapiens
  misc_feature: GYAE6OF02JV7T3.38.28.C06.1.454.CMB.1.raw
  modified_base (140)..(140): a, c, t, g, unknown or other
  misc_feature (140)..(140): n is a, c, g, or t
  modified_base (612)..(612): a, c, t, g, unknown or other
  misc_feature (612)..(612): n is a, c, g, or t
  modified_base (656)..(656): a, c, t, g, unknown or other
  misc_feature (656)..(656): n is a, c, g, or t
  modified_base (716)..(716): a, c, t, g, unknown or other
  misc_feature (716)..(716): n is a, c, g, or t
tcagtcgatcacgtcacgaccggtgctcgatttagagctcacgtattgggtttgggtgccgaagttgctggaggtcacggttcaccatcaccagagacaactccaggagcacactatatctacaaatgcacagcctgagngtcgaggacacggccgtgtattattgtgcgagagactcccaagggtcgaccaccgttgggtcgtctttttggattttcgtagggtcgtccgaaagggtacaaagttcgggttcaaccggttccttctttaccgacggcccttccccgaacccgtaaacggggccccctaagttcccggttccctttacccccccgttgggtccccgtccccgttcggtcccttaccccggtaaggggtaccgacccggtaaccccgtaccgggtaacggaacggaccgtaaccggtaaccggtcccgggtacccccggtggggccctttccgggaccccgtttcggggttacccgaaaacggggttacccttaccgttaaccccgtaaccggttacggtaaccgttccggtaaccgttagggtaacgggcccgggttacgtacggggaccggtaaagggcccggtacgtaacgttaaccggngtacgtcacgagacgtcgcgtagacgcgtcgcgacgtcgtcgtntacgtacgtcgacgtcgtcgtcgtcgtacgcgtacgtacgtacgtacgtaacgtacgacncgtacggtacggacggtagtacgtacgtagtagtagtacgagtcgtacggtacgtacggtcgg

SEQ ID NO: 204493 - DNA, 730 bp, Homo sapiens
  misc_feature: GYAE6OF02GYD31.38.28.C06.1.454.CMB.1.raw
  modified_base (215)..(215): a, c, t, g, unknown or other
  misc_feature (215)..(215): n is a, c, g, or t
tcagtcgatcacgtcacgaccggtgctcgatttagagctcacgtattgggtttgggctgagcgtgcgtttctaggtggctattttaaaaggtgtcagtgtgaggtgcaggtgtcggagtctgggggaggcttgggttcagcctgggggggtccctgagactctcctgtgcagtctctggattaacctttagtgactatgccatgatctgggtccnccaggctccgagggaagggctggagtgggtactcagcaattaagtgggtaggggtgacttcaccatattacgacagacctccgggtggggggccgttcaccgatcaccagacgacaactccgaggagcacactactatctaactaatcgatacaagcctgagacgtacggacgacgtacggccgtaggttacttagtgtcgacgagacgactacccgaacggtcgaaccgtaccgttacgggtcgtaccgttttgtaacgttttcgttcggttacggaccgtaaacggggtaactaaacggttccgggtacctaaacccgggtttccttacctttacccggaaccgttaccccgttaacccggaaaccccgtaacgggggtaacccccctacggttaccccgggttaccccgttttccccccggtacgggacccccgttccccggttacccgtcccgttaacccgggaacgggacccgttaccccggtaaccccgttacccggaccggtaaccgg

SEQ ID NO: 204494 - DNA, 776 bp, Homo sapiens
  misc_feature: GYAE6OF02F9D5O.38.28.C06.1.454.CMB.1.raw
tcagtcgatcacgtcacgaccggtgctcgatttagagctcacgtattggggtttggggctgagctggctttttcttgtggctattttaaaaaggtgtccagtgtgaggtgcaggtgtcggagtctgggggagcttggttcagcctggggggtccctgagactctcctgtgcagtctctggattaaccttagtgactatgccatgatcgtgggtccgccaggtcctccgaggggaacggggctgggacggttgggtcctcgaggactaattaaaggtgggtagggggtagtagttaccaacctataattacgactaaggtaccgtccggggtcggggggccgtttacgaccctaactctaacccgaggacgtaaccaaccgtccgaaggtacgaccaacgtaactaactatacccgtaaacaaatcgaccaatacgtccgtagaacggtagtaccggaaggaaccaccggggtacccggttagttaaacgtttggttaggtacggtacgtaaacggacgtaaccgaaccccggtaaacggggttacaaccccgtacgtttacgggtacttcggttttagttacgttttacgtacggtccggtaaccgggtaaagggaccttaaaagttcggtaccgtaaccgttcgttaccttacaccgtacccttacaacccgggtaacgaccctacgttccggttaccctttcccggcggtaccccgacccttcggacccgtaccggtaccggacgtacccgtacccggtacccggagtacccgg

SEQ ID NO: 204495 - DNA, 740 bp, Homo sapiens
  misc_feature: GYAE6OF02J1HC9.38.28.C06.1.454.CMB.1.raw
  modified_base (191)..(191): a, c, t, g, unknown or other
  misc_feature (191)..(191): n is a, c, g, or t
  modified_base (213)..(213): a, c, t, g, unknown or other
  misc_feature (213)..(213): n is a, c, g, or t
  modified_base (274)..(274): a, c, t, g, unknown or other
  misc_feature (274)..(274): n is a, c, g, or t
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagngactatgccatgatctgggtcnccaggctccagtgaaggggctggagtcgggtctcgagactaagttaagtgggtagggggtnaagttccaaccgtattacttacgacgacggtacctccgggttgggggggacccgtttacaccctaagtccgaacccgagtacgaaccaacgttcccgagggtacgacaaccgtaactatacttacgtaaacaaatcgacacacgcctaggagacgtcgacggtacacggtccttaggtaatttcgtgtcggtacgacggagtaaccgtaccccgtaaggtccgaacctacccgtttgggtacgttcctttagtacgtttcgtacgggtaccggtaccggtaaacgggtaaccgtacgtccgggttaaccctccggtttaccgttccgttacccgacgtaccccggttaccctaaaccgggaccgggtacccctacggtttacccggtcccttacccccgtgggtccccgtcccgtaaccggttccttacccggacggtacccgacccgttaccccgacgtaaccgg

SEQ ID NO: 204496 - DNA, 734 bp, Homo sapiens
  misc_feature: GYAE6OF02IT66N.38.28.C06.1.454.CMB.1.raw
  modified_base (211)..(211): a, c, t, g, unknown or other
  misc_feature (211)..(211): n is a, c, g, or t
  modified_base (266)..(266): a, c, t, g, unknown or other
  misc_feature (266)..(266): n is a, c, g, or t
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaccttagtgactatgccatgatctggtccncaggctccgagggagggctggagtgggtctcagactaattaagtgggtaggggtnagttccaccgtattagttaccgactagacctaccgggtgggggggacccggtttcaacctacgttcccaacccgtaaggacgtaccaaaccgttacccgaagggacgtaccaacgaccttaatactccttaaacaaaactcgacactacggccctaggagacggtacggacggtacgaaccggtccggtttaagttacgttttagttcggttaggacgtaggtaaacgtaccgtacccgaaacgggtcgaacccgtacgtttacgggttacgttacgtttttcgtactttttcgtggttaccggacccgtaaagggaccgttaacgtcgggtaccttacccggttacttccttaccgtcgtaccccgtaccctaccgaaacgggccctacgttcccgttacccttcccccggtcgtacccgtcccgttccgaccgtccgacggaccgtaccgccccgttacgacgacg

SEQ ID NO: 204497 - DNA, 710 bp, Homo sapiens
  misc_feature: GYAE6OF02FJ43G.38.28.C06.1.454.CMB.1.raw
  modified_base (272)..(272): a, c, t, g, unknown or other
  misc_feature (272)..(272): n is a, c, g, or t
  modified_base (344)..(344): a, c, t, g, unknown or other
  misc_feature (344)..(344): n is a, c, g, or t
  modified_base (372)..(372): a, c, t, g, unknown or other
  misc_feature (372)..(372): n is a, c, g, or t
  modified_base (646)..(646): a, c, t, g, unknown or other
  misc_feature (646)..(646): n is a, c, g, or t
tcagtcgatcacgtcacgaccggtgctcgatttagagctcacgtattgggtttgggctgagctggctttttcttgtggctattttaaaaggtgtccagtgtgaggtgcaggtgtcggagtctgggggagcttggttcagcctggggggtccctgagactctcctgtgcagtctctggattaacctttagtgactatgccatgatctgggtccgccaggctccgaggggagggctgggagtgggtctcgagacaattaagtgggtagggggtntattcaccattacgttacgcagtaccgtccgggtggggggccgttcaccatccaccagagacactcgagacncacactatatactaacaaatcgacaacncgtcctaggagtaggtacggaacggaccgaccggggtccgttagttaacttagtttcggtagggtcgaaggacgtaaccgttaccccggtaaacggggttccgaacccgttacccggtttaggtcgttactttttaggtacttttcgttcgggtccgggtaacccggaagggtaacctaacggttccggtaccgtcccgttacgttcgtaccaccgtcccttacccgaaccggtacccgggccctacggttcccggttaccccgttcccccggnggtcccccgtcccgtagtccccgtccggacggtacccgacccgtaccccgtccggaactaccgg

SEQ ID NO: 204498 - DNA, 646 bp, Homo sapiens
  misc_feature: GYAE6OF02FGIY2.38.28.C06.1.454.CMB.1.raw
  modified_base (274)..(274): a, c, t, g, unknown or other
  misc_feature (274)..(274): n is a, c, g, or t
  modified_base (337)..(337): a, c, t, g, unknown or other
  misc_feature (337)..(337): n is a, c, g, or t
  modified_base (593)..(593): a, c, t, g, unknown or other
  misc_feature (593)..(593): n is a, c, g, or t
tcagtcgatcacgtcacgaccggtgctcgatttagagctcacgtattgggtttgggctgagctggctttttcttgtggctattttaaaaggtgtccagtgtgaggtgcaggtgtcggagtctggggggaggcttggttcagcctggggggtccctgagactctcctgtgcagtctctggattaacctttagtgactatgccatgatcgtgggtccgccaggctccgaggggacgggctgggagtgggtctcagctaattaagtgggtaggggtnattcaccatattacgcagaccttcggtggggggccgttcaccatcacagagacaactccaggncacatatatctaacaatgacacgacgtcctggaacgaggtacgagggaacctaccggggcccgttagttaactttagttacggtcggacggaaggaacgtactaccccggtaaacgggtcgaacccgtaccggtttgggtcgtctttttaggtattttcgtggttacgggccgaagggtacaagttcggtacctacggtccttcgttcgacgcccctaccgaaccggacggtccctagtcccggtaccttccccgnggccctacccgtgcccttacgacggtacgacccgtaccgtaccggagtacccg

SEQ ID NO: 204499 - DNA, 755 bp, Homo sapiens
  misc_feature: GYAE6OF02JVIJU.38.28.C06.1.454.CMB.1.raw
  modified_base (457)..(457): a, c, t, g, unknown or other
  misc_feature (457)..(457): n is a, c, g, or t
tcagtcgatcacgtcacgaccggtgctcgatttagagctcacgtattgggtttggggtctgagagaggagcccagccctgggattttcaggcgttttcatttggtgatcaggactgaacagagagaactcaccatggagtttgggctgagcgtggtctttttcttgtggcttaattttaaagtgtccagtgtgaggtgcgaggtgtcggagtcgtggggagtcgttggttcacggtccgttcggggggtccctggacgtaccgtcgtccgtggtgctagttccttcgtacggttaactttaaaccgtttagtacgtaacttcttacggacctgttaggtacgttcggtccgggttccgccgtaacggccgttccgggaaagggggaacggggtccgtaggggtacggtcgggttaccgtacgaacgtaccggttaagttaaggtgggttaacgggtnttacgttaccgtacgtaacgttaacgtttacggacgtcgtaccggttcggggtacgggggtcccttacaccgtacgtacgaccgaagtacgaaccgtaactcgtaaggacgaccactaacgtataacgtaacgtaactaacgtcgtaccacgtaccgtacaaggtcgacggtacgaacggaaccgaccgttcgtaacgttagttaacgtcggtacgtaggaactacggtaaccgtaccgtaaccggtccgtaaacccggttcgttaccgggttactttgttaccgtttcgttgtacgg

SEQ ID NO: 204500 - DNA, 797 bp, Homo sapiens
  misc_feature: GYAE6OF02GOO8J.38.28.C06.1.454.CMB.1.raw
tcagtcgatcacgtcacgaccggtgctcgatttagagctcacgtattgggtttgggctgagctggctttttcttgtggctattttaaaaggtgtccagtgtgaggtgcaggtgtcggagtcgtgggggaggcttggttcagccgtggggggtccctgagactctcctgtgcagtctctggatttaacctttagtagactatcgccatgatcgtcgggtccgccgaggcctccggaggggagggcgtgggagtgggtctcagactaaagttaagtgggtaggggtgtacttaccaaccgtattaacttaccggacgtaacggtaccgttcccgggggtacgggggggtcccgtttaccaacccgtacgtacccaacccgaaggaaccgaacctaaccgtacccgaggacgacctaacctaactatatacctaaacaaagtcgacacagcctaggacgagtacggaaggccgaacggtccgtaagttacgtttagttacggtggaccggaagtagtaaccgtaccccggaaacgggtcctaacccgtacggtttgggtcgtttacgttttcgttacgtttttcgtacgggtaccgaaccggtaaggtaaccgtacgttcggttaccctacccggtttccttaccgtttccgaacccgttccctaaccccgaacccggtaacccgggtaccccgtacgtttccccggtacccccgtttcccccgtgggtccccccgtacccgttacccggaccccgtaccgggtacggaacccgtccccgtacccggtaccggacggccg

SEQ ID NO: 204501 - DNA, 762 bp, Homo sapiens
  misc_feature: GYAE6OF02IXZAC.38.28.C06.1.454.CMB.1.raw
  modified_base (214)..(214): a, c, t, g, unknown or other
  misc_feature (214)..(214): n is a, c, g, or t
  modified_base (343)..(343): a, c, t, g, unknown or other
  misc_feature (343)..(343): n is a, c, g, or t
  modified_base (372)..(372): a, c, t, g, unknown or other
  misc_feature (372)..(372): n is a, c, g, or t
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccnccaggcctccgagggaggggctgggagtgggtctcagcaaattaagtgggaggggtagtattcacctagtaattacgcagactccggtggggggccgttcaccatcaccgagagacaactccaaggacncacactatactctaacaatgaccactaanccgtgagagtacgaggaccaacggtcgtaggttattaacgtttggtacgccggaagacggtaacgttaccccgaacggtttacgaaacccgtaccgtttgggtacgttaccgtttttggtaactttttccgtggttacgggacccgtaaaggggtaaccgtaaacgttcgggttaccgaaccccgtttcgtaccgttctaacgggtaccccttaccggtaacccctaaaccgggggtacccccctacgtttccccgggtttaccccggtttaaccccccccgttaggggtcccccggtacccccgtttaccggtaaccccggtttcccccggaaacgggtaacccgggttccctaaaccccccgggtttcccgggaacggaaaccccggg

SEQ ID NO: 204502 - DNA, 698 bp, Homo sapiens
  misc_feature: GYAE6OF02FPXOB.38.28.C06.1.454.CMB.1.raw
  modified_base (202)..(202): a, c, t, g, unknown or other
  misc_feature (202)..(202): n is a, c, g, or t
  modified_base (225)..(225): a, c, t, g, unknown or other
  misc_feature (225)..(225): n is a, c, g, or t
  modified_base (291)..(291): a, c, t, g, unknown or other
  misc_feature (291)..(291): n is a, c, g, or t
  modified_base (365)..(365): a, c, t, g, unknown or other
  misc_feature (365)..(365): n is a, c, g, or t
  modified_base (386)..(386): a, c, t, g, unknown or other
  misc_feature (386)..(386): n is a, c, g, or t
  modified_base (693)..(693): a, c, t, g, unknown or other
  misc_feature (693)..(693): n is a, c, g, or t
tcagtcgatcacgtcacgaccggtgctcgatttagagctcacgtattgggtttgggctgagctggctttttcttgtggctatttaaaaggtgtccagtgtgaggtgcaggtgtcggagtctgggggagcttggttcacgccgtgggggggtccctggagactctccgtgtgcagtctctggactttaacctttagtcgactntcgcctatcgatcgtcgggtccnccgaggcctccggaggggacggggctagggagtcgggtctcgagactaattagtagggtaggggtnacttcgaacctagttactcggacctaggacgttcccggggtaggggggtccgttaccgaccactccaaccgaanacgaacctacctcgaaggacncgaacacgttatacttacaacaaatcgaccagaccgcgttagaacgaggtcggacggacgacccgggtcttagttattacgttggagtcgtaagccgtaaacgtccccggtaagggtccacccggttacgttggtacgtttctttcgtttacttcgttggaccgcgaacgggactaggtacgtcgtaacccttgtccttacgctacccgtccaaccggtacgccccgttacgtccgttcccgtcccgtacgggtaccccttcggcccttaccgaccgggtgacccgtacgaccccgtacccgggtancccgg

SEQ ID NO: 204503 - DNA, 655 bp, Homo sapiens
  misc_feature: GYAE6OF02I853G.38.28.C06.1.454.CMB.1.raw
  modified_base (286)..(286): a, c, t, g, unknown or other
  misc_feature (286)..(286): n is a, c, g, or t
  modified_base (313)..(313): a, c, t, g, unknown or other
  misc_feature (313)..(313): n is a, c, g, or t
  modified_base (512)..(512): a, c, t, g, unknown or other
  misc_feature (512)..(512): n is a, c, g, or t
tcagtcgatcacgtcacgaccggtgctcgatttagagctcacgtattgggtttggggtctgagagaggagcccagccctgggattttcaggcgttttcatttggtgatcaggactgaacagagagaactcaccatggagtttgggctgagctggctttttctgtggctaattttaaaaggtgtccagtgtgaggtgcaggtgtcggagtcgtgggggagtcttggttcagccgtggggggtccctggacgactctccgtgtgcagtctctggattaaccctttagntacctatgccatgatcgtagggtcccnccgtaggctccgaggccgaaaggggcgtacgggaggtggggtcggacaacgtatactcatatggaacgtaggtaaagttttaaagattacgtaggacggtactccggtaggaacgggtcctagttccaccctatcctaccagtagacgtaattaccaaagacgccaacgacttcgtatttacgactaaattcgaaaccnggacccgttagggagtaccgtaggtaaccggaacgacggtacttgtacttacgttaaccgtaggtagtacccgaaaacggtacccggacccttacgtaggttcggggttaccgggtattaacggttggtacccggtacggggg

SEQ ID NO: 204504 - DNA, 683 bp, Homo sapiens
  misc_feature: GYAE6OF02F9NN9.38.28.C06.1.454.CMB.1.raw
  modified_base (217)..(217): a, c, t, g, unknown or other
  misc_feature (217)..(217): n is a, c, g, or t
tcagtcgatcacgtcacgaccggtgctcgatttagagctcacgtattgggtttgggctgagctggctttttcttgtggctattttaaaaggtgtccagtgtgaggtgcaggtgtcggagtctgggggaggcttggttcagccgtgggggggtccctgagactctcctgtgcagtctctggtattaacctttagtgactatgccatgatctgggtccnccaggctccgagggagggctggaggtggtctcagcaattagtggtagggtgatcacatatacgcacgacgtcggtggggggccgttcaccatcacgagacgacaactccgaaggacgacaacactatatacctaaacaaagcgtaccacgacgcctaggaagacgtacggaggaaccgacgggtccgttagttatttacgttggcgacgaagtacgaccgttacccgtaacgggtctaaccctaccgtttgggttacttcgttttaggacttttcgtgggttaccggaacgtaaagggacttaaggttccggtaccgtacccgtttccttcgtttacaccgtacccctaccgaaccggtaccggccctacggttcccggtacccgtttccccccggtacggtccccgtccccggttcggtaccctacccgggtaggacccgtccgtaaccccgttcgaaggcccgg

SEQ ID NO: 204505 - DNA, 819 bp, Homo sapiens
  misc_feature: GYAE6OF02I5FR7.38.28.C06.1.454.CMB.1.raw
tcagtcgatcacgtcacgaccggtgctcgatttagagctcacgtattggggtttgggctgagctggctttttcttgtggctatttaaaaggtgtccagtgtgaggtgcaggtgtcggagtctgggggaggcttggttcaggccgtggggggtccctgagacctctcctgtgcacgtctctggtatttaaccttagtcgactagtcgaccatggactcgtcgggtcccgaccacggccgtaccggaagggggaacggggtcgtgggtacggtcgggtcctcgaagacttaaagtttaacggtggggttaagggtcgtaattccgaacctatttaaccgtacgactaacggtaccggtccggggtacggggggtcccttacgaaccgtatcccaaccgagaacgaacctaaccgtcggaaggacacctaacgaacgttaactaacgttacctaacaaagtccgaaccgacgtacgtccgtaaggacggtacggtaccggaggtaacccgcggttacgttagttaacttacgttcggacggtcgtaacggacgtaaccgtacccggtaacggtcctaacccggttcgttacggtcgttcgttttgttactttcggttacggtacggttaaccgaagggtaacctaaggttccgttaaccgtcccgtttactaccgtacgtaccgtcccgtaacccgaccgtaacccggtaccgtacccgttccggttacccccggtaccccggttcgggccccgttaccggtccgtcccgttacccgggaccggttacccggacccgtaacccggtacggaacccggtacgg

SEQ ID NO: 204506 - DNA, 927 bp, Homo sapiens
  misc_feature: GYAE6OF02GOYTY.38.28.C06.1.454.CMB.1.raw
tcagtcgatcacgtcacgaccggtgctcgatttagagctcacgtattgggtttgggctgagctggctttttcttgtggctattttaaaaggtgtccagtgtgaggtgcaggtgtcggagtctgggggagcttggttcagcctggggggtccctgagactctcctgtgcagtctctggattaacctttagtgactatgccatgatcgtcgggtccgcgaggcctccggaggggaacgggtcgtgggacggttgggtctcgagactaaagttaagtggggtaggggtgtacttaccgaacctaattaacgttaccggacgtaaggtacccgttcccgggggtacgggggggggtcccgtttaccgaacctaactacccgaacccgaaggaaccgtaaaccgtaaaccttacccggaagggaacggacccaacctaaaccgttaattaccttaaccttaaacaaaacgttcggaacctaacgacggtacccgttaggaaggtaacgggttaccggaacgggaaccgtaccggggtcccgtttaaggtttaacttttagtttacgggtcggaacggtaaggtaacgtaccgttaccccgggaaagggttcccgaaacccgtaacccggttttgggttaccggtttacgttttttacggtaactttttcgggttacggggttaccgggtaaacccggtaaaaggggttacctaaagggtttaccgggttacccggttaacccgtttcctttaacccggttactaacccggtaccccttacccgaaaacccgggtaccggggttacccctaccgggttttccccgtttaccccggttcccccggttacggggtcccccgtacccgttccggtacccgttaccccggggacggtacccggtacccgttaaccccggtacccggacgtaacccgg

SEQ ID NO: 204507 - DNA, 676 bp, Homo sapiens
  misc_feature: GYAE6OF02G7426.38.28.C06.1.454.CMB.1.raw
  modified_base (192)..(192): a, c, t, g, unknown or other
  misc_feature (192)..(192): n is a, c, g, or t
  modified_base (262)..(262): a, c, t, g, unknown or other
  misc_feature (262)..(262): n is a, c, g, or t
  modified_base (378)..(378): a, c, t, g, unknown or other
  misc_feature (378)..(378): n is a, c, g, or t
  modified_base (387)..(387): a, c, t, g, unknown or other
  misc_feature (387)..(387): n is a, c, g, or t
  modified_base (452)..(452): a, c, t, g, unknown or other
  misc_feature (452)..(452): n is a, c, g, or t
  modified_base (668)..(668): a, c, t, g, unknown or other
  misc_feature (668)..(668): n is a, c, g, or t
tcagtcgatcacgtcacgaccggtgctcgatttagagctcacgtattgggtttgggctgagctggtcttttcttgtggctatttaaaggtgtccagtgtgaggtgcaggtgtcggagtctggggggagcttggttcaggccgtggggggtccctgagactctcctgtgcagtctctggacttaacctttagngaactagtcgccgaatgacttcgtcggggtccaccgaggctaccgaggggtaaggggctggagtggtacncagctaaagtgtgggtaggttgattcgacatattacgcaggtcctccgggtaggggggtccgttcacgtactccaccgagacgaacgtaactccgaggacgactaactactaaatntaccctaanaaagtcgacgacacgtccgagtagtacgtcggacgtaacgacgggtaccgtgttaaattgttcgngtcgagtagacgtacccgtacgtcgaccgtacgttacgggcttctttgaagttttccgtgggtaacgtccgaaagggtacaaacgggtggttccctacgggttccctacttcaccgtcccctaacggaccgaaacgggtccagttaccgtcccgttacccggccggtccacccgttcgacccgtttcggacgggtacctaccgacccggttaccgnggaaccgg

SEQ ID NO: 204508 - DNA, 929 bp, Homo sapiens
  misc_feature: GYAE6OF02F5GOF.38.28.C06.1.454.CMB.1.raw
tcagtcgatcacgtcacgaccggtgctcgatttagagctcacgtattggggtttgggctgagctggctttttcttgtggctattttaaaaggtgtccagtgtgaggtgcaggtgtcggagtctggggggaggcttggttcagccgtgggggggtccctgagactctcctgtgcagtctctggtactttaaccgtttagtgactatgccatgactcgtcgggtccgccgaggcctccggaagggggaaggggctagggaggttggggtctacgagtactaaatttaaggtggggttaaggggtataacttccgaaccgtaattaacgttaaccgcctaacggtaccgtttccgggggtaggggggggtcccgtttaccaaccctagtacccgaaccgaaggaacgaacctaacccgtccggaacgggtaacaccgaaactaaccttaattactaaccttaacaaaatccggaactaacgaccgtccgtaagaggacggtacggaacggacgtaccgggtaccgtttagttaactttagtttcggaccgaaggtaacgaacgtaccgtaacccccggtaacgggtacccgtaaacccgttccggtttgggtaccgttttcggttttaggtttaacgtttttccgggttacgggttacggtaaacccgggttaaagggtaaccgtttaaacggtttcccggggttaacccgttaccccgttttacccgtttacccggttaaccccgtacccgggttacccctaaccccgggtaaaccccgggtaaaccccggggccccgttttaaccggtcccccggggttttacccccgttccccgggacccccggggtcccccttccccggttacccggacccggttcccggaaacccggttccggtacccccgttaaccccgtaccgggaggaacccgg

SEQ ID NO: 204509 - DNA, 918 bp, Homo sapiens
  misc_feature: GYAE6OF02IIG0P.38.28.C06.1.454.CMB.1.raw
  modified_base (198)..(198): a, c, t, g, unknown or other
  misc_feature (198)..(198): n is a, c, g, or t
  modified_base (267)..(267): a, c, t, g, unknown or other
  misc_feature (267)..(267): n is a, c, g, or t
tcagtcgatcacgtcacgaccggtgctcgatttagagctcacgtattgggtttgggctgagctggcttttctgtggctaattttaaaaggtgtccagtgtgaggtgcaggtgtcggagtcgtgggggacggcttggttcaggccgtggggggtccctgagactctcctgtagcagtctcgtggtactttacctttagntacgtatcgcctagtgtacgtcgtcgggtacccgccgacgggtcctccggaaggggaacgggtctgggnggtcgggttcacgaggactaattaggtgggtaggggttatacttccactaagttacgttaccgacgacgtaccggtccggggtcgggggtaccgttcgaaccctacgtacccgaacccgaaggtaccgaaaccgtaaccgttaccggaagggactacctaaacgtacggtaactttaacgtaaccgttaaccaaaaggtccaacgtaaccgtaacgttaccggaaggtacgtaacgggttacggaaccggtaaccggttcccgggtaacccggtttagtttaaacggtttacgggttaccgggtaggtaaccggaaaccgggttaacgtaccccgtaaccccggggttaaaacgggtcccgttaaaccccgttacccgggttggttacccgggtttttacgtttacggttacgttttccccggttaggggtaccggtaacccggtttaaaacgggaacgttaacgttccggttaaaccccggttattcccgtttactacccgggaacctttaccccgaaccgttaaaccggggtacccgttaccgtacccggttttaccccgggttcccgtcccccgtaacggggtccccttcccggttacgaccctttacgggacggttcccacccgttacggccggtaacgtacccggg

SEQ ID NO: 204510 - DNA, 738 bp, Homo sapiens
  misc_feature: GYAE6OF02HQYVH.38.28.C06.1.454.CMB.1.raw
  modified_base (298)..(298): a, c, t, g, unknown or other
  misc_feature (298)..(298): n is a, c, g, or t
  modified_base (631)..(631): a, c, t, g, unknown or other
  misc_feature (631)..(631): n is a, c, g, or t
tcagtcgatcacgtcacgaccggtgctcgatttagagctcacgtattgggtttgggctgagctggctttttcttgtggcttattttaaaacggtgtccagtgtgaggtgcaggtgtcggagtcgtgggggagcttggtcagccgtaggggggtccctgagacttctcctgtgcagtctctggaattaaccttgtagactaatcgcctatcgaatcgtcggtccacgaggtcctaccggaagggaagggtctgggtagttacgggtctacgaacgactaagttaaggtgggtaagggtntacgttcactagtactacgtcgaagtcgtcgggtcggggtactacaaccgataccaacgagacgaaccgtaaccgtcgaacggacgtacaaacgtaccttaataccgtacgtaaaacacgtagaccaacgttacgcgtaacggtagaaaccggttcgaaacggtacgtaccgggtacttaggtattacggtagtacggacgtacggtaacaaccgtaccggtaacggtaccgaaccgttacgttacgggttacgttacgttttacggtaacgtttcgtacgggtacgaaccggtaggtaaagtaacgtcggtacccgtaacgtcttaccgtanaccggtccctaacggaaacctaccgggtacctacgttccggtcccgttccgtaccggccctccgtacgacctaccggactaccgaccccaacggtaccgacgtaacg

SEQ ID NO: 204511 - DNA, 189 bp, Homo sapiens
  misc_feature: GYAE6OF01ETS14.53.34.D01.1.454.CMB.1.raw
  modified_base (189)..(189): a, c, t, g, unknown or other
  misc_feature (189)..(189): n is a, c, g, or t
tcagcgcgtatacacacgaccggtgctcgatttagatcgtctgtgttgggtttgggacagcaaccctgattgggtgttcggcggagggaccaaactgaccgtcctaggtcagcccaaggctgccccctcggtcactctgttcccaccctcctctcgtactgcgctgagcgggctggcaaggcgcatagn

SEQ ID NO: 204512 - DNA, 201 bp, Homo sapiens
  misc_feature: GYAE6OF01BA24V.53.34.D01.1.454.CMB.1.raw
  modified_base (186)..(201): a, c, t, g, unknown or other
  misc_feature (186)..(201): n is a, c, g, or t
tcagcgcgtatacacacgaccggtgctcgatttagatcgtctgtgttgggtttgggacagcaaccctgattgggtgttcggcggagggaccaaactgaccgtcctaggtcagcccaaggctgcccctcggtcactctgttcccacctcctctcgtactgcgctgagcggctggcaaggcgcatagnnnnnnnnnnnnnnnn

SEQ ID NO: 204513 - DNA, 110 bp, Homo sapiens
  misc_feature: GYAE6OF02HZWZZ.53.34.D01.1.454.CMB.1.raw
tcagcgcgtatacacacgaccggtgctcgatttagatcgtctgtgttgggtttgggttagctaggactccggggtacgcactcgtctgagcgggctggcaaggcgcatag

SEQ ID NO: 204514 - DNA, 637 bp, Homo sapiens
  misc_feature: GYAE6OF01D5HTK.33.16.B05.1.454.CMB.1.raw
  modified_base (249)..(249): a, c, t, g, unknown or other
  misc_feature (249)..(249): n is a, c, g, or t
  modified_base (300)..(300): a, c, t, g, unknown or other
  misc_feature (300)..(300): n is a, c, g, or t
  modified_base (303)..(303): a, c, t, g, unknown or other
  misc_feature (303)..(303): n is a, c, g, or t
  modified_base (430)..(430): a, c, t, g, unknown or other
  misc_feature (430)..(430): n is a, c, g, or t
  modified_base (438)..(438): a, c, t, g, unknown or other
  misc_feature (438)..(438): n is a, c, g, or t
  modified_base (447)..(447): a, c, t, g, unknown or other
  misc_feature (447)..(447): n is a, c, g, or t
  modified_base (487)..(487): a, c, t, g, unknown or other
  misc_feature (487)..(487): n is a, c, g, or t
  modified_base (611)..(611): a, c, t, g, unknown or other
  misc_feature (611)..(611): n is a, c, g, or t
tcagtacacacactcacgaccggtgctcgatttagagctcacgtatttggggtttggggggagctctgggggagttctgcaccatggcttggaccccatcctcttcctcaccctcctcctccactgcacagggtctctctccagtcttgtgctgtacctacaatccgccctctgcctctcgcccttccggtaggggactcccgttgggacaacgtcctactactcgtcggacctacggttcgaggaacnggtaaagggcgggacactaacggtaccaaaccgttacggactacgtccganagngtacatcgacgcacagacgcgaacggaggaaccggtcctaagggtactagtaacgaaggtaaggtaactagcgatcgagacgactaacggaggacgggactactcgtgtaacttcggttagaccggngtagtcgnggtcgtacnggaccggtttcactacgactacactcgtacctcgcagttntcgtaggaacgtgtaggacttacgattaacgtacgtctaggtactacggtacgggtgttactaggttcgttaggtgtacggggtacgacgggtaacgacgttcgacggtctccgtacgtcgacncccgtaacgacgtcgtcccgccgtac

SEQ ID NO: 204515 - DNA, 781 bp, Homo sapiens
  misc_feature: GYAE6OF02HKDRF.33.16.B05.1.454.CMB.1.raw
tcagtacacacactcacgaccggtgctcgatttagagctcacgtagttagggggtttgggggagactcgtggggagtctgcaccgatggcttggaccccacgtcctcgttcctcaccctcctcctccactgcacagggtctctctcccagcttggtcgcgtcgactcaatccgcctctcgcctctcgccctcccgtgggacgtccgtcgtcaagctcactctcgacctactcgtcgagcgtaggtggaccacgacgactaacgtacgtacctagtccgtactacgtcggactacgtacgacgacgacgacgacgacgaacggaaccggaacccggtaccgttacggtacgttagtaacgttaaggtaacggtaacgaggtacggtacgtacggacgtacgtaccgtaacggaacgggtaacgggtacggtacgtaccgtacgttacgttacgttacggacggtacgtacgtacgtcggtacggtacgtacgacgtaccgtacctaccgtaccgtacctaccgtaccgtaccgtacgtaccgtacggtacgtacgtaggtaaggttacgtacggtacgtacgtaacgtaaccttacgtacgtacgtaaccggtacggtaccgggttacgggtaccgtttacggtttacgggttacggtttacggggttacgggttaccgggacgggtaacggtaccgtaccggtaccggtacggtaacccggtacggtaaccggtacccgtaaccggtacccgtaccggtcccgtacccggtacccgtaccg

SEQ ID NO: 204516 - DNA, 575 bp, Homo sapiens
  misc_feature: GYAE6OF01BNNV2.47.50.E06.1.454.CMB.1.raw
  modified_base (175)..(175): a, c, t, g, unknown or other
  misc_feature (175)..(175): n is a, c, g, or t
  modified_base (197)..(197): a, c, t, g, unknown or other
  misc_feature (197)..(197): n is a, c, g, or t
  modified_base (212)..(212): a, c, t, g, unknown or other
  misc_feature (212)..(212): n is a, c, g, or t
  modified_base (223)..(223): a, c, t, g, unknown or other
  misc_feature (223)..(223): n is a, c, g, or t
tcagagctcacgtacacgaccggtgctcgatttagatctactgacaacacacaagggggagagaagacaggattcaggacaatctccagcatggccggcttccctctcctcctccaccctcctcactcactgtgcagggtcctgggcccagtctgtgctgactcagcccaccctnagcgtcgtcggggacccccggnagacgtcaccatctnttgtctggaancagctacaatatcggaaatgataatgtatactggtaccagcaagtcccaacgaaccggacccccaaactcctacatctaataacaatgatcagcggccctcgacggggtccctggccgattctcgtggctccaagtctggcgcctcacgcccaccctggccatcagtcggctcccggccgaggatgagctgattatactgtgtaggttggagtcgcagcctgacctgtccttacgtcttcgggacgtcgtacgggaccgtaaggtcctacccggtccgttagggtccacggacccccgaaagggaccccctaaacccccgtacgtacgttacccaccgttcccgttccccgg

SEQ ID NO: 204517 - DNA, 655 bp, Homo sapiens
  misc_feature: GYAE6OF01AZSA0.47.50.E06.1.454.CMB.1.raw
  modified_base (193)..(193): a, c, t, g, unknown or other
  misc_feature (193)..(193): n is a, c, g, or t
  modified_base (231)..(231): a, c, t, g, unknown or other
  misc_feature (231)..(231): n is a, c, g, or t
  modified_base (364)..(364): a, c, t, g, unknown or other
  misc_feature (364)..(364): n is a, c, g, or t
  modified_base (371)..(371): a, c, t, g, unknown or other
  misc_feature (371)..(371): n is a, c, g, or t
tcagagctcacgtacacgaccggtgctcgatttagatctactgacaacacacaaggggagagaagacaggattcaggacaatctccagcatggccggcttccctctcctcctcaccctcctcactcactgtgcagggtcctgggcccagtctgtgctgactcagccaccctcagcgtctcgggacccccgggnagagggtcactatctcttgttctggaagcagctccaanatacggaaatgataatgtatactggtaccagcaagtcccacgaaccggcccccaaactcctaatctaataacaatgatcgagccggcctcgagggtccctggcctattctcgtcggctaccgaagtctggccncctcacncccgaccctggccatcgaggttcgggccttcccggcccgaggactggacggactgtaatttacgttacgtggttaggttagggttgggactcgcgacgtcccgtgtaaccgtcgtactttaaccgggttccgtttcgggagtccggttacggggaacccttaaacgggtcccttaaccccgggtccgtacgggttacccacgggtaccccccaaaacggggtacccccctaacccccgaacggttcgttaaccctacccgttcccgttccgtttaccccccccg

SEQ ID NO: 204518 - DNA, 555 bp, Homo sapiens
  misc_feature: GYAE6OF02HDMB9.47.50.E06.1.454.CMB.1.raw
tcagagctcacgtacacgaccggtgctcgatttagatctactgacaacacacaaggggagagaagacaggattcaggacaatctccagcatggccggcttccctctcctcctcaccctcctcactcactgtgcagggtcctgggcccagtctgtgctgactcagccaccctcagcgtctgggacccccggcagagggtcactatctcttgttctggaagcagctccaacatacgtaaaaaaatttgtatactggtatcagcaactccaggaaccgcccccaaactcctcatgtctaaggaataatcagccggccctcgacgggtccctgaccgattctctggctccaagtctggccacctcacgccctccctggcccatcgaggtcgggcctccgggtccgaggatggaggctgtatttagttacgtgtgcagcagtgggtatgacacgccgtcgccgtgtcgtagttgggttcggttcggacgggacggaccgagcgtcggaccgtcgtacggtcacgcccgaggcctccgtccccgtcggtccaccgttcccg

SEQ ID NO: 204519 - DNA, 749 bp, Homo sapiens
  misc_feature: GYAE6OF02HDKWL.47.50.E06.1.454.CMB.1.raw
  modified_base (172)..(172): a, c, t, g, unknown or other
  misc_feature (172)..(172): n is a, c, g, or t
  modified_base (191)..(191): a, c, t, g, unknown or other
  misc_feature (191)..(191): n is a, c, g, or t
tcagagctcacgtacacgaccggtgctcgatttagatctactgacaacacacaaggggagagaagacaggattcaggacaatctccagcatggccggcttccctctcctcctcaccctcctcactcactgtgcagggtcttgggcccagtctgtgctgactcagccaccctnagcgtctgggacccccggnagacggtcaccatctcttgttctggaagcagctccaatatcggaaatgataatgtatactggtaccagcaagtcccacgaaccggcccccaaaccctcatctaataacaatgatcagccggccctcgacggggtccctggccgattccgtctcggcctaccgaagttccgtcgggccgccctcgacggtcccctaccccgtcggaccctaatccgtaacgggtcggggtcccgtccccgggaccccggtaagggacgttacgggacgggtccgttaggtaacttttaacgtttaccgttggttaggttacggggttttcggggacgttccggaccgtaacggttcccgttacggaccgtttcggtaccgttttaaccggttccgttttaccggggacggtacccggttacgggggaaccccgttaacgggttacccgtaacccgggttccccgttaaggggtaccctaccgggtacccccgtaaacccgggaccccctaaaccccccgtacgttacccggttacccgtacccgtttcccgttacccggttaccccccc

SEQ ID NO: 204520 - DNA, 760 bp, Homo sapiens
  misc_feature: GYAE6OF02F0EN5.47.50.E06.1.454.CMB.1.raw
  modified_base (333)..(333): a, c, t, g, unknown or other
  misc_feature (333)..(333): n is a, c, g, or t
tcagagctcacgtacacgaccggtgctcgatttagatctactgacaacacacaaggggagagaagacaggattcaggacaatctccagcatggccggcttccctctcctcctcaccctcctcactcactgtgcagggtcctgggcccagtctgtgctgactcagccaccctcagcgtctcgggacccccggcagagggtcactatctcttgttcgtggaagcagctaccaacatacgtaaaaaattttgaatactggtatcagcaacctccaggaaccgcccccaaactcctcatcgtctaaggaataatcagccgccctcgacggggtcccngaccgattctcgtcggctacgaagtcgtggcacctcacgtccctcctcggcctatcgaggtcgggtccgtccgggtaccggaggtacgtacgggacggtccttaggtaactttaacgttaccgtaggtcgtaccaacggtccgtaaggttcgggggtaacttcggaaacccgtacgggtccccttaggccccggtttaggggtacctttagggggttttcgggggttcgggtttacccgggggacggggtaaaccggggtaacccgtaacgggttcccggtaacgggttaacccccgggttaccggtttaaccgggggttaccccgaacccgggtaaaccccccggggtaaacccggttaccccccgtaaaaaacccccccggttcggttcccggtaacccccgttacccgttttacccccccgggg

SEQ ID NO: 204521 - DNA, 712 bp, Homo sapiens
  misc_feature: GYAE6OF02IXG2C.47.50.E06.1.454.CMB.1.raw
  modified_base (195)..(195): a, c, t, g, unknown or other
  misc_feature (195)..(195): n is a, c, g, or t
  modified_base (283)..(283): a, c, t, g, unknown or other
  misc_feature (283)..(283): n is a, c, g, or t
tcagagctcacgtacacgaccggtgctcgatttagatctactgacaacacacaaggggagagaagacaggattcaggacaatctccagcatggccggcttccctctcctcctcaccctcctcactcactgtgcagggtcctgggcccagtcgtgtgctgactcagccaccctcagccgtcgtcggggaccccggnacggtagggtcactactcttcttgttactaggaacgcagccttaccaacattaaacgtaaaaaattttgaacttacgtggtatacganacaacctccgaacggaacccgaccccctaaactccgttacacgtcttacgtaaggtaacttactacgacggacccggtcctacggaccgggttccctacggaccgtatttccgtcgtcggccttaccaacgttcgacggtacccacgtacacgtccctacgtcgcttacgcgtacggtccgggtccgtccggtaccgtagggtcgtacggtacgtacgtaacgttagtttaacgttaggtacgtcgtacaacgtcgtaaggtcgggtactacgaccgtcgtaccgttcgtccgtaggttacgtttaggtcgggttacgggtaccggacgggtaacgaaccgtacgggcctacccgggtactccggttaacggacgtacccggacgtaaccggtccgtacccgtacccggtcgttacctccgttaccccg

SEQ ID NO: 204522 - DNA, 299 bp, Homo sapiens
  misc_feature: GYAE6OF01CD9UM.14.12.B01.1.454.CMB.1.raw
  modified_base (290)..(299): a, c, t, g, unknown or other
  misc_feature (290)..(299): n is a, c, g, or t
tcagcgtctagtaccacgaccggtgctcgatttagtagtgtagattccgcgggccactggcatcccagacaggttcagtggcagtgggtctgggacagacttcactctcaccatcagcagactggaagctgaagattttgcagtgtattactgtcagcagtatggtagttcaccgtacacttttggccaggggaccacggtggtgatcaaacgaactgtggctgcaccatctgtcttcatcttcccgcatctgagtactagacgctgagcgggctggcaaggcgcatagnnnnnnnnnn

SEQ ID NO: 204523 - DNA, 311 bp, Homo sapiens
  misc_feature: GYAE6OF01DRGFM.14.12.B01.1.454.CMB.1.raw
  modified_base (294)..(311): a, c, t, g, unknown or other
  misc_feature (294)..(311): n is a, c, g, or t
tcagcgtctagtaccacgaccggtgctcgatttagtagtgtagattccgcggggccgactggcatcccagacaggttcagtggcagtgggtcctgggacagacttcactctcaccatcagcagactggaagctgaagattttgcagtgtattactgtcagcagtatggtagttcacgtacacttttggccaggggaccacggtggtgatcaaacgaactgtggctggcaccatctgtcttcatcttcccgccatctgagtactagacgctgagcgggctggcaaggcgcatagnnnnnnnnnnnnnnnnnn

SEQ ID NO: 204524 - DNA, 296 bp, Homo sapiens
  misc_feature: GYAE6OF01A8EEO.14.12.B01.1.454.CMB.1.raw
  modified_base (291)..(296): a, c, t, g, unknown or other
  misc_feature (291)..(296): n is a, c, g, or t
tcagcgtctagtaccacgaccggtgctcgatttagtagtgtagattccgcgggccactggcatcccagacaggttcagtggcagtgggtctgggacagacttcactctcaccatcagcagactggaagccgaagattttgcagtgtattactgtcagcagtatggtagttcaccgtacacttttggccaggggaccacggtggtgatcaaacgaactgtggctgcaccatctgtcttcatcttcccgccatctgagtactagacgctgagcgggctggcaaggcgcatagnnnnnn

SEQ ID NO: 204525 - DNA, 334 bp, Homo sapiens
  misc_feature: GYAE6OF01AJKUY.14.12.B01.1.454.CMB.1.raw
  modified_base (297)..(334): a, c, t, g, unknown or other
  misc_feature (297)..(334): n is a, c, g, or t
tcagcgtctagtaccacgaccggtgctcgatttagtagtgtagattccgcggggccgacgtggcatcccagacaggttcagtggcagtgggtctggggaccagacttcactctcgaccatcagcagactggaagctgaagattttgcagtgtattactgtcagcagtatggtagttcaccgtacacttttggccaggggaccacggtggtgatcaaacgaactgtggctgcaccatctgtcttcatcttaccgcatctgagtactagacgctcgagcgggctggcaaggcgcatagnnnnnnnnnnnnnnnnnnnnnnnnnnnnnnnnnnnnnn

SEQ ID NO: 204526 - DNA, 301 bp, Homo sapiens
  misc_feature: GYAE6OF01DEQNV.14.12.B01.1.454.CMB.1.raw
  modified_base (292)..(301): a, c, t, g, unknown or other
  misc_feature (292)..(301): n is a, c, g, or t
tcagcgtctagtaccacgaccggtgctcgatttagtagtgtagattccgcggggccactgggcatcccagacaggttcagtggcagtgggtctgggacagacttcactctcaccatcagcagactggaagctgaagattttgcagtgtattactgtcagcagtatggtagttcaccgtacacttttggccaggggaccacggtggtgatcaaacgaactgtggctgcaccatctgtcttcatcttcccgcatctgagtactagacgctgagcgggctggcaaggcgcatagnnnnnnnnnn

SEQ ID NO: 204527 - DNA, 295 bp, Homo sapiens
  misc_feature: GYAE6OF01B60BE.14.12.B01.1.454.CMB.1.raw
  modified_base (291)..(295): a, c, t, g, unknown or other
  misc_feature (291)..(295): n is a, c, g, or t
tcagcgtctagtaccacgaccggtgctcgatttagtagtgtagattccgcggggccactggcatcccagacaggttcagtggcagtgggtctgggacagacttcactctcaccatcagcagactggaagctgaagattttgcagtgtattactgtcagcagtatggtagttcaccgtacacttttggccaggggaccacggtggtgatcaaacgaactgtggctgcaccatctgtcttcatcttcccgcatctgagtactagacgctgagcgggctggcaaggcgcatagnnnnn

SEQ ID NO: 204528 - DNA, 294 bp, Homo sapiens
  misc_feature: GYAE6OF01CZQ7C.14.12.B01.1.454.CMB.1.raw
  modified_base (290)..(294): a, c, t, g, unknown or other
  misc_feature (290)..(294): n is a, c, g, or t
tcagcgtctagtaccacgaccggtgctcgatttagtagtgtagattccgcggggccactggcatcccagacaggttcagtggcagtgggtctgggacagacttcactctcaccatcagcagactggaagctgaagattttgcagtgtattactgtcagcagtatggtagttcaccgtacacttttggccaggggaccacggtggtgatcaaacgaactgtggctgcaccatctgtcttcatcttccgcatctgagtactagacgctgagcgggctggcaaggcgcatagnnnnn

SEQ ID NO: 204529 - DNA, 327 bp, Homo sapiens
  misc_feature: GYAE6OF01C2XTC.14.12.B01.1.454.CMB.1.raw
  modified_base (296)..(327): a, c, t, g, unknown or other
  misc_feature (296)..(327): n is a, c, g, or t
tcagcgtctagtaccacgaccggtgctcgatttagtagtgtagattccgcggggccactgggcatcccagacaggttcagtgggcagtgggtctgggacagacttcactctcgccatctagcagactggaagctgaagattttgcagtgtattactgtcagcagtatggtagttcaccgttacactttttggccaggggaccacggtggtgatcaaacgaactgtggctgcaccatctgtcttcatcttcccgcatcctgagtactagacgctgagcggctggcaaggcgcatagnnnnnnnnnnnnnnnnnnnnnnnnnnnnnnnn

SEQ ID NO: 204530 - DNA, 292 bp, Homo sapiens
  misc_feature: GYAE6OF01BVCKH.14.12.B01.1.454.CMB.1.raw
  modified_base (291)..(292): a, c, t, g, unknown or other
  misc_feature (291)..(292): n is a, c, g, or t
tcagcgtctagtaccacgaccggtgctcgatttagtagtgtagattccgcggggccactggcatcccagacaggttcagtggcagtgggtctgggacagacttcactctcaccatcagcagactggaagctgaagattttgcagtgtattactgtcagcagtatggtagttcaccgtacacttttggccaggggaccacggtggtgatcaaacgaactgtggctgcaccatctgtcttcatcttccgccatctgagtactagacgctgagcgggctggcaaggcgcatagnn

SEQ ID NO: 204531 - DNA, 299 bp, Homo sapiens
  misc_feature: GYAE6OF01ER496.14.12.B01.1.454.CMB.1.raw
  modified_base (293)..(299): a, c, t, g, unknown or other
  misc_feature (293)..(299): n is a, c, g, or t
tcagcgtctagtaccacgaccggtgctcgatttagtagtgtagattccgcggggccactggcatcccagacaggttcagtggcagtgggtctgggacagacttcactctcaccatcagcagactggaagctgaagattttgcagtgtattactgtcagcagtatggtagttcaccgtacacttttggccaggggaccacggtggtgatcaaacgaactgtggctgcaccatctgtcttcatccttcccgccatctgagtactagacgctgagcgggctggcaaggcgcatagnnnnnnn

SEQ ID NO: 204532 - DNA, 295 bp, Homo sapiens
  misc_feature: GYAE6OF01E5Y3A.14.12.B01.1.454.CMB.1.raw
  modified_base (290)..(295): a, c, t, g, unknown or other
  misc_feature (290)..(295): n is a, c, g, or t
tcagcgtctagtaccacgaccggtgctcgatttagtagtgtagattccgcggggccactggcatcccagacaggttcagtggcagtgggtctgggacagacttcactctcaccatcagcagactggaagctgaagattttgcagtgtattactgtcagcagtatggtagttcaccgtacacttttggccaggggaccacggtggtgatcaaacgactgtggctgcaccatctgtcttcatcttccgccatctgagtactagacgctgagcgggctggcaaggcgcatagnnnnnn

SEQ ID NO: 204533 - DNA, 300 bp, Homo sapiens
  misc_feature: GYAE6OF01D1VA1.14.12.B01.1.454.CMB.1.raw
  modified_base (291)..(292): a, c, t, g, unknown or other
  misc_feature (291)..(292): n is a, c, g, or t
  modified_base (294)..(300): a, c, t, g, unknown or other
  misc_feature (294)..(300): n is a, c, g, or t
tcagcgtctagtaccacgaccggtgctcgatttagtagtgtagattccgcggggccactggcatcccagacaggttcagtggcagtgggtctgggacagacttcactctcaccatcagcagactggaagctgaagattttgcagtgtattactgtcagcagtatggtagttcaccgtacacttttggccaggggaccacggtggtgatcaaacgaactgtggctgcacatctgtcttcatccttcccgcatctgacgtactagacgctgagcggctggcaaggcgcatagnngnnnnnnn

SEQ ID NO: 204534 - DNA, 294 bp, Homo sapiens
  misc_feature: GYAE6OF01B6KFX.14.12.B01.1.454.CMB.1.raw
  modified_base (290)..(294): a, c, t, g, unknown or other
  misc_feature (290)..(294): n is a, c, g, or t
tcagcgtctagtaccacgaccggtgctcgatttagtagtgtagattccgcggggccactggcatcccagacaggttcagtggcagtgggtctgggacagacttcactctcaccatcagcagactggaagctgaagattttgcagtgtattactgtcagcagtatggtagttcaccgtacacttttggccaggggaccacggtggtgatcaaacgaactgtggctgcaccatctgtcttcatcttcccgctctgagtactagacgctgagcgggctggcaaggcgcatagnnnnn

SEQ ID NO: 204535 - DNA, 296 bp, Homo sapiens
  misc_feature: GYAE6OF01DA9ZY.14.12.B01.1.454.CMB.1.raw
  modified_base (288)..(296): a, c, t, g, unknown or other
  misc_feature (288)..(296): n is a, c, g, or t
tcagcgtctagtaccacgaccggtgctcgatttagtagtgtagattccgcggggccactggcatcccagacaggttcagtggcagtgggtctgggacagacttcactctcaccatcagcagactggaagctgaagattttgcagtgtattactgtcagcagtatggtagttcaccgtacacttttggccaggggaccacggtggtgatcaaacgactgtgctgcaccatctgtcttcactcttcccgcatctgagtactagacgctgagcggctggcaaggcgcatgnnnnnnnnn

SEQ ID NO: 204536 - DNA, 306 bp, Homo sapiens
  misc_feature: GYAE6OF01DRFPN.14.12.B01.1.454.CMB.1.raw
  modified_base (263)..(263): a, c, t, g, unknown or other
  misc_feature (263)..(263): n is a, c, g, or t
  modified_base (291)..(306): a, c, t, g, unknown or other
  misc_feature (291)..(306): n is a, c, g, or t
tcagcgtctagtaccacgaccggtgctcgatttagtagtgtagattccgcggggccactggcatcccagacaggttcagtggcagtgggtctgggacagacttcactctcaccatcagcagactggaagctgaagatttgcagtgtattactgtcagcagtatggtagttcaccgtacacttttggcacggggaccaggtggtcgatccaaacgactgtggctgcaccatctgtcttcatcttcccgcatctgatactagacncgtgagcggctggcaaggcgacagtagnnnnnnnnnnnnnnnn

SEQ ID NO: 204537 - DNA, 308 bp, Homo sapiens
  misc_feature: GYAE6OF01D00Z1.14.12.B01.1.454.CMB.1.raw
  modified_base (296)..(308): a, c, t, g, unknown or other
  misc_feature (296)..(308): n is a, c, g, or t
tcagcgtctagtaccacgaccggtgctcgatttagtagtgtagattccgcggggccactggcatcccagacaggttcagtggcagtgggtctgggacagacttcactctcaccatcagcagactggaagctgaagattttgcagtgtattactgtcagcagtatggtagttcaccgtacacttttggccagggccacggtggtgatcaaacgaactgtgctgcaccatctgtcttcatcctccgccatctagagtactagaccgcttagagcgggtactgggctaaggcacatagnnnnnnnnnnnnn

SEQ ID NO: 204538 - DNA, 392 bp, Homo sapiens
  misc_feature: GYAE6OF01C8PAN.14.12.B01.1.454.CMB.1.raw
  modified_base (137)..(137): a, c, t, g, unknown or other
  misc_feature (137)..(137): n is a, c, g, or t
  modified_base (338)..(338): a, c, t, g, unknown or other
  misc_feature (338)..(338): n is a, c, g, or t
  modified_base (341)..(392): a, c, t, g, unknown or other
  misc_feature (341)..(392): n is a, c, g, or t
tcagcgtctagtaccacgaccggtgctcgatttagtagtgtagattccgcggggccactggcatcccagacaggttcagtggcagtgggtctgggacagacttcactctcaccatcagcagactggaagctgaagtnttttgcagtgtattactgtcagcagtatggtacgttcaccgttactagttttcggaccgaggggacctacgggtggtgatacgaaacgactggtcggctcgcaactagtcctcgttcttacgctttcctcccgtctatctagtacgtacgtagcgtagtggacggtcggtcgtacgggaccgaacgggtccgaataagtgnatnnnnnnnnnnnnnnnnnnnnnnnnnnnnnnnnnnnnnnnnnnnnnnnnnnnn

SEQ ID NO: 204539 - DNA, 318 bp, Homo sapiens
  misc_feature: GYAE6OF01BUIGX.14.12.B01.1.454.CMB.1.raw
  modified_base (261)..(261): a, c, t, g, unknown or other
  misc_feature (261)..(261): n is a, c, g, or t
  modified_base (279)..(279): a, c, t, g, unknown or other
  misc_feature (279)..(279): n is a, c, g, or t
  modified_base (305)..(305): a, c, t, g, unknown or other
  misc_feature (305)..(305): n is a, c, g, or t
  modified_base (308)..(318): a, c, t, g, unknown or other
  misc_feature (308)..(318): n is a, c, g, or t
tcagcgtctagtaccacgaccggtgctcgatttagtagtgtagattccgcggggccactggcatcccagacaggttcagtggcagtgggtctgggacagacttcactctcaccatcagcagactggaagctagaagtattttgcagtcgttattactgtcagcagtatggtagttcaccgtactacgttttggccgaggggtaccacgggtggtagatacgaaacgactggtggctgcaccatctgtctcagtcctcccgnactctgtagtacagacgntggaggcggtctggacgaggcgctanagnnnnnnnnnnn

SEQ ID NO: 204540 - DNA, 295 bp, Homo sapiens
  misc_feature: GYAE6OF02G6ZUV.14.12.B01.1.454.CMB.1.raw
  modified_base (291)..(295): a, c, t, g, unknown or other
  misc_feature (291)..(295): n is a, c, g, or t
tcagcgtctagtaccacgaccggtgctcgatttagtagtgtagattccgcgggccactggcatcccagacaggttcagtggcagtgggtctgggacagacttcactctcaccatcagcagactggaagctgaagattttgcagtgtattactgtcagcagtatggtagttcaccgtacacttttggccaggggaccacggtggtgatcaaacgaactgtggctgcaccatctgtcttcatcttcccgccatctgagtactagacgctgagcgggctggcaaggcgcatagnnnnn

SEQ ID NO: 204541 - DNA, 293 bp, Homo sapiens
  misc_feature: GYAE6OF02F24GR.14.12.B01.1.454.CMB.1.raw
  modified_base (291)..(293): a, c, t, g, unknown or other
  misc_feature (291)..(293): n is a, c, g, or t
tcagcgtctagtaccacgaccggtgctcgatttagtagtgtagattccgcgggccactggcatcccagacaggttcagtggcagtgggtctgggacagacttcactctcaccatcagcagactggaagctgaagattttgcagtgtattactgtcagcagtatggtagttcaccgtacacttttggccaggggaccacggtggtgatcaaacgaactgtggctgcaccatctgtcttcatcttcccgccatctgagtactagacgctgagcgggctggcaaggcgcatagnnn

SEQ ID NO: 204542 - DNA, 300 bp, Homo sapiens
  misc_feature: GYAE6OF02GYY4I.14.12.B01.1.454.CMB.1.raw
  modified_base (292)..(300): a, c, t, g, unknown or other
  misc_feature (292)..(300): n is a, c, g, or t
tcagcgtctagtaccacgaccggtgctcgatttagtagtgtagattccgcggggccactggcatcccagacaggttcagtggcagtgggtctgggacagacttcactctcaccatcagcagactggaagctgaagattttgcagtgtattactgtcagcagtatggtagttcaccgtacacttttggccaggggaccacggtggtgatcaaacgaactgtggctgcaccatctgtcttcatcttcccgccatctgagtactagacgctgagcgggctggcaaggcgcatagnnnnnnnnn

SEQ ID NO: 204543 - DNA, 292 bp, Homo sapiens
  misc_feature: GYAE6OF02HZGC4.14.12.B01.1.454.CMB.1.raw
  modified_base (289)..(292): a, c, t, g, unknown or other
  misc_feature (289)..(292): n is a, c, g, or t
tcagcgtctagtaccacgaccggtgctcgatttagtagtgtagattccgcgggccactggcatcccagacaggttcagtggcagtgggtctgggacagacttcactctcaccatcagcagactggaagctgaagattttgcagtgtattactgtcagcagtatggtagttcaccgtacacttttggccaggggaccacggtggtgatcaaacgaactgtggctgcaccatctgtcttcatcttccgcatctgagtactagacgctgagcgggctggcaaggcgcatagnnnn

SEQ ID NO: 204544 - DNA, 294 bp, Homo sapiens
  misc_feature: GYAE6OF02IRKBA.14.12.B01.1.454.CMB.1.raw
  modified_base (291)..(294): a, c, t, g, unknown or other
  misc_feature (291)..(294): n is a, c, g, or t
tcagcgtctagtaccacgaccggtgctcgatttagtagtgtagattccgcggggccactggcatcccagacaggttcagtggcagtgggtctgggacagacttcactctcaccatcagcagactggaagctgaagattttgcagtgtattactgtcagcagtatggtagttcaccgtacactttggccaggggaccacggtggtgatcaaacgaactgtggctgcaccatctgtcttcatcttcccgccatctgagtactagacgctgagcgggctggcaaggcgcatagnnnn

SEQ ID NO: 204545 - DNA, 295 bp, Homo sapiens
  misc_feature: GYAE6OF02FS1BL.14.12.B01.1.454.CMB.1.raw
  modified_base (292)..(295): a, c, t, g, unknown or other
  misc_feature (292)..(295): n is a, c, g, or t
tcagcgtctagtaccacgaccggtgctcgatttagtagtgtagattccgcggggccactggcatcccagacaggttcagtggcagtgggtctgggacagacttcactctcaccatcagcagactggaagctgaagattttgcagtgtattactgtcagcagtatggtagttcaccgtacacttttggccaggggaccacggtggtgatcaaacgaactgtggctgcaccatctgtcttcatcttcccgccatctgagtactagacgctgagcgggctggcaaggcgcatagnnnn

SEQ ID NO: 204546 - DNA, 295 bp, Homo sapiens
  misc_feature: GYAE6OF02HC7MG.14.12.B01.1.454.CMB.1.raw
  modified_base (291)..(295): a, c, t, g, unknown or other
  misc_feature (291)..(295): n is a, c, g, or t
tcagcgtctagtaccacgaccggtgctcgatttagtagtgtagattccgcgggccactggcatcccagacaggttcagtggcagtgggtctgggacagacttcactctcaccatcagcagactggaagccgaagattttgcagtgtattactgtcagcagtatggtagttcaccgtacacttttggccaggggaccacggtggtgatcaaacgaactgtggctgcaccatctgtcttcatcttcccgccatctgagtactagacgctgagcgggctggcaaggcgcatagnnnnn

SEQ ID NO: 204547 - DNA, 295 bp, Homo sapiens; identical to SEQ ID NO: 204545
  misc_feature: GYAE6OF02HWX0Q.14.12.B01.1.454.CMB.1.raw
  modified_base (292)..(295): a, c, t, g, unknown or other
  misc_feature (292)..(295): n is a, c, g, or t

SEQ ID NO: 204548 - DNA, 303 bp, Homo sapiens
  misc_feature: GYAE6OF02ICGJ6.14.12.B01.1.454.CMB.1.raw
  modified_base (236)..(236): a, c, t, g, unknown or other
  misc_feature (236)..(236): n is a, c, g, or t
  modified_base (295)..(303): a, c, t, g, unknown or other
  misc_feature (295)..(303): n is a, c, g, or t
tcagcgtctagtaccacgaccggtgctcgatttagtagtgtagattccgcggggccactggcatcccagacaggttcagtggcagtgggtctgggacagacttcactctcaccatcagcagactggaagctgaagattttgcagtgtattactgtcagcagtatggtagttcaccgtacacttttggccaggggaccacggtggtgatcaaacggaactgtggcctgcaccgatcngtcttcatcttccgccatctgagttactagacgctgagcggctggccaaggcgcatagnnnnnnnnn

SEQ ID NO: 204549 - DNA, 289 bp, Homo sapiens
  misc_feature: GYAE6OF02FIUMT.14.12.B01.1.454.CMB.1.raw
  modified_base (279)..(279): a, c, t, g, unknown or other
  misc_feature (279)..(279): n is a, c, g, or t
  modified_base (285)..(289): a, c, t, g, unknown or other
  misc_feature (285)..(289): n is a, c, g, or t
tcagcgtctagtaccacgaccggtgctcgattagtagtgtagattccgcgggccactggcatcccagacaggttcagtggcagtgggtctgggacagacttcactctcaccatcagcagactggaagctgaagatttgcagtgtatactgtcagcagtatggtagttcaccgtacactttggccaggggaccacggtggtgatcaaacgactgtggctgcaccatctgtcttcatcttcccgcatctgagtactagacgctgagcgggctggcaaggcncatagnnnnn

SEQ ID NO: 204550 - DNA, 295 bp, Homo sapiens
  misc_feature: GYAE6OF02GHNNN.14.12.B01.1.454.CMB.1.raw
  modified_base (292)..(295): a, c, t, g, unknown or other
  misc_feature (292)..(295): n is a, c, g, or t
tcagcgtctagtaccacgaccggtgctcgatttagtagtgtagattccgcggggccactggcatcccagacaggttcagtggcagtgggtctgggacagacttcactctcaccatcagcagactggaagctgaagattttgcagtgtattactgtcagcagtatggtagttcaccgtacacttttggtcaggggaccacggtggtgatcaaacgaactgtggctgcaccatctgtcttcatcttcccgccatctgagtactagacgctgagcgggctggcaaggcgcatagnnnn

SEQ ID NO: 204551 - DNA, 296 bp, Homo sapiens
  misc_feature: GYAE6OF02GAMGU.14.12.B01.1.454.CMB.1.raw
  modified_base (290)..(296): a, c, t, g, unknown or other
  misc_feature (290)..(296): n is a, c, g, or t
tcagcgtctagtaccacgaccggtgctcgatttagtagtgtagattccgcgggccactggcatcccagacaggttcagtggcagtgggtctgggacagacttcactctcaccatcagcagactggaagctgaagattttgcagtgtattactgtcagcagtatggtagttcaccgtacacttttggccaggggaccacggtggtgatcaaacgaactgtggctgcaccatctgtcttcatcttcccgcatctgagtactagacgctgagcgggctggcaaggcgcatagnnnnnnn

SEQ ID NO: 204552 - DNA, 296 bp, Homo sapiens
  misc_feature: GYAE6OF02I4KW9.14.12.B01.1.454.CMB.1.raw
  modified_base (291)..(296): a, c, t, g, unknown or other
  misc_feature (291)..(296): n is a, c, g, or t
tcagcgtctagtaccacgaccggtgctcgatttagtagtgtagattccgcgggccactggcatcccagacaggttcagtggcagtgggtctgggacagacttcactctcaccatcagcagactggaagctgaagattttgcagtgtattactgtcagcagtatggtagttcaccgtacacttttggccaggggaccacggtggtgatcaaacgaactgtggctgcaccatctgtcttcatcttcccgccatctgagtactagacgctgagcgggctggcaaggcgcatagnnnnnn

SEQ ID NO: 204553 - DNA, 297 bp, Homo sapiens
  misc_feature: GYAE6OF02GRBC5.14.12.B01.1.454.CMB.1.raw
  modified_base (292)..(297): a, c, t, g, unknown or other
  misc_feature (292)..(297): n is a, c, g, or t
tcagcgtctagtaccacgaccggtgctcgatttagtagtgtagattccgcggggctactggcatcccagacaggttcagtggcagtgggtctgggacagacttcactctcaccatcagcagactggaagctgaagattttgcagtgtattactgtcagcagtatggtagttcaccgtacacttttggccaggggaccacggtggtgatcaaacgaactgtggctgcaccatctgtcttcatcttcccgccatctgagtactagacgctgagcgggctggcaaggcgcatagnnnnnn

SEQ ID NO: 204554 - DNA, 295 bp, Homo sapiens; identical to SEQ ID NO: 204545
  misc_feature: GYAE6OF02FO8RC.14.12.B01.1.454.CMB.1.raw
  modified_base (292)..(295): a, c, t, g, unknown or other
  misc_feature (292)..(295): n is a, c, g, or t

SEQ ID NO: 204555 - DNA, 296 bp, Homo sapiens
  misc_feature: GYAE6OF02G2EY2.14.12.B01.1.454.CMB.1.raw
  modified_base (292)..(296): a, c, t, g, unknown or other
  misc_feature (292)..(296): n is a, c, g, or t
tcagcgtctagtaccacgaccggtgctcgatttagtagtgtagattccgcggggccactggcatcccagacaggttcagtggcagtgggtctgggacagacttcactctcaccatcagcagactggaagctgaagattttgcagtgtattactgtcagcagtatggtagttcaccgtacacttttggccaggggaccacggtggtgatcaaacgaactgtggctgcaccatctgtcttcatcttcccgccatctgagtactagacgctgagcgggctggcaaggcgcatagnnnnn

SEQ ID NO: 204556 - DNA, 291 bp, Homo sapiens
  misc_feature: GYAE6OF02FG232.14.12.B01.1.454.CMB.1.raw
  modified_base (285)..(285): a, c, t, g, unknown or other
  misc_feature (285)..(285): n is a, c, g, or t
  modified_base (290)..(291): a, c, t, g, unknown or other
  misc_feature (290)..(291): n is a, c, g, or t
tcagcgtctagtaccacgaccggtgctcgatttagtagtgtagattccgcggggccactggcatcccagacaggttcagtggcagtgggtctgggacagacttcactctcaccatcagcagactggaagctgaagattttgcagtgtattactgtcagcagtatggtagttcaccgtacacttttggccaggggaccacggtggtgatcaaacgactgtggctgcaccatctgtcttcatcttcccgcatctgagtactagacgctgagcgggctggcaaggcgnatagnn

SEQ ID NO: 204557 - DNA, 298 bp, Homo sapiens
  misc_feature: GYAE6OF02GRSXK.14.12.B01.1.454.CMB.1.raw
  modified_base (293)..(298): a, c, t, g, unknown or other
  misc_feature (293)..(298): n is a, c, g, or t
tcagcgtctagtaccacgaccggtgctcgatttagtagtgtagattccgcggggccactggcatcccagacaggttcagtggcagtgggtctgggacagacttcactctcaccatcagcagactggaagctgaagattttgcagtgtattactgtcagcagtatggtagttcaccgtacacttttggccaggggaccacggtggtgatcaaacgaactgtggctgcaccatctgtcttcatcttcccgccatctgagtactagacgctgagcggggctggcaaggcgcatagnnnnnn

SEQ ID NO: 204558 - DNA, 298 bp, Homo sapiens
  misc_feature: GYAE6OF02G8T5G.14.12.B01.1.454.CMB.1.raw
  modified_base (292)..(298): a, c, t, g, unknown or other
  misc_feature (292)..(298): n is a, c, g, or t
tcagcgtctagtaccacgaccggtgctcgatttagtagtgtagattccgcggggccactggcatcccagacaggttcagtggcagtgggtctgggacagacttcactctcaccatcagcagactggaagctgaagattttgcagtgtattactgtcagcagtatggtagttcaccgtacacttttggccaggggaccacggtggtgatcaaacgaactgtggctgcaccatctgtcttcatcttcccgccatctgagtactagacgctgagcgggctggcaaggcgcatagnnnnnnn

SEQ ID NO: 204559 - DNA, 296 bp, Homo sapiens; identical to SEQ ID NO: 204555
  misc_feature: GYAE6OF02GJS0A.14.12.B01.1.454.CMB.1.raw
  modified_base (292)..(296): a, c, t, g, unknown or other
  misc_feature (292)..(296): n is a, c, g, or t

SEQ ID NO: 204560 - DNA, 312 bp, Homo sapiens
  misc_feature: GYAE6OF02I973T.14.12.B01.1.454.CMB.1.raw
  modified_base (274)..(274): a, c, t, g, unknown or other
  misc_feature (274)..(274): n is a, c, g, or t
  modified_base (299)..(312): a, c, t, g, unknown or other
  misc_feature (299)..(312): n is a, c, g, or t
tcagcgtctagtaccacgaccggtgctcgatttagtagtgtagattccgcggggccgactggcatcccagacaggttcagtggcagtgggtctgggacagacttcactctcaccatcagcagactggaagctgaagattttgcagtgtattactgtcagcagtatggtagttcaccgttacactttttggccaggggaccacggtggtgatcaaaacgaactgtggctgcaccatctgtcttcatcttcccgccatcctgagtactagacgctnagcgggctggcaaaggcgcaatagnnnnnnnnnnnnnn

SEQ ID NO: 204561 - DNA, 317 bp, Homo sapiens
  misc_feature: GYAE6OF02IQEED.14.12.B01.1.454.CMB.1.raw
  modified_base (298)..(298): a, c, t, g, unknown or other
  misc_feature (298)..(298): n is a, c, g, or t
  modified_base (300)..(317): a, c, t, g, unknown or other
  misc_feature (300)..(317): n is a, c, g, or t
tcagcgtctagtaccacgaccggtgctcgatttagtagtgtagattccgcgggccgacgtggcatcccagacaggttcagtggcagtgggtctgggacaggacttcactctcaccatcagcagactggaagctgaagatttgcagtgtattactgtcagcagtatggtagttcaccgtacacttttggcctaggggtaccacggtggtgatcaaacgactgtggctgcaccatctgtcttcatcttcccgactatctgatactagacgctgagcggctaggcaaggccgaacgtgctnannnnnnnnnnnnnnnnnn

SEQ ID NO: 204562 - DNA, 291 bp, Homo sapiens
  misc_feature: GYAE6OF02FFAKH.14.12.B01.1.454.CMB.1.raw
  modified_base (284)..(284): a, c, t, g, unknown or other
  misc_feature (284)..(284): n is a, c, g, or t
  modified_base (290)..(291): a, c, t, g, unknown or other
  misc_feature (290)..(291): n is a, c, g, or t
tcagcgtctagtaccacgaccggtgctcgatttagtagtgtagattccgcggggccactggcatcccagacaggttcagtggcagtgggtctgggacagacttcactctcaccatcagcagactggaagctgaagattttgcagtgtattactgtcagcagtatggtagttcaccgtacacttttggccaggggaccacggtggtgatcaaacgactgtggctgcaccatctgtcttcatcttcccgcatctgagtactagacgctgagcgggctggcaaggcncatagnn

SEQ ID NO: 204563 - DNA, 345 bp, Homo sapiens
  misc_feature: GYAE6OF02IFFC3.14.12.B01.1.454.CMB.1.raw
  modified_base (154)..(154): a, c, t, g, unknown or other
  misc_feature (154)..(154): n is a, c, g, or t
  modified_base (232)..(232): a, c, t, g, unknown or other
  misc_feature (232)..(232): n is a, c, g, or t
  modified_base (311)..(311): a, c, t, g, unknown or other
  misc_feature (311)..(311): n is a, c, g, or t
  modified_base (316)..(318): a, c, t, g, unknown or other
  misc_feature (316)..(318): n is a, c, g, or t
  modified_base (320)..(345): a, c, t, g, unknown or other
  misc_feature (320)..(345): n is a, c, g, or t
tcagcgtctagtaccacgaccggtgctcgatttagtagtgtagattccgcgggccgactggcatcccagacaggttcagtggcagtgggtctgggacaggacttcactctcaccatcagcagactggaagctgaagattttgcagtgtattacngtcagcagtatggtagttcaccgtacacgtttggccaggggaccacgggtggtgatacaaacgactgtggctgacacntctgtcttcatcctccgctatcagagtactagacgtctggacgccgggtctgggactaacggccacgtaacgtaggctncgcgnnngnnnnnnnnnnnnnnnnnnnnnnnnnn

SEQ ID NO: 204564 - DNA, 337 bp, Homo sapiens
  misc_feature: GYAE6OF02JWD92.14.12.B01.1.454.CMB.1.raw
  modified_base (264)..(264): a, c, t, g, unknown or other
  misc_feature (264)..(264): n is a, c, g, or t
  modified_base (314)..(337): a, c, t, g, unknown or other
  misc_feature (314)..(337): n is a, c, g, or t
tcagcgtctagtaccacgaccggtgctcgatttagtagtgtagattccgcgggccgactggcatcccagacaggttcagtggcagtgggtctgggacgagacttcactctcaccatcagcagactggaagctgaagattttgcagtgtattactgtcagcagtatggtattcaccgtacacttttggccaggggaccacgggtcggtggatcgaaacgactaggtcgctggcacgatctgtaccttcatcttcccgcactctgngtactagacgctgagcgggctgggctaacggcgccagtagatcgagcagnnnnnnnnnnnnnnnnnnnnnnnn

SEQ ID NO: 204565 - DNA, 303 bp, Homo sapiens
  misc_feature: GYAE6OF02JQT50.14.12.B01.1.454.CMB.1.raw
  modified_base (290)..(303): a, c, t, g, unknown or other
  misc_feature (290)..(303): n is a, c, g, or t
tcagcgtctagtaccacgaccggtgctcgatttagtagtgtagattccgcggggccactggcatcccagacaggttcagtggcagtgggtctgggacagacttcactctcaccatcagcagactggaagctgaagattttgcagtgtattactgtcagcagtatggtagttcaccgtacacttttggccaggggaccacggtggtgatcaaacgaactgtggctgcaccatctgtcttcatcttccgcatctgagtactagacgctgagcgggctggcaaggcgcatagnnnnnnnnnnnnnn

SEQ ID NO: 204566 - DNA, 296 bp, Homo sapiens
  misc_feature: GYAE6OF02I6RP5.14.12.B01.1.454.CMB.1.raw
  modified_base (290)..(296): a, c, t, g, unknown or other
  misc_feature (290)..(296): n is a, c, g, or t
tcagcgtctagtaccacgaccggtgctcgatttagtagtgtagattccgcggggccactggcatcccagacaggttcagtggcagtgggtctgggacagacttcactctcaccatcagcagactggaagctgaagattttgcagtgtattactgtcagcagtatggtagttcaccgtacacttttggccaggggaccacggtggtgatcaaacgaactgtggctgcaccatctgtctttatctcccgcatctgagtactagacgctgagcgggctggcaaggcgcatagnnnnnnn

SEQ ID NO: 204567 - DNA, 335 bp, Homo sapiens
  misc_feature: GYAE6OF02H97VD.14.12.B01.1.454.CMB.1.raw
  modified_base (267)..(267): a, c, t, g, unknown or other
  misc_feature (267)..(267): n is a, c, g, or t
  modified_base (289)..(289): a, c, t, g, unknown or other
  misc_feature (289)..(289): n is a, c, g, or t
  modified_base (297)..(300): a, c, t, g, unknown or other
  misc_feature (297)..(300): n is a, c, g, or t
  modified_base (302)..(302): a, c, t, g, unknown or other
  misc_feature (302)..(302): n is a, c, g, or t
  modified_base (304)..(335): a, c, t, g, unknown or other
  misc_feature (304)..(335): n is a, c, g, or t
tcagcgtctagtaccacgaccggtgctcgatttagtagtgtagattccgcggggccactggcatcccagacaggttcagtggcagtgggtctgggacagacttcactctcaccatcagcagactggaagctgaagattttgcagtgtattactgtcagcagtatggtagttcaccgtacacttttggccaggggaccaaggtggtgatcaaacgaactgtggctggcacatctgtcttcatccttccgcatctggggatactagacnctgagcgggctgggacaaggcncagtaggnnnnantnnnnnnnnnnnnnnnnnnnnnnnnnnnnnnnn

SEQ ID NO: 204568 - DNA, 328 bp, Homo sapiens
  misc_feature: GYAE6OF02H0TU9.14.12.B01.1.454.CMB.1.raw
  modified_base (226)..(226): a, c, t, g, unknown or other
  misc_feature (226)..(226): n is a, c, g, or t
  modified_base (253)..(253): a, c, t, g, unknown or other
  misc_feature (253)..(253): n is a, c, g, or t
  modified_base (306)..(308): a, c, t, g, unknown or other
  misc_feature (306)..(308): n is a, c, g, or t
  modified_base (311)..(328): a, c, t, g, unknown or other
  misc_feature (311)..(328): n is a, c, g, or t
tcagcgtctagtaccacgaccggtgctcgatttagtagtgtagattccgcggggccactggcatcccagacaggttcagtggcagtgggtctggggacagacttcactctcaccatcagcagactggaagctgaagattttgcagtgtattactgtcagcagtatggtattcaccgtacacttttggccgaggggaccacgggtgggtgactacaaaacgaactgnggcctgcaccatctgtctcatcctccnctatctgagtactagacgctggacggcgggcgtggacgaaggcgactaagtgnnngannnnnnnnnnnnnnnnnn

SEQ ID NO: 204569 - DNA, 301 bp, Homo sapiens
  misc_feature: GYAE6OF02FPA8Y.14.12.B01.1.454.CMB.1.raw
  modified_base (292)..(301): a, c, t, g, unknown or other
  misc_feature (292)..(301): n is a, c, g, or t
tcagcgtctagtaccacgaccggtgctcgatttagtagtgtagattccgcggggccactggcatcccagacaggttcagtggcagtgggtctgggacagacttcactctcaccatcagcagactggaagctgaagattttgcagtgtattactgtcagcagtatggtagttcaccgtacacttttggccaggggaccacggtggtgatcaaacgaactgtggctgcaccatctgtcttcatcttcccgccatctgagtactagacgctgagcgggctggcaaggcgcatagnnnnnnnnnn

SEQ ID NO: 204570 - DNA, 449 bp, Homo sapiens
  misc_feature: GYAE6OF02GIH9C.14.12.B01.1.454.CMB.1.raw
  modified_base (155)..(155): a, c, t, g, unknown or other
  misc_feature (155)..(155): n is a, c, g, or t
  modified_base (184)..(184): a, c, t, g, unknown or other
  misc_feature (184)..(184): n is a, c, g, or t
  modified_base (206)..(206): a, c, t, g, unknown or other
  misc_feature (206)..(206): n is a, c, g, or t
  modified_base (366)..(366): a, c, t, g, unknown or other
  misc_feature (366)..(366): n is a, c, g, or t
  modified_base (370)..(371): a, c, t, g, unknown or other
  misc_feature (370)..(371): n is a, c, g, or t
  modified_base (374)..(374): a, c, t, g, unknown or other
  misc_feature (374)..(374): n is a, c, g, or t
  modified_base (377)..(380): a, c, t, g, unknown or other
  misc_feature (377)..(380): n is a, c, g, or t
  modified_base (382)..(382): a, c, t, g, unknown or other
  misc_feature (382)..(382): n is a, c, g, or t
  modified_base (385)..(388): a, c, t, g, unknown or other
  misc_feature (385)..(388): n is a, c, g, or t
  modified_base (390)..(390): a, c, t, g, unknown or other
  misc_feature (390)..(390): n is a, c, g, or t
  modified_base (392)..(393): a, c, t, g, unknown or other
  misc_feature (392)..(393): n is a, c, g, or t
  modified_base (396)..(396): a, c, t, g, unknown or other
  misc_feature (396)..(396): n is a, c, g, or t
  modified_base (398)..(403): a, c, t, g, unknown or other
  misc_feature (398)..(403): n is a, c, g, or t
  modified_base (405)..(449): a, c, t, g, unknown or other
  misc_feature (405)..(449): n is a, c, g, or t
tcagcgtctagtaccacgaccggtgctcgatttagtagtgtagattccgcggggccgactggcatcccagacaggttcagtggcagtgggtctgggacaggacttcactctcaccatcagcagactggaagctgaagattttgcagtgtattacngtcagcagtatggtattccacgtaacctnttttggccctagggaccacggngggttgatcaaaacggtaatggtgctcgactaccaagtcttgttccttcaacttccgttccccggactacgtcttagaacggttacgaagtcccggacttcggagggtccgggtacgtcggacgaaaaggcccggtactaaggttacgcgtgtacagacncgannagngtnnnnanagnnnngnannagngnnnnnngnnnnnnnnnnnnnnnnnnnnnnnnnnnnnnnnnnnnnnnnnnnnn

SEQ ID NO: 204571 - DNA, 313 bp, Homo sapiens
  misc_feature: GYAE6OF02I5EC7.14.12.B01.1.454.CMB.1.raw
  modified_base (277)..(277): a, c, t, g, unknown or other
  misc_feature (277)..(277): n is a, c, g, or t
  modified_base (293)..(313): a, c, t, g, unknown or other
  misc_feature (293)..(313): n is a, c, g, or t
tcagcgtctagtaccacgaccggtgctcgatttagtagtgtagattccgcggggccactggcatcccagacaggttcagtggcagtgggtctgggacagacttcactctcaccatcagcagactggaagctgaagattttgcagtgtattactgtcagcagtatggtagttcaccgtacacttttggccaggggaccacggtggtgatcaaacgaactgtggctgcaccatctgtcttcatcttcccgcatctgagtactagacgctgacgcgggcnggcaaggcgcatacgnnnnnnnnnnnnnnnnnnnnn

SEQ ID NO: 204572 - DNA, 260 bp, Homo sapiens
  misc_feature: GYAE6OF01EPKAX.40.66.F11.1.454.CMB.1.raw
  modified_base (249)..(260): a, c, t, g, unknown or other
  misc_feature (249)..(260): n is a, c, g, or t
tcagtctagcgactcacgaccggtgctcgatttagtcacgcgagagggaaagggattactatggttcggggagttattagtctggggccagggaaccctggtcaccgtctcctcagcttccaccaagggcccatcggtcttccccctggcgccctgctccaggagcacctctgggggcacagcggccctgggctgcctggtcaaggctacttccagtcgctagactgagcggctggcaaggcgcatagnnnnnnnnnnnn

SEQ ID NO: 204573 - DNA, 253 bp, Homo sapiens
  misc_feature: GYAE6OF02I5ERK.40.66.F11.1.454.CMB.1.raw
  modified_base (247)..(253): a, c, t, g, unknown or other
  misc_feature (247)..(253): n is a, c, g, or t
tcagtctagcgactcacgaccggtgctcgatttagtcacgcgagagggaaagggattactatggttcgggagttattagtctgggccagggaacctggtcaccgtctcctcagcttccaccaaggccatcggtcttccccctggcgccctgctccaggagcacctctgggggcacagcggccctgggctgcctggtcaaggactacttccagtcgctagactgagcgggctggacaaggcgcatagnnnnnnn

SEQ ID NO: 204574 - DNA, 259 bp, Homo sapiens
  misc_feature: GYAE6OF02IH5AA.40.66.F11.1.454.CMB.1.raw
  modified_base (251)..(259): a, c, t, g, unknown or other
  misc_feature (251)..(259): n is a, c, g, or t
tcagtctagcgactcacgaccggtgctcgatttagtcacgcgagagggaaagggattactatggttcgggagttattagtctggggccagggaaccctggtcaccgtctcctcagcttccaccaagggcccatcggtcttccccctggcgccctgctccaggacgcacctctgggggcacaggcggccctgggctgcctggtcaaggctactccagtcgctagactgagcgggctggcaaggcgcatacgnnnnnnnnn

SEQ ID NO: 204575 - DNA, 502 bp, Homo sapiens
  misc_feature: GYAE6OF01B0E1D.47.62.F07.1.454.CMB.1.raw
tcagagctcacgtacacgaccggtgctcgatttagtagtcgcataaagggaaaggggagtcagtcccaaccaggacacagcctggacatgagggtccctgctcagctcctggggctcctgctgctctggctccgaggtgccagatgtgacatccagatgacccagtctccatcctccctgtctgcatctgtaggagacagagtcaccatcacttgccgggcaagtcagagcattaacagcgatttaaattggtatcaccagaaaccagggaaagcccctaacctcctgatctatgctgcatccagtttgcatagtgggtcccatctaggttcagtgcagtggatctgggacagatttcactctcaccatcagcagtctgcaacctgaagtattttgcaactttactactgtcaacagacgttaccggtaccccgtactacttttggcccaggggaccaaacgtggaacatacaaacgactgtggctgcaccatctgtcttac

SEQ ID NO: 204576 - DNA, 491 bp, Homo sapiens
  misc_feature: GYAE6OF01EB7LZ.47.62.F07.1.454.CMB.1.raw
  modified_base (399)..(399): a, c, t, g, unknown or other
  misc_feature (399)..(399): n is a, c, g, or t
tcagagctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagatgacccagtctccatcctccctgtctgcatctgtaggagacagagtcaccatcacttgccaggcgagtcaggacattagcaactatttaaattggtatcaccagaaaccaggaaagcccctaacctcctgatctatgctgcatccagtttgcatagtgggtcccatctagtcagtggcagtggatctgggactagatttcactctcaccatcagcagtctgcaacctgaagatattgcaanatattactgtacaacagtatcaataatcctaccctactttccggccctagggaccaaagtaggatatacaaacgaactgagactgctactac

SEQ ID NO: 204577 - DNA, 507 bp, Homo sapiens
  misc_feature: GYAE6OF01BW56Y.47.62.F07.1.454.CMB.1.raw
  modified_base (275)..(275): a, c, t, g, unknown or other
  misc_feature (275)..(275): n is a, c, g, or t
  modified_base (500)..(500): a, c, t, g, unknown or other
  misc_feature (500)..(500): n is a, c, g, or t
tcagagctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagatgacccagtctccatcctccctgtctgcatctgtaggagacagagtcaccatcacttgccaggcgagtcaggacattagcaactatttaaatggtatcagcagaaaccagggaaacncccctaactcctgatctatgctgcatccagtttgcatagtcgggtccatctaggtcagtggcagtggatcgtgggacagtatttcactctcaccatcagcagtctgcaactgaagtatttgactaacttactactgtacaactagtacgttaccgtacccgtactacgtttacggaccgagggtaccaaacgtggacagtacaaacgtactggtgctacgacacntcgtgtc

SEQ ID NO: 204578 - DNA, 532 bp, Homo sapiens
  misc_feature: GYAE6OF01A9PZR.47.62.F07.1.454.CMB.1.raw
tcagagctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagatgacccagtctccatcctccctgtctgcatctgtaggagacagagtcaccatcacttgccaggcgagtcaggacattagcaactatttaaattggtatcagcagaaaccaggaaagcccctaagctcctgatctacgatgcatccaatttggaaacaggggtcccatcaaggttcagtggaagtggatcgtgggacagtattttacttcacctatcagcagcctgcagcctagaagatattgcaaactatattactgtacaacagttatccaattaactccttacccctaactttccggaccctggggtaacccaaaaggttggaatacgtacaaaacggactagtacgggctcggaccaccgtatcctgttcc

SEQ ID NO: 204579 - DNA, 756 bp, Homo sapiens
  misc_feature: GYAE6OF01B3I6W.47.62.F07.1.454.CMB.1.raw
  modified_base (218)..(218): a, c, t, g, unknown or other
  misc_feature (218)..(218): n is a, c, g, or t
  modified_base (705)..(705): a, c, t, g, unknown or other
  misc_feature (705)..(705): n is a, c, g, or t
tcagagctcacgtacacgaccggtgctcgatttagtagtcgcataacgggaagggggagtcagtcccaaccaggacacagcctggacatgagggtccctaccgctcagccctcctcggggctccctgcgtgcgtcctgggctctccaggttgtccgaggatggtcgacaccccaagaatggacccccagtcctaccgatccctcccgtggtctgactntcgtgtaggagacaagagtccgacctatcgacgttaggcccagggcgaagtcgaacggtactagttacacctaaaccttaagttttaaaagttggtactaccgaagccaagaaaccggagggaaaccgcccccgtaaaggccctcgtacgtaaggtccttacggaatggactaggtaccttaaaggttttacgggaaaaccgtacgggggtacccctaagttaccgtaagggtttaccgaagttaaggggtaagttggggaacttccggtaggggtaaccgttaggggtacttttaacgtttaccaacgtactacgtaggaccgtacgtacccgttcgactacgtaccctaagtaaacggtaattaagttacggaacctaaacgtacttaagttactagtactaactaggtaactaactaacgttaactaccttacccttaacgttccggtacccgtaggaaccctaaaggtacgaacgtacggtanaaacggtacgttcgtacgttactcggtaccacgtacttccgtccgttaacg

SEQ ID NO: 204580 - DNA, 501 bp, Homo sapiens
  misc_feature: GYAE6OF01AL6RR.47.62.F07.1.454.CMB.1.raw
  modified_base (491)..(491): a, c, t, g, unknown or other
  misc_feature (491)..(491): n is a, c, g, or t
tcagagctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagatgacccagtctccatccctccctgtctgcatctgtaggagacagagtcaccatcacttgccaggcgagtcaggacattagcaactatttaaatggtatcagcagaaaccagggaaagcccctaagcctcctgatctacgatgcatccaatttggaaacagggtccatcaaggtcagtgaagtgatcgtggacagtattttacttcactatcagcagcctgcagcctagaagtatagtgacaacattacttactgtacaactagtatcaattatcctccctacttcgcctaggaccaaagtgaatacgtacaaacgactgtgactcgacacctntcgtgttacc

SEQ ID NO: 204581 - DNA, 506 bp, Homo sapiens
  misc_feature: GYAE6OF01E52QI.47.62.F07.1.454.CMB.1.raw
  modified_base (395)..(395): a, c, t, g, unknown or other
  misc_feature (395)..(395): n is a, c, g, or t
tcagagctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagatgacccagtctccatcctccctgtctgcatctgtaggagacagagtcaccatcacttgccaggcgagtcaggacattagcaactatttaaattggtatcagcagaaaccagggaaagcccctaaagctcctgatctacgatgcatccaatttggaaacaggggtcccatcaaggttcagtggaagtggatcgtgggactagtattttacttcaccatcagcagcctgcagcctgaanatattgcaacataattactgtcaatagtaatcaataacttcctacccctactttccggccctagggacctaaagtggatatacaaacgtactgtggctgcacatctgttcc

SEQ ID NO: 204582 - DNA, 593 bp, Homo sapiens
  misc_feature: GYAE6OF01CWTUE.47.62.F07.1.454.CMB.1.raw
tcagagctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagatgacccagtctccatcctccctgtctgcatctgtaggagacagagtcaccatcacttgccaggcgagtcaggcattagctaactaatttaaattggtatcagacagaaaccaagggaacgcccctaagctcctagactacgtacgatgctatacctaaagtttacggaaaacgtacggggtcccaagtaccgtaaggttcgaaggtaggaagtggatcgtagggactagttattttaccgttacacctacttcgaagtcacgtcctagcacgtcctagaagtatattacgactaactattacttactgtacaactaagtactactaattactaccttaccctacgtttccggacccgttacgggaacctaaaggtggtaactaagtaaccgaaacgtaacttcggtagtcctacgaccacgacttgtcggttacc

SEQ ID NO: 204583 - DNA, 909 bp, Homo sapiens
  misc_feature: GYAE6OF01BMU2X.47.62.F07.1.454.CMB.1.raw
tcagagctcacgtacacgaccggtgctcgatttagtagtcgcataaagggaaagggggggagtcaggtccgaaccaggacacagcgatggacatgagggtccccgcgtcagctcctggggctcctcgctgctctggttcccaggtggccgagggtcgtgacatcccagactcgacccagtctccactcctccctggtctcgcgatcgtgtagacgaccactagtccacatcacgttcgccggacgagtcgaggactagttagactaattactttacgtaccttaggttactacgaacgacctaacgaaaccgaacggtaaacgttaccctaaacggtcctaccttagtacttacttagttacgttaactacttacctacgttttacgaccgttaacggtttccggggtaccctaacgttccgttccggtttaccgtaggttcggtaccgtaacgggttacggtacgttacgggtacgggtaaccgtaccggttaccttttaccgtaaccttacccttacccgtaacccgttacgtaccggtacgtaccgtaaccggtcccgttacggaccgtaacgggtacccgttaaggtaaacggtttaacgtttacggtttaccgtaacccgtttaaaccgtttaaccgttttaaccgttaacgttaaaaccgttaaaaacgtttaaccgtaaaccgtaaccggttacccggtacccccgttaccgttaacccggtttaacccgggtttaccggggtaacccggggtaacggggtaaacccggtaaacgggggttaaacggtaacggtaacccggttaaacccggaaaccgggttaacccggttacgggtacccggtaccggttaacccggacccgttaaccccggttaccgttccccggtttcgtttaacccccg

SEQ ID NO: 204584 - DNA, 645 bp, Homo sapiens
  misc_feature: GYAE6OF01ES2U8.47.62.F07.1.454.CMB.1.raw
tcagagctcacgtacacgaccggtgctcgatttagtagtcgcataaagggaaagggggagtcagtcccaaccaggacacagcctggacatgagggtccctgctcagctcctggggctcctgctgctctggctctcaggtgccaggtgtgacatccagatgacccagtctccatcctccctgtctgcatctgtaggagacagagtcaccatcacttgccgggcgagtcagggcttgcaaatgctttggcctggtttcagcagacacagggagcccctaagcgcctgatctatggtgcatacactttgacaaaggtcgggtacccagtcaaggttcgagcggcgagtggatcgtagggacagtatttcacgtctacgacttactcagacagcctgcaacgccgtagtaagttagtttttacggtaaacttttagtttaacttgttaacgtaaacgtaacggggttaaaccttaccggttttaccccgtacctttaccgtaaccccgtttacggggacccgggtaacgggggtaacccgtaaaggggtagggtaacggtaaacgttaaagggaaaacggttaaaccggttcgggtacgggttaccgttacgggaccctaaacccgtagttccgtttcggtttaacccg

SEQ ID NO: 204585 - DNA, 521 bp, Homo sapiens
  misc_feature: GYAE6OF01BLHQQ.47.62.F07.1.454.CMB.1.raw
  modified_base (516)..(516): a, c, t, g, unknown or other
  misc_feature (516)..(516): n is a, c, g, or t
tcagagctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagatgacccagtctccatcctccctgtctgcatctgtaggagacagagtcaccatcacttgccaggcagtcaggacattagcaactatttaaattggtatcagcagaaaccagggaaagcccctaagctcctgactctacgatgcatccaatttggaaacaggggtcccatcgaaggttcagtggaagtggatctgggacagagttcactctcacatcagcagtctgaccaactgaagtattttgctaactttactactgtacaactagacgttaaccggtaccccgtataccttttggacctagggacccaaacgtcggacactacaaacgactagtcggctcgacacattctatcttcnttccc

SEQ ID NO: 204586 - DNA, 516 bp, Homo sapiens
  misc_feature: GYAE6OF01DHGD9.47.62.F07.1.454.CMB.1.raw
  modified_base (396)..(396): a, c, t, g, unknown or other
  misc_feature (396)..(396): n is a, c, g, or t
  modified_base (416)..(416): a, c, t, g, unknown or other
  misc_feature (416)..(416): n is a, c, g, or t
  modified_base (508)..(508): a, c, t, g, unknown or other
  misc_feature (508)..(508): n is a, c, g, or t
tcagagctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagatgacccagtctccatcctccctgtctgcatctgtaggagacagagtcaccatcacttgccgggcagtcgagggcgttgcaaatgctttggcctggtttcagcagacaccagggaacggcccctaagcgcctgatctagtggtgcattacactttgcaaaggtgggtcccatcaaaggttcagcggcagtaggtctgggacagagttcactctcactatcagcgctgcagcctgaagtnttctgactaactttatactntctcagtatgtatgtacttaccctcggtactttccggaccgaaagggacctaaggtaggaaatacgaaaacgactggtacgtcagacctacnttcgtacg

SEQ ID NO: 204587 - DNA, 515 bp, Homo sapiens
  misc_feature: GYAE6OF01B8OOF.47.62.F07.1.454.CMB.1.raw
  modified_base (353)..(353): a, c, t, g, unknown or other
  misc_feature (353)..(353): n is a, c, g, or t
  modified_base (390)..(390): a, c, t, g, unknown or other
  misc_feature (390)..(390): n is a, c, g, or t
  modified_base (509)..(509): a, c, t, g, unknown or other
  misc_feature (509)..(509): n is a, c, g, or t
tcagagctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagatgacccagtctccatcctccctgtctgcatctgtaggagacacagtcaccatcacttgccgggcgagtcaggacattagcaattatttagcctggtatcagcagaaaccagggaaagttcctaagctcctgatctatgttacatccactttgcaattcgggtcccatctcgttcagtggcagtggatctgggacngattcactctcacatcagcagccctgcagcctgaagntgttgactaacgtttattactagtactaaaaatataaacagtcgccccgctctactttcgggacggacgggaccaagggtggaagactacgaaacgacgtgtcgggactagacctacgngttacg

SEQ ID NO: 204588 - DNA, 608 bp, Homo sapiens
  misc_feature: GYAE6OF01DC08M.47.62.F07.1.454.CMB.1.raw
tcagagctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagatgacccagtctccatcctccctgtctgcatctgtaggagacagagtcaccatcacttgccaggcagtcaggacattagactaactatttaaatggtatacagacaagaaaccgaagggaacgacccctaagctacctagactactacgatgactactactaagtttacggaaacgtacggggtacccaagtacgtaaggttacgaggtagggaaggtggtatcggtagggtaactagtttacttttaccttacaacctatacgacgtacgacgtaccgtagacacgtaccgtaagaaagtattagttacgaactaaactattaacttactacgtactaactaagtaactactaacttactaccctacccttacgttccgaccgtaacggacctaaaggtgtaactaacgtacgaaacgtagtacgtagactcgacactatcgttcgtacg

SEQ ID NO: 204589 - DNA, 545 bp, Homo sapiens
  misc_feature: GYAE6OF01DCOMO.47.62.F07.1.454.CMB.1.raw
tcagagctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcataccaatttggaaacaggggtcccatcaagttcagtggaagtggatcgtggacagtatttacttcacatcagcagcctgcagcctagaaagatattgactaacattaattactgtacaacaagtatacaattaactcctacccctacctttccggaccccgttagggaacccgtaaaggtcggaagtaactacaaaaccggtaacttaggtacggtactacgacccacctactcttcggttacc

SEQ ID NO: 204590 - DNA, 756 bp, Homo sapiens
  misc_feature: GYAE6OF01E26UI.47.62.F07.1.454.CMB.1.raw
tcagagctcacgtacacgaccggtgctcgatttagtagtcgcataaagggaaagggggagtcagtcccaaccaggacacagcctggactatgagggtccctgctcagctcctgggctcctgctgctctggctcgtcaggtgccaggtactgtgacaccctagatgacccagtctccatcctccctgtctgcgatcggtgtaggagaccagagtcgaccatcacttgccaggccgtagtcaggtactagttagcaaacttatttaaattggtatcagcagaaaccagggaaacgccccctaagcctcctagactccgtaacgagtcgctactccgtaaattttaggaaaaccgtaggggtacccctaattcgtaaacggtttcgaaagttagggtaaacgttacgggtaattaccggtaggggaacctaagggttactttttaaccggtttccaaacctacttaccgaacgtacctaacgtaccgttagacctaacgtacccgtaaggaaacgtaacgtttaacttagaaccctaaacgtaatttaacgtttaaccttacggtaacctaaacgtaacgttaactactaaagttaaaccgttaccccttacccccttaacgttttacccgggtaccccttaacggggtaaaccctaaaaggtcggttaactaacgttaagtaaaaccgggtacgtttacggggtacggtaccttaacggtaccctaaaccgttacgtttacccgtcggttttaacccg

SEQ ID NO: 204591 - DNA, 696 bp, Homo sapiens
  misc_feature: GYAE6OF01DEBUW.47.62.F07.1.454.CMB.1.raw
  modified_base (668)..(668): a, c, t, g, unknown or other
  misc_feature (668)..(668): n is a, c, g, or t
tcagagctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgaccacccagatgacccagtctccatcctccctgtctgcatctgtaggagacagatcaccatcacttgccaggcgagtcgaggactattagactaaacttaatttaaattggtatcgaagacaacggaaaaccgaacgggaaactaccccgtaaagtcctacctaggtaacttacgtaaccgtatacggacctaacttacctaaaagtttacgggaaaaccgtacggggttacccctaagtacgtaaacggttacgtaagggtagggtaaaggtgggtaaacgttccggtacggggtaacttacggttttaacttttttaaccgttaccgaaccttacgtaccgaacgtccgacgtcctaggaccaggtaccgtaagtaaacgtattaacgttgaactaaagtactttattacgtacgtaactaaacgtaattaacacttaacttaacgtcccttaccctacgtttcccggacctacgggaaactaacggtagaacttacaacgtaaacgtacgttaggngtacctacgaccgactgtacctgttacc

SEQ ID NO: 204592 - DNA, 540 bp, Homo sapiens
  misc_feature: GYAE6OF01DKSSB.47.62.F07.1.454.CMB.1.raw
  modified_base (313)..(313): a, c, t, g, unknown or other
  misc_feature (313)..(313): n is a, c, g, or t
  modified_base (354)..(354): a, c, t, g, unknown or other
  misc_feature (354)..(354): n is a, c, g, or t
  modified_base (392)..(392): a, c, t, g, unknown or other
  misc_feature (392)..(392): n is a, c, g, or t
  modified_base (534)..(534): a, c, t, g, unknown or other
  misc_feature (534)..(534): n is a, c, g, or t
tcagagctcacgtacacgaccggtgctcgatttagtagtcgcataaagggaaagggggagtcagtcccaaccaggacacagcctggacatgagggtccctgctcagctcctgggactcctgctgctctggctcccagataccagatgtgacatccagatgacccagtctccatcctccctgtctgcatctgtaggagacacagtcaccatcacttgccgggcgagtcaggactattagacaattatttaagcctggtatcagcaagaaaccagggaaattcctaagctcctgatctatgttacatcactttgnagttcgggtccatctcggtcagtggctgtgatcgtgggacngtatttcactctcaccatcagcagctgcagcctagatntgtgactaacttattaactgtaaactaaaataactaacgagtccgaccccgtactaccgttacgtttaccgggacggtacgggaaccggtaagggtcggaagacgttaacgaaaacggtactggtcggactagaccaccgtnttaccg

SEQ ID NO: 204593 - DNA, 790 bp, Homo sapiens
  misc_feature: GYAE6OF01DPCAL.47.62.F07.1.454.CMB.1.raw
  modified_base (441)..(441): a, c, t, g, unknown or other
  misc_feature (441)..(441): n is a, c, g, or t
tcagagctcacgtacacgaccggtgctcgatttagtagtcgcataaagggaaagggggagtcagtcccaaccaggacacagcctggacatgagggtccctgctcagctcctggggctcctgctgctcgtggctctccgaggtcaccagatggtacgaacccacccgaagtacgtaccggaaccctacgttcctaccctacttccccttcccgtggttctcgctacgttcgttagggtaggaacgaacgaggtacgtacccaacctaagttcctaccggttccggggccccggggacggtaacgtcgggtacggggtcgttacgaactaaagttcggtttcgtttcggtccggtttaggttacgaacgacgaacggaacccgaaccgggaaggggtaacccgaccccgtaaggccggtcctagacgtcgttaggtcggtacncttaactaccgttacgttacgaacgtaacgggttccgggtaccaacgttacggtaacggtcgaacggcggtacgttaaggttacgggtcggtaacgggaactacggttacgtacctcgttacttacgaacgttacacggacggccgtactacggcgtaacgtacgtacgtaagttacttcgacgtaactttaaccgtttattcgtacttcgtaacttaggtacgtgtacttccgttacccgttaaccggttcggtaccgttaccggaccgggaaacggtacgtaaagggtaacaaccggttaacgaaacgttacggttggaccgtctacgacctatccgttcgttaccg

SEQ ID NO: 204594 - DNA, 718 bp, Homo sapiens
  misc_feature: GYAE6OF01A3D34.47.62.F07.1.454.CMB.1.raw
  modified_base (411)..(411): a, c, t, g, unknown or other
  misc_feature (411)..(411): n is a, c, g, or t
tcagagctcacgtacacgaccggtgctcgatttagtagtcgcataaagggaaagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtcaccatcacttgccgggccagtcgagggcgttgcaaatgtctttggcctggtttcagcagacacgagggaacggcccctaagccgcctgactcgtagtggtgcatactactttcgacgtaacggtcgggtccctatacgtaaggtcgacgtcggacgtagggtacggtcggtacgggtacaggtacgttacgacttcctacaacgtntaccgaggccggctcgactacgcctaggtaacgtacttacgtcgtaccttaacgtttacttaccgtcgttccttaccgtagttacttacgtacgttaccgtacccgtttaccccggttacgggttacccggttttaccggggaaccccggttaaacggggtaaaccccggttaaaacggggggttaaccggtaaaaaccggttaacccggaaaaaccgggttaccgggttaaccgggttaccgggttaccggttacgtaccccggttaaaccccgttacgtttcccggtttaaccggtttaccccgg

SEQ ID NO: 204595 - DNA, 557 bp, Homo sapiens
  misc_feature: GYAE6OF01AKP7X.47.62.F07.1.454.CMB.1.raw
tcagagctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagatgacccagtctccatcctccctgtctgcatctgtaggagacagagtcaccatcacttgccaggcgagtcagagcattaacagcgatttaaatggtatcaccagaaaccagggaaacgcccctaacctcctgatctatgctgcatccagtttgcatagtcggggtccagtctaggttcaggtggcaggtggatcgtgggacagtatttcactctcaccatcagcagtctcgacaaccgtagtaaagtattttacgaccttaacttactacttacgtacaacgacggtaacgttacccggtaccccgttacgtaccgttttcggaccgtagggtacccaaacgtgaaccgtaataccaaacggtaactggtacggcctacggacaccgtattctgttaccc

SEQ ID NO: 204596 - DNA, 737 bp, Homo sapiens
  misc_feature: GYAE6OF01AWB91.47.62.F07.1.454.CMB.1.raw
tcagagctcacgtacacgaccggtgctcgatttagtagtcgcataaaagggaaagggggagtcagtcccaaccaggacacagcctggacatgagggtccctgctcagctcctggggctcctgctgctctggttcccaggtgccaggtgtgacatccagatgacccagtctccatcctcctgtctgcatctgtaggagacagagtcacatcacttggccgggcagtcgagggtcgttagacaaatgtcttggcctggttcagcagacacgaggacgcccctagccgcctgactctagtggtgactatactactttacgacgtaaaggtcgggtaccctagtaccgtaaacggtttcgaaggttcgggacgtaacggtaggtacgtacgtaggggtaacctaggtaacctttcgaaaccttccgtaccaacctaacgtccgtaacggtccgtaaccgtaccgtaacgtacggtaccgttaagtaaaccggtttacgttttaacgggttaaactttttaacgttaccgtttacgggtaccgaacggttaccgtaacgggttcgtttaaggttaaccggtttccggtaccgggtacccttcccggttaccgttaccgttaccgggtttccggggaaccgggtacgggtaacccgggtaggggaccggtaaggtaccgtaaaccggaaacccggttaagttcggtccgggtaccgttaggaaccctaccgttaacgttccgg

SEQ ID NO: 204597 - DNA, 671 bp, Homo sapiens
  misc_feature: GYAE6OF01EPJ0U.47.62.F07.1.454.CMB.1.raw
tcagagctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagatgacccagtcctccatccctccctgtctgcatctgtaggagacagagtcaccatcacttgccgaggcgagtcaggacagttagacaactatttaaagttggtatcagacaagtaaaaccgaggaaacgcccctaaagcctacctagatcctacgatgctatacccaagtttacggaaacgacggggtacccagtacgtaaaggttccaaggtaggaagtggagttccgtagggaactagtactttttacttacgtacctatcaacgtctacgtcctgcctagacctaggaacgtacttagtacgacaaactatttacttaacgtagtaccaaacgtattaactacaacgtttaacctacccttaccccgttaccgttttccccgggaacccgttacgggtaaaaccctaaaggttacggtaaacgttaacgttaaaccgtaaaaaccggtaacggtttcggtaaccgggtcctaaccggtacctaaacccggtatttccgtcggtttaacccc

SEQ ID NO: 204598 - DNA, 754 bp, Homo sapiens
  misc_feature: GYAE6OF01CHMFP.47.62.F07.1.454.CMB.1.raw
tcagagctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgaccacccagatcgacccagtcctccatccctccctgtctgcatcgtgtaggagacagagtccaaccatcacttcgaccgaggcgtagtccaagggactaattagactaacttaatttaaagtggtaatcgagacaagaaaccgacgggaaactaccccgaagcctctagactactacgatcgactactacctaagtttacggaaaccgtacgggtaccctattaccgtaggttacgagtcggacgagtaggtacgtcgtaggggtactagtacttttaccgacttccttaccaactacgtaccaggtacctacggtcccgtacgaccgacggtaccgtagtaaacgggttacttaggttaccgtaaccttaaactttttaacgttaaaccgttaacgtttaaaaccgttaaaaagttacgttaaaaccgttaccggttaccccgtaccccgtttacccgttaccggttaacccgggtttacccggggaacggggttaaacccgggaaaccgggttaaggggtacggtaacggtaaacggttaaacccggtaaaaccgtacgggttacgtacggtaccgtccgaacccttaacgtcctttacccgg

SEQ ID NO: 204599 - DNA, 636 bp, Homo sapiens
  misc_feature: GYAE6OF01C3KMV.47.62.F07.1.454.CMB.1.raw
  modified_base (342)..(342): a, c, t, g, unknown or other
  misc_feature (342)..(342): n is a, c, g, or t
tcagagctcacgtacacgaccggtgctcgatttagtagtcgcataaagggaaagggggagtcagtcccaaccaggacacagcctggacatgagggtccctgctcagcttctggggctcctgctgctctggctctcaggtgccagatgtgacacccagatgacccagtctccatcctccctgtctgcatctgtaggagacacagtcaccatcacttgccgggcgagtcaggacattagcaattatttagcctggtatcagacaagaaaccgaagggaagttcctaagcctcctgatctatgttacatcctactttgactaagttccgggtccattctcggttnaggtggctaggtggagtcgtagggactagtacgttcactctaccaacctataccaaccaccctgacctacgtcctagtacttagttattttcgacgttacttttaactttaaccgtacgtaaacctaaaagttaattaaagttacgttacgtacccgttccggtttacccgggtttacccggcccgttaacgggaaacccgttaaacgggtcggtaacgttacggttaaccgaaaacggtacgttaggtacggtacgtacgtacctaacctacttccgtcgttcctttaacccg

SEQ ID NO: 204600 - DNA, 700 bp, Homo sapiens
  misc_feature: GYAE6OF01DTES4.47.62.F07.1.454.CMB.1.raw
  modified_base (619)..(619): a, c, t, g, unknown or other
  misc_feature (619)..(619): n is a, c, g, or t
  modified_base (682)..(682): a, c, t, g, unknown or other
  misc_feature (682)..(682): n is a, c, g, or t
  modified_base (689)..(689): a, c, t, g, unknown or other
  misc_feature (689)..(689): n is a, c, g, or t
tcagagctcacgtacacgaccggtgctcgatttagtagtcgcataaaggggaaagggggagtcagtcccaaccaggacacagcctggacatgagggtccctgctcagctccgtggggctcctgctgctcgtggctctcgaggtgccagatgtcgaccacccagactcgaaccctgtcctaccactcccctcctgtcctgctacttcgtaggtacggaacgacgaaggtactaccaacctactaccgtaccgttccggacccggaggggaccgtacggtaccggaaggtaactaagttacgtaacgttaaattttaaatttaagttggtaactacgaacgaacgaaaccggaaaacggacggtaacccgtaccctaacggtcctacggacttactccgtaagtcgtacactaccgttaacgtaacgttaaccgggaccggtaccgggtacctaggtaccggtaaggtaccgtaagggtaggtacggtagtacttaggtaacggttaacttaacgtttacttttaccaactaccgtagtaacctcgtaacccgcgccgttagaccgtacggtaacgtagaacgttagtactagataaccttagtacctagtacagtaactntatactactaccgtcctacttccggactccggagtacgtagatacgtaactacggactgtcgnacgtctnactctgcttcc

SEQ ID NO: 204601 - DNA, 621 bp, Homo sapiens
  misc_feature: GYAE6OF01CG901.47.62.F07.1.454.CMB.1.raw
  modified_base (420)..(420): a, c, t, g, unknown or other
  misc_feature (420)..(420): n is a, c, g, or t
tcagagctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagatgacccagtctccatcctccctgtctgcatctgtaggagacagagtcaccatcacttgccgaggcgagtcgaggactattagctaacttatttaaattggtaatcagtacaagaaaccgaagggaaacacccctaagcctaccgtagactcgtacgatcgacatacctaagtttacggaaacgtcggggtaccccatacggtaacggttcgacggcggacaggtggatcggtagggactagtactttcacttctacacttancagctacgccctagacactccgtagaagttatttaggtaactttagtttattagtacgtaacgtacgggttaactaccgtttcccgacgttccgtaccgttcgggaccgggaacgggtaaccgtagggtacggagtaacgtaaaggtaaagacggttcgggtacgtacggtccacgtacgtacttcgttcgttccttaccg

SEQ ID NO: 204602 - DNA, 751 bp, Homo sapiens
  misc_feature: GYAE6OF01AH578.47.62.F07.1.454.CMB.1.raw
  modified_base (202)..(202): a, c, t, g, unknown or other
  misc_feature (202)..(202): n is a, c, g, or t
  modified_base (737)..(737): a, c, t, g, unknown or other
  misc_feature (737)..(737): n is a, c, g, or t
tcagagctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagatcgacccagtctccatcctccctgtcctgctactcgtgtagganacagacgtccacctatcacgttcgaccagggccgaaggtacaacgggtacaagtttacgacttaaacttaagttttaaaagtggttaactacgtaggaccaaaggtaaaacccgaaggggaaaccgtaccccgttaaacggccctttacccggtaagacgttaccgttaaccgagttacggacctaacttaccgtaaaggtttacgggaaaacctacgggggttaccccagttaccgtaaacggttacgacggtacggtaccgtagggttacgggaacttcggtaacggggtaacctaggttaactttccaaccgttctaacctaacttagtacccgagtccgaacgtccgtacgtacaaccgtaccgtaagtaaacggtttagtttaaggttaacttacgtttacgttacgtaacgtaaacgtaagggtttaccctaacggtttcccgtactacccgttacgttcgggaccgtaagggaccgtaagggtagaagacgtaagaaagtaccgtgtacggtctaggacctacgtacncgttagtcctaccg

SEQ ID NO: 204603 - DNA, 682 bp, Homo sapiens
  misc_feature: GYAE6OF01EFQY6.47.62.F07.1.454.CMB.1.raw
  modified_base (305)..(305): a, c, t, g, unknown or other
  misc_feature (305)..(305): n is a, c, g, or t
tcagagctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagatgacccagtctccatccctccctgtctgcatctgtaggagacagagtccaccatcacgttggccggcgagtcgagggtcgttgacaaagtgtcgttggtcttggttcagcagacacgaggacgccctaagcgctgatacgtagtggngcatacgtacttagacgtaaggtcggtacctagtacgtaacggttcgacggtcggacgtaggtaggtcgtagggacgtaggtacgttcctacgtctaccgtactacgtccgtacgcggtccgtagaccgtacgtacctagtaacgtacgtttacgtacgtactttaaacctttcgttaccttcgttacctacgtaggttactagtacgtttccgtaccctttacccggttaccggtacccggttaaccgggaaacccggtaacgggtaaacccggttaacgggttaaaccggtaaaacgttaaccggtaaaaccggtaacggttacggtaaccgggttaccgacccgtaacctaacccgttgttaccgtttaacccg

SEQ ID NO: 204604 - DNA, 781 bp, Homo sapiens
  misc_feature: GYAE6OF01DF0MY.47.62.F07.1.454.CMB.1.raw
tcagagctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagactcgacccagtctaccactcctccctgtctgcatctggtaagagacagtacgtacacctatacctacgttggtccgggacgtagtcgtaagggttattagcctaacgtggttacgcctaggtaactacgaaaacgaacgaaaccgaacgggaaaccctacccctaacctccctacactccttactactcgacacgtcctacgtttacgaacgtaaacggtcgggtaccagtacgtaacggttcgacggtcggacgtaggtcggtatcggtagggactaacggttactttaccaccgttacctaccaacctagtaaccgtacgaccgtaacgttcgtacgtaaacccgtaaaccgtttaaggtaaagttttaccgttttaacgaaccctttaaacctttacgttaacgttaccgttaaactaaccggttaacgggtttaacccgtttaaccccgggttaacccccgtttaacgttttaaccccggggtttacggaacccgggttaaaccgggtaaacctaccggtacggaaacctaccgtaaaccggtaacggtaccggtacgtacggtactaccggactaccgtactttccgtacttacccgttaatcccgttcccgtacccg

SEQ ID NO: 204605 - DNA, 650 bp, Homo sapiens
  misc_feature: GYAE6OF01BJ3BR.47.62.F07.1.454.CMB.1.raw
tcagagctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagatgacccagtctccatcctccctgtctgcatctgtaggagacagagtcaccatcacgttggccgggcgagtcgagggcgttgacaaatgctttgccgtggttcagcagacaccgaggacgcccctaagcgccgtgtatcgtagtggtcgctacgtactacgtttagacgtaaaggtcggggtaccctagtacgtaacggttcgacggtccggacgtacgggttaggtccggtacggggactaggtacgttccaaccgttcgtacctaactatacgacggtacccggccgttcgcgaacgcctaaggaacgtcgttcgtacgtactaactttactttactcgttacctacgtagttagtagttacgtacgttacccgttacccgtacggttaccgtttccggaccgtaaacgggtaccggtaaaggtacgtaaactaccggtaaaaccggtacgttacggtacggtactacgtacctaccgtgttccgttaccg

SEQ ID NO: 204606 - DNA, 662 bp, Homo sapiens
  misc_feature: GYAE6OF01AKWCG.47.62.F07.1.454.CMB.1.raw
tcagagctcacgtacacgaccggtgctcgatttagtagtcgcataaagggaaagggggagtcagtctcagtcaggacacagcatggacatgagggtccccgctcagctcctggggctcctgctactctggctccgaggtgccagatgtgacatccagatgacccagtctccatccctccctgtctgcatctgtaggagacagacgtcaccatcacgttggccgggacaagtcagagctaattaacagcgtaatttaaatggtatcaccaagaaaccgaggaaacgcccctaacctcctgactctatgctgacactcctagtttgactagtaggtccgggtaccctagttacgtagggttcaggttcgggacgagggtaggactcggtagggactagttactttaccaccttcctaccgacctataccgtacgcctacggttactcggaccaaccgttagtaaagttacttttagaccttaaactttactacgttaacgttaccgaaacggttacgtaaccgggttttaaccccggtacccctttaagttaccggtttacggaccgggtaaccggggaaccctaaacggtcccggaactaccgtaaccgtaaaccgtcgttacggtacggcctaccggactaacctcgttccgttcgttaccg

SEQ ID NO: 204607 - DNA, 727 bp, Homo sapiens
  misc_feature: GYAE6OF01DP6QM.47.62.F07.1.454.CMB.1.raw
  modified_base (713)..(713): a, c, t, g, unknown or other
  misc_feature (713)..(713): n is a, c, g, or t
tcagagctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgaccacccagatcgacccagtcctccattccctccctgtctgctatcgtggtaggagacagacgtccacctatccacttcgaccgaggcgacgtcgaaggactaagttacgactaaactttaatttaagttaggtactacgagacgaaacggaaaccgaaggggaaacccaccccgttaaagccttaccgtagtactaccgtaacgtagtcgactacttaccgttaaagttacgggaaaaccggtaccggggtaccctaagttaccggtaaggtttcgaagggttacggaaggttcggacgttacggtaagggtaacgtaacgttttacgttttaccgttacctaacctataccgtactacgtaccgtcctgacctacgtaactaggtaagtattagttaaccgaacttaaactagtttaactttactacggtaaactaacgtaagttaactacttaaaccttaccttaccccttacccgttaccgtttccggacccgtaggtaaaccgtaagtagtaactaaccgaacgtaaacgtcgtaggtaccgctaaacgctaaaccttnttcgtcgtttaccc

SEQ ID NO: 204608 - DNA, 730 bp, Homo sapiens
  misc_feature: GYAE6OF01DYIDM.47.62.F07.1.454.CMB.1.raw
  modified_base (186)..(186): a, c, t, g, unknown or other
  misc_feature (186)..(186): n is a, c, g, or t
  modified_base (604)..(604): a, c, t, g, unknown or other
  misc_feature (604)..(604): n is a, c, g, or t
tcagagctcacgtacacgaccggtgctcgatttagtagtcgcataaagggaaagggggagtcagtcccaaccaggacacagcctggacatgagggtccctgctcagctccgtggggctcctgctgctctggctctcgaggtgaccagatgtacgaccacccgaagactacgaccctagtcctaccncttccccttcctcgttcctgcctattcggtagggtaacggacgaacgacggtactaccaacctaacttcctacgttcgaccgacgggagacgtcgaaggtactagtacgtactaagtttaacttaagttgtactacgacgacgtaaaggaaaccggaacggaaccgtaccctaacggtcctccgtaacggttaactacccgaagtactacgaccgtaacttaacgtaacgggtttaaacgaaccgggtaccggtacctagttaacgggtaacggttagaggggtaggtaacggtaggtaccggaggttacggagttttaacgttacttttaccacgtactagtacgtacgtcgtacgtccgtacgtacgtacgtacggtacaaggttatactacgtaactaacgtacttacgtaactntaacagtaatacataaccgtacctacccttcgtacctaccggtcgtaaccggaactacggtataacgtacgtaaacgtacggacgtcggacgtaccgtactacgattacccgttgttaccgttacc

SEQ ID NO: 204609 - DNA, 650 bp, Homo sapiens
  misc_feature: GYAE6OF01CBXLY.47.62.F07.1.454.CMB.1.raw
  modified_base (206)..(206): a, c, t, g, unknown or other
  misc_feature (206)..(206): n is a, c, g, or t
tcagagctcacgtacacgaccggtgctcgatttagtagtcgcataaagggaaagggggagtcagtcccaaccaggacacagcctggacatgagggtccctgctcagctcctggggctcctgctgctctgctctcaggtgccagatgtgacacccagatcgacccagtcctccattccctcctgtctgcctatcgtgagagacagancacatcacttcgccaggcgacgtcgaggactagttacactaacttaattttaattggtatccgaagcgaaacgaaaccggtaacggaaaccgtacccctaagtcctacccgtagtacttccgaacgtatacggctaactacgtaagttacggaacgcggtacccatacgtagttacaggtagagtgatcgtagtatagtttacttttacgacctactatacgtacgcgacgtcgtacgacgtacgtacgtaagtaattagtacgttacacgtaaacttacgtttaacttacgttacgtaaccgtaattacggttaactacctaactttaccctacccgttacccgttaccgttaccggtacccgtacgaaccgttaacgagttaaccgacgttaacgaactcgtcggtacgtccgtacgactaccgttaccttcgtcgtttacc

SEQ ID NO: 204610 - DNA, 612 bp, Homo sapiens
  misc_feature: GYAE6OF01BRT1I.47.62.F07.1.454.CMB.1.raw
tcagagctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagatgacccagtctaaccatcctccctgtctgcatctgtaggagacagagtcaccatcacttgccaggcgagtcgaggacattagcaacttaatttaaattggtatcagacaagaaaccgagggaacacccctaagcctcctagatctacgatgctactctaagtttacggaaacgtacggggtacccatacgtaaggttcagtaggaagtgagtcgtaggactagttattttacttacactatacagcacgcctgaccacgtccgtaggaaatattacgtacgaactaacgtaattactttactacgtacctaaacgtagttaactaacgtaacttaaccttcccttaccccgttaccgtttcccggacccgttacgggtaacctaaaggtcggtaataccgtaaacaaccgtaacgtggtaacggcctacgaccctactacgttcttacgttccc

SEQ ID NO: 204611 - DNA, 597 bp, Homo sapiens
  misc_feature: GYAE6OF01BGSDG.47.62.F07.1.454.CMB.1.raw
  modified_base (281)..(281): a, c, t, g, unknown or other
  misc_feature (281)..(281): n is a, c, g, or t
tcagagctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagatgacccagtctccatcctccctgtctgcatctgtaggagacagagtcaccatcacttgccaggcgagtcaggacattagactaactatttaaattggtatcagacaacgaaacgagggaaacncccctaagctaccgtgactctacggatcgactactacctaaagtttacggaaactagggactacccaatacgtaaggttcgaaggtaggaagtggatcgtgggtactagttattttacgtacactatcgaagcaacgtcctagactacgaccttagaacgtactagttcgaactaacgtattaacttacgtacgtaactaacgtagttacactaacttaccttacctaccccttagtcccggtacctaaggtacctaaaggtacgtatactaacgaaacgtaagttggcgtacgtactaccgactgttcgttaccg

SEQ ID NO: 204612 - DNA, 644 bp, Homo sapiens
  misc_feature: GYAE6OF01E1TCX.47.62.F07.1.454.CMB.1.raw
  modified_base (205)..(205): a, c, t, g, unknown or other
  misc_feature (205)..(205): n is a, c, g, or t
  modified_base (359)..(359): a, c, t, g, unknown or other
  misc_feature (359)..(359): n is a, c, g, or t
  modified_base (415)..(415): a, c, t, g, unknown or other
  misc_feature (415)..(415): n is a, c, g, or t
  modified_base (511)..(511): a, c, t, g, unknown or other
  misc_feature (511)..(511): n is a, c, g, or t
  modified_base (516)..(516): a, c, t, g, unknown or other
  misc_feature (516)..(516): n is a, c, g, or t
tcagagctcacgtacacgaccggtgctcgatttagtagtcgcataaagggaaagggggagtccagtcccaaccaggacacagcctggacatggagggtccctgctcagctcctgggctcctgctgctctggctctcaggtgccagactgtgacacccagatgacccagtctccatcctcctgtcctgccatctgtaggagacagngtcgaccatcacttgccaggccgtagccaggactatttacgcaaccttaatttaaacgttggtatacaagtccgaagaaacccgaggggaaaccgtacccctaaagctaccgtatactctaacgactcgacactacctaacttagggaaaaccncggggttacccaagtacctaaggtttcaacgggttagggaaggtcggaacttcggngggtaactagtagtttttaccttaccaccgtattaccagcctacggccttcggacaccgtacgaataagtatacgttcacaactattaacgttaancgtanaacgagttactacgaataactcctaccccgttcgtttacccggacccttaggacctaaaggtcgtaaactcttaaaccgaacgttaacgtcggttacgactcggtacccaacttcgtctcggttaccc

SEQ ID NO: 204613 - DNA, 752 bp, Homo sapiens
  misc_feature: GYAE6OF01D81QP.47.62.F07.1.454.CMB.1.raw
tcagagctcacgtacacgaccggtgctcgatttagtagtcgcataaaggggaaagggggagtcagtcccaaccaggacacagcctggacatgagggtccctgctcagctccgtgggctcctgctgctcgtggctctcgaggtcgaccagatgtcgacactaccgagactacgacccagtccgccactccctacactcgtctcgctagtcgtaggaggaagacgaggactaccaactattacctacggtttcgggaccgggacgtacgggtcgaaggtaccttagttagttactttaacgtttttacggtccgttggtttacacgtacgaaacggtaaaccggaacggtaaaccctaccccgttaacggttaccctaggtacttaacgttgtcgtaccgttgttccgttaccttacgttacggtaacgtaacgggttccggtaccctagttaacggttaacggttcggcgggttcggaggttaccgtggtaacggtactacgttaccttccgtactaccgtaccacccgataccgacgtaccgtacgacgttcgaccgttacgaacgtagtaacgtatacgtactaacgttacgtaactttacgttaagaccgttaactaacgtactaacttaactaacttaccttacccccgttacgtaccggttacccggtaaccgaacgttaaaccgtaggtacgtaacttaaccgaaacgtacgttacgtcgaccgtccagtaccaactcgtcttaccg

SEQ ID NO: 204614 - DNA, 782 bp, Homo sapiens
  misc_feature: GYAE6OF01DJ7LO.47.62.F07.1.454.CMB.1.raw
  modified_base (177)..(177): a, c, t, g, unknown or other
  misc_feature (177)..(177): n is a, c, g, or t
  modified_base (773)..(773): a, c, t, g, unknown or other
  misc_feature (773)..(773): n is a, c, g, or t
tcagagctcacgtacacgaccggtgctcgatttagtagtcgcataaagggaaagggggagtcagtcccaaccaggacacagcctggacatgagggtcctgctcagctcctggggctctgctgctctggcttcacgaggtcgccgagtatcggtcgaccaccctagactcggaacccngtcctctactcccctcctgtcctagctagttcgtaaggaggacgacgaggacttaccaactactcctacgttcgccgaaggtaccgagttaccgaaggtactacgttaagacccttaaagttagttttaagtaggtactacggaacacgaaacggaaccggtaagggaacctccctaagcttaccgagacttaccgaagcctaggtacaacgtaacttaacgggttaacgaaacccggttggtaaccctaggtaaccggtaaggttccgaaagggttggtaaggttaccggtaacgtcgggtaacggtaaactttaccggttttaacctttaaccggtacgtaactacggttacgtaccgtacgtaaccggtcctacgtacgtacccgttaacgtaacgggtaataacgtacgtacctaacggttaaccttaacgttaacgtttaacgtacgtaacgtaacgtaacgttaaccttaactaaccgtttaaccctacccttacccgtttaccgttaccggtaaccggttaccgacgtaaacggtaagtacgtaaccgtagaaaccggtgtacggtacgacgtacgacgtactacgttntcgttaccc

SEQ ID NO: 204615 - DNA, 679 bp, Homo sapiens
  misc_feature: GYAE6OF01AX1WU.47.62.F07.1.454.CMB.1.raw
  modified_base (157)..(157): a, c, t, g, unknown or other
  misc_feature (157)..(157): n is a, c, g, or t
  modified_base (192)..(192): a, c, t, g, unknown or other
  misc_feature (192)..(192): n is a, c, g, or t
  modified_base (199)..(199): a, c, t, g, unknown or other
  misc_feature (199)..(199): n is a, c, g, or t
  modified_base (227)..(227): a, c, t, g, unknown or other
  misc_feature (227)..(227): n is a, c, g, or t
  modified_base (267)..(267): a, c, t, g, unknown or other
  misc_feature (267)..(267): n is a, c, g, or t
  modified_base (313)..(313): a, c, t, g, unknown or other
  misc_feature (313)..(313): n is a, c, g, or t
tcagagctcacgtacacgaccggtgctcgatttagtagtcgcataaagggaaagggggagtcagtcccaaccaggacacagcctggacatgagggtccctgctcagctcctgggctcctgctgctctggctctcaggtgccagatgtgacacccagntcgacccagtcctccatcctccgtgtctgccatcngtacganacacagtcacctatcctacgttgccggngaacgtcaggactattagctaattatttacgccttagtancagacaagaaacagggtaacttccaagcctactgatctatgttacnctaccttattcacgttacgttccgggtcctacgttcgtacggtcctaggtaggtcccgtagaggtacgtacggtggggactagttactttcgacttcaccgtacacttacgaacgtccgtacgctacggacctaacgtaccgtaggaacgttatcggtttacgaccttaagtttaaccttaacgtagttaaacctaaaactacgttaaaccgtacgtaacccggtcccttaacgttaccgttacgggttaacccgggaccggtaaacggggtaaccgtaaggggttaccggaagttaaaccggtaccgttaaaccggtacggtacgttaacgggtccgtaaagtacccgtaccctacggttacccg

SEQ ID NO: 204616 - DNA, 858 bp, Homo sapiens
  misc_feature: GYAE6OF01C3EBF.47.62.F07.1.454.CMB.1.raw
  modified_base (235)..(235): a, c, t, g, unknown or other
  misc_feature (235)..(235): n is a, c, g, or t
tcagagctcacgtacacgaccggtgctcgatttagtagtcgcataaagggaaagggggagtcagtcccaaccaggacacagcctggacatgagggtccctgctcagctccgtggggctcctgctgctctggctctcgaggtcgccagatgtcgaccacccgagactcgaccctagtcctccacttccctcccgtgtctgctattcgtaggtaggacgacagtacgtccaaccgtnttacctacgttcggaccgtagggccgtaacggtaccgaagggtaacttaagttaacgtaaccttaaacgttttaaagtttttaaaggtttaggttaactacgtaacgtaaccgaaacggtaaaacccgaaacggggtaacccgtacccccgtaagtccgtaccgttaggtacttacccgtaacggtaactcgaccttaacgtaaccgttaaaggtttaacgggaaaccggtaccgggtaccctaagttaaccgtaacggttaccggtaaggtacggtaacggttaggtacgttacggtaacgggtaacctaagtttttaaccgttttaccgtttaaccaaccgttaacgtacgtaacggtccctaacgtacccgttagaccgtaacgttccggtaaaaggtttaacgtttcgttttaacccgaactttaaacctttccgtaacgtacgtaaccgtaacgttaccgggtttaaccggttaaccccgtttaacccgggttactttacgggttaccggaaccggtaaacccggtactacggtacaaacgtaacaccgtaaagtcgtacggtcgactacgaccctattcgtccgttagttacccttacgtacccgtttccgtacccg

SEQ ID NO: 204617 - DNA, 855 bp, Homo sapiens
  misc_feature: GYAE6OF01BPZD1.47.62.F07.1.454.CMB.1.raw
tcagagctcacgtacacgaccggtgctcgatttagtagtcgcataaagggaaagggggagtcagtcccaaccaggacacagcctggacatgagggtccctgctcagctccgtggggctcctgctgctctggctcgtcgaggtcgaccagtagtgtacgaccacccgtagactcgacccagttcctaccactccctcccgtgtctgactacttcgtaggtaggacgacgtagacgtaccaccacgtactaccgttacgaccggtacggcgacgtcgaacgtactacgttacgaacttaactttaagtttaagttacggtatacgacgaacgaaccgaaacggtaacggaaccgtaccctacgtccgttacgtacgtactaccgttagacgtacgtacctaaccgtaacgtttaagggttaaacgggaacccggtaaccggttacctacgtaacggtacgttaggaggtaacgggtagttacggagttacgggacggtaacttacgtttacttttacgaccacgtactaccgacgtacgtaccgtaccgttacggaccgtacgttaacgttaacggttaaacgttttacggtttacgtttaagtttaacgtttaacgtttacgtaacggtaacgtttaacgggttaccgttacccggttacccgtaccgttaaccgggtacccgggttaaccgggacgggtaaacccgggtacggtaacgggtacgtaacgggaaacgttaaaggtacggtaacggttcgggttaaccgttcccgggtacccgtaccccgttaaccggttaacgtttccgttaacccggttacccctttttaccgaccccggttcccccgttacccg

SEQ ID NO: 204618 - DNA, 719 bp, Homo sapiens
  misc_feature: GYAE6OF01E0V8L.47.62.F07.1.454.CMB.1.raw
  modified_base (350)..(350): a, c, t, g, unknown or other
  misc_feature (350)..(350): n is a, c, g, or t
  modified_base (370)..(370): a, c, t, g, unknown or other
  misc_feature (370)..(370): n is a, c, g, or t
tcagagctcacgtacacgaccggtgctcgatttagtagtcgcataaagggaaagggggagtcagtcccaaccaggacacagcctggacatgagggtccctgctcagcctccgtggggctcctgctgctcgtgctctcaggtcgccagatgtacgaccaccagactcgacccagtcctctactccctcccgtgttctacgctattcgtaggtaggaacgacgagtacgtaccaactacttaccgtaacttccggcccgtaaggggtccgagtaccgaagtactattacgaactaactttaagtttaagtacgtatcgacgacgaacgaaacgaacggaactacccgtaacnctacgtagtacgtcgaacgngtactacgtacttaaccgtaagtaaccggtaaacggtacggtacctaagtacgtaacggtacgtaggtagggaattaggtacgttaggtacgtaagtttacgtttaacttttactcctacgtactagtacgcgtacgtctacgacgttacagtacgattatacgtaacaacttacgtaacttactaacgtataacgtaactcgtaacttactaaccgttaccttaccccttacggtttaccgtacccgggtaccggtaacggtaacgttaccggaagttaacctaaccggtaactaaacgggtagttcggtaactccgtaaccgtactacctacgttccgcttaccccg

SEQ ID NO: 204619 - DNA, 820 bp, Homo sapiens
  misc_feature: GYAE6OF01A06O9.47.62.F07.1.454.CMB.1.raw
  modified_base (130)..(130): a, c, t, g, unknown or other
  misc_feature (130)..(130): n is a, c, g, or t
  modified_base (772)..(772): a, c, t, g, unknown or other
  misc_feature (772)..(772): n is a, c, g, or t
tcagagctcacgtacacgaccggtgctcgatttagtagtcgcataaagggaaagggggagtcagtcccaaccaggacacagcctggacatgagggtccctgctcagctccgtgggctccgtgctgctcgnggctctcgaggtgccgagatgtacgaccaccgagactcgaccctgtcctacctctccctccgtgtctcgctagtcgtaggtagacgacgtaggtacctaccgtaccatacctacggttcgaccgacggggtacgagttaccggaagtaacgttaacgtacgtaaaccttaaaatttaagttttaaacgttgaacttaccggaagtaaccgaaaacgggaaaccggtaaccgggtaaccccctacccccttacgtacccacgttaccttaccgtacctagtccgtacgtaccttaaccgttgttaacgacggtaacggtcccgtactaaggtaccggtaaggtcggacgtcggtaaagtccggttagtaccggtacggtaggaaccgttagtttacctaaacgtccttctaaacggaccgttaccaggtacccgataacccggttccgagtaccgtacgttaaccgtagttacgttttaaggttacctttaagtacgtttcgtaaccggtaacgaaggttcccttaaggtttccccgtaactccggttaacttaccggggacgggaccggtaacgggtacgttaacggagtttaaacggaaccgggtttaaaagacggttccgggttaagtaccccgtaaacncggttaccccggactttaggggttttacctcctttaaaccccgggtcc

SEQ ID NO: 204620 - DNA, 551 bp, Homo sapiens
  misc_feature: GYAE6OF02GFF0S.47.62.F07.1.454.CMB.1.raw
  modified_base (366)..(366): a, c, t, g, unknown or other
  misc_feature (366)..(366): n is a, c, g, or t
tcagagctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttacttnaccatcagcagcctgcagcctgaagatattgcaacatattactgtacaacagtaatcaattaactcctacccctacttttccggaccccttaggggaaccctaaaggttcggaacttaactaccgaaaaaccggtaacttaggttacggaccttacggacctaacccaatttcctaggtttaccc

SEQ ID NO: 204621 - DNA, 487 bp, Homo sapiens
  misc_feature: GYAE6OF02JH9F8.47.62.F07.1.454.CMB.1.raw
  modified_base (417)..(417): a, c, t, g, unknown or other
  misc_feature (417)..(417): n is a, c, g, or t
tcagagctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttgaaacaggggtccatcaagttcagtggaagtggatctgggacagtattttactttcaccatcagcagcctgcagcctgaagatattgacaacatattactgtaccaanagtatcaataactctcccattcgcctggaccagtggatatacaaagaactgtagctgacacatctgtacc

SEQ ID NO: 204622 - DNA, 483 bp, Homo sapiens
  misc_feature: GYAE6OF02IIWRG.47.62.F07.1.454.CMB.1.raw
  modified_base (274)..(274): a, c, t, g, unknown or other
  misc_feature (274)..(274): n is a, c, g, or t
  modified_base (457)..(457): a, c, t, g, unknown or other
  misc_feature (457)..(457): n is a, c, g, or t
  modified_base (468)..(468): a, c, t, g, unknown or other
  misc_feature (468)..(468): n is a, c, g, or t
  modified_base (481)..(481): a, c, t, g, unknown or other
  misc_feature (481)..(481): n is a, c, g, or t
tcagagctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagatgacccagtctccatcctccctgtctgcatctgtaggagacagagtcaccatcacttgccaggcgagtcaggacattagcaactatttaaattggtatcagcagaaaccaggaaancccctaagctcctgatctacgatgcatccaatttggaaacaggggtccatcaaggttcagtgaagtggatcgtgggacagtattttacttcacctatcagcagctgcagcctagaagatattgacaacataattactgtacaacagtatcataactctccctacttcgcctggacaagtgatnacaaagactgngctgacacatctntc

SEQ ID NO: 204623 - DNA, 657 bp, Homo sapiens
  misc_feature: GYAE6OF02GHFIW.47.62.F07.1.454.CMB.1.raw
tcagagctcacgtacacgaccggtgctcgatttagtagtcgcataaagggaaagggggagtcagtcccaaccaggacacagcctggacatgagggtccctgctcagctcctggggctcctgctgctctggttcccaggtgccaggtgtgacatccagatgacccagtctccatcctccctgtctgcatctgtaggagacagagtcaccatcacttgccggcgagtcagggcgttgcaatgctttggcctggttcagcagacacgaggaacgccctaagcgcctgactcgtatggtgctatactactttgacgtaaaggtcgggtacccatacgaaggttcgagcggacaggtaggtcgtagggactaggtacgttcacttctactactacgtcgacggtccggcctggaccacgtccgtaagtaacgtacttacgtcgtaaccttaactttacgttacttacgtacctaccgtaagttacttagtacgttccgttacccgtttacccgttaccggttacccggttaccggaaccggtaaaccggggtaaccgtaacgggttaacgaaacgtaaccgtaaaaccggttaccggttaggtaccggtccttaacggaccctaaccgttacgtttaccgtttacgttaccctttaaccccg

SEQ ID NO: 204624 - DNA, 590 bp, Homo sapiens
  misc_feature: GYAE6OF02I7OWK.47.62.F07.1.454.CMB.1.raw
  modified_base (261)..(261): a, c, t, g, unknown or other
  misc_feature (261)..(261): n is a, c, g, or t
  modified_base (283)..(283): a, c, t, g, unknown or other
  misc_feature (283)..(283): n is a, c, g, or t
  modified_base (537)..(537): a, c, t, g, unknown or other
  misc_feature (537)..(537): n is a, c, g, or t
tcagagctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagatgacccagtctccatcctccctgtctgcatctgtaggagacagagtcaccatcacttgccaggcgagtcaggacattagactaacttaatttaaattggtatnagacaagaaaccaagggaaacncccctaagctacctagactctaacgatgactactactaatttaggaaacgcggggtacccagtacgaaacggttcaaggtaggaagtggatcgtagggactagtattttactcgactatcgagacagtctacgacgtacgacgtagaagtatattagacctaatattacttaactagtaacaatagttaactactaacttactaccttaccctacgtttacccggaccgttagggaacctagtacggtaactanctaaaacgtaccgttagtacggactacggacctaaccgattaccgtagttacc

SEQ ID NO: 204625 - DNA, 521 bp, Homo sapiens
  misc_feature: GYAE6OF02J0689.47.62.F07.1.454.CMB.1.raw
  modified_base (309)..(309): a, c, t, g, unknown or other
  misc_feature (309)..(309): n is a, c, g, or t
  modified_base (395)..(395): a, c, t, g, unknown or other
  misc_feature (395)..(395): n is a, c, g, or t
  modified_base (515)..(515): a, c, t, g, unknown or other
  misc_feature (515)..(515): n is a, c, g, or t
tcagagctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacatccagatgacccagtctccatcctcctgtctgcatctgtaggagacagagtcaccatcacttgccggcaagtcagagcattaacagcgatttaaatggtatcacagaaaccagggaaacgacccctaacctcctgatactatgctgcatccagtttnctagtacgtcgggtccatcgtagttcagtgctagtgatcgtgggactagatttcacgtctcacatcagcagtctgcaactgtaatnttagctaacttacactagtcaactagtacgttaaccgtaccttacgtacgtttcggacgtagggacctaacgtgacctataccgaaagtacgtgttacggcttacggccactactacgtnttaccg

SEQ ID NO: 204626 - DNA, 781 bp, Homo sapiens
  misc_feature: GYAE6OF02HPI6W.47.62.F07.1.454.CMB.1.raw
tcagagctcacgtacacgaccggtgctcgatttagtagtcgcataaagggaaagggggagtcggagtcccaaccaggacacagcctggacgatgacgggtccctgcgtccaggctcctggggctcctgctgctctcggctctcaggtcgccaggactggtcgacacccagactgaccctagtctccatccctccctgtctgctactcgtgtaggagacagacgtcacctatctacgttcggaccgggcgtaagtcgacgggtcgttggactaaagtgtcgtttcggcgttggttacagcacgacgacgaacgggaaccgaccctaagccgtacctagacgtactagtcggtacgcgtacttactacgtttcgacgtaacggtcgggtacctagtacgtaacgttcgaggcggacgtaaggtacgtcgtcggtactaggtacttctactctacgtaacctacgtcgacggtccgtaccgtgaccgtacgtccgtaagttaacgttacgttaccgttacggtaaccttaaccgttttaaattaccggttaacgttacccgttaacccggttaagtttaacgttacggtaacgttttaccgtttacccggtttaaccccgggttacggttaacccgggttttaaccggaacccgggtaaccgggttaaaccggtaacggggtaaacggttaaaaccgtaacccggtaaaaccggtaaccggttacgggtacccggttaacccggtcgtaaccccgtaacgttacccgttaccgtttaaccccgg

SEQ ID NO: 204627 - DNA, 626 bp, Homo sapiens
  misc_feature: GYAE6OF02G63N1.47.62.F07.1.454.CMB.1.raw
  modified_base (457)..(457): a, c, t, g, unknown or other
  misc_feature (457)..(457): n is a, c, g, or t
  modified_base (498)..(498): a, c, t, g, unknown or other
  misc_feature (498)..(498): n is a, c, g, or t
tcagagctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagatgacccagtctccatccctccctgtctgcatctgtaggagacagagtcaccatcacttggccgggcgagtcagggcgttgacaaatgctttggccttggttcagcagacaccgagggaacgccctaagccgccgtgacgtactagtggtgacctagtacctacttttgaacgtaaaggtcggggtaccacgttacgtaacggttacgaggccgacgtaggtacggtcgtagggacaagtagttacctactctacgtactactccgaacgccggtcctagccgacgtcctagaaacggtnttcgtagacttaacttatttactacgttccttacgtagttntacgtattccgtacctttacccgtcgttaaccgtttccggaaccgtacgggtaaccgtaagggtaacggtaaaccgtaacgaaacggtacgtacggtacgacgttacgacctaccgtattccgttacg

SEQ ID NO: 204628 - DNA, 537 bp, Homo sapiens
  misc_feature: GYAE6OF02G81TG.47.62.F07.1.454.CMB.1.raw
  modified_base (395)..(395): a, c, t, g, unknown or other
  misc_feature (395)..(395): n is a, c, g, or t
  modified_base (398)..(398): a, c, t, g, unknown or other
  misc_feature (398)..(398): n is a, c, g, or t
  modified_base (401)..(401): a, c, t, g, unknown or other
  misc_feature (401)..(401): n is a, c, g, or t
  modified_base (414)..(414): a, c, t, g, unknown or other
  misc_feature (414)..(414): n is a, c, g, or t
tcagagctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagatgacccagtctccatcctccctgtctgcatctgtaggagacagagtcaccatcacttgccaggcgagtcaggggcttgcaaatgctttggcctggtttcagcagacaccagggaaggcccctaagcgcctgatctatggtgcatacactttgacaaagtggggtacccagtacaaggttcaggtcggcacggtaggtctggggactaggagttacactctcactatcagcggctgcngcnganatctgctaacttntaactcgtctaccagtatgacttgacctttacccgtcggttactttccggaccgtaacgggtaccgtaagggtacgaaagtaaccgaaacgaacgtacggtggaccgtgacctaccgattacg

SEQ ID NO: 204629 - DNA, 588 bp, Homo sapiens
  misc_feature: GYAE6OF02GZWZO.47.62.F07.1.454.CMB.1.raw
  modified_base (277)..(277): a, c, t, g, unknown or other
  misc_feature (277)..(277): n is a, c, g, or t
  modified_base (401)..(401): a, c, t, g, unknown or other
  misc_feature (401)..(401): n is a, c, g, or t
tcagagctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagatgacccagtctccatcctccctgtctgcatctgtaggagacagagtcaccatcacttgccaggcgagtcaggacattagcaactatttaaattggtatcagcaagaaaccagggaaacncccctaagcctcctgatctacgatgcatccaatttggaaacgcggggtcccatcgaaggttcagtggaagtgatcgtgggactagttattttacttcactatcagcagcctgcagtcctagaanattagttgactaactattaacttactacgtacaaactagttactactaaattaaccttcccttaccccgttaccgtttccggaccccgttaggggtaaccctaaggttcggtaacttaaccgtaaccgtaaaaccggtaccgttagggtacgtcctacggtacctaaccctattccgttagttaccc

SEQ ID NO: 204630 - DNA, 578 bp, Homo sapiens
  misc_feature: GYAE6OF02HCWSK.47.62.F07.1.454.CMB.1.raw
  modified_base (197)..(197): a, c, t, g, unknown or other
  misc_feature (197)..(197): n is a, c, g, or t
  modified_base (257)..(257): a, c, t, g, unknown or other
  misc_feature (257)..(257): n is a, c, g, or t
  modified_base (385)..(385): a, c, t, g, unknown or other
  misc_feature (385)..(385): n is a, c, g, or t
  modified_base (399)..(399): a, c, t, g, unknown or other
  misc_feature (399)..(399): n is a, c, g, or t
tcagagctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagatgacccagtctccatcctccctgtctgcatctgtagganacagagtcaccatcacttgccaggcgagtcaggacattagcaactatttaaattggtatnagcagaaaccagggaagcccctaagctcctgatctacgatgcataccaatttggaaactagggggtcccatcaaggttcagtaggaagtggatcgtggacagtattttacttcaccatcagcacgccngcagcctgaacatnttagactaactatatactatacaacagttaactcgtaataacttacctaccccttactttacccggtacccttacggggtaaccctaaaggttacggtaacttaacgttaactaaaaccgggtaacttacgggtacgtacgttacgacccgtaaccctacgttcccgttagtttacccg

SEQ ID NO: 204631 - DNA, 626 bp, Homo sapiens
  misc_feature: GYAE6OF02G8IOF.47.62.F07.1.454.CMB.1.raw
  modified_base (275)..(275): a, c, t, g, unknown or other
  misc_feature (275)..(275): n is a, c, g, or t
tcagagctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagatgacccagtctccatcctccctgtctgcatctgtaggagacagagtcaccatcacttgccaggcgagtcaggacattagcaactggttagcctggtatcaacagaaacagggaaacncccctaacctcctcatcctctactgcatcctactttgactaaaggtcggggtacccagtacaaggttcaggcggcaggtggactcgtgggactagtactttcacttctacactactcagccagcctgtacgcctaggtaagttagtttacggtaaacttttagttaacgttcgtaactaaacggtaagggttaaccttacggttttccccgacttaccgtaaccggtttcgggaaccggggtaacggaacccgtaaggggtcggtaacgtaggtaacggaaaacggtacgtgggtaacggtaccttacggaccgtaaccgtattccgtttacgttaccgttacgttacccg

SEQ ID NO: 204632 - DNA, 554 bp, Homo sapiens
  misc_feature: GYAE6OF02GJ7H4.47.62.F07.1.454.CMB.1.raw
  modified_base (398)..(398): a, c, t, g, unknown or other
  misc_feature (398)..(398): n is a, c, g, or t
tcagagctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagatgacccagtctccatcctccctgtctgcatctgtaggagacagagtcacatcacttgccgggcaagtcagagcaattaacagcgatttaaatggtatcacagaaaccagggaaacgcccctaacctcctagatcctatgctgcatccagtttgctagtaggtcggggtaccagttcttaggttcaggtggacagtggatcgtggggaactagtatttccgactctcaccatcagcagtcngcaacctgtaattatttacgactaaacttactactagtactaaacagtacgttaccggttacccgttacttacgttttacgaccgtaagggaacccaaagtgtaacagtaaccgaaacggtactggtacgcgtacgcacctatctacgtcttaccg

SEQ ID NO: 204633 - DNA, 617 bp, Homo sapiens
  misc_feature: GYAE6OF02HF845.47.62.F07.1.454.CMB.1.raw
  modified_base (431)..(431): a, c, t, g, unknown or other
  misc_feature (431)..(431): n is a, c, g, or t
tcagagctcacgtacacgaccggtgctcgatttagtagtcgcataaaagggaaagggggagtcagtcccaaccaggacacagcctggacatgagggtccctgctcagctcctggggctcctgctgctctggctctcaggtgccagatgtgaccacccagatcgacccagtcctccatccctccctgtctgcatcgtgtaggagacagagtcaccatctactcggccgggacaagtcagagactaataacgagtacgtaattttaaaagttgtactaccaaccgaaggaaaaccgaggggaaacctacccccctaaaccttcctagactcttagtcgtcctagctactcgttagttgctaggtcggtcggtcctagtcgtagttcgagtcgacgtagtgatcggaggtatagttcttcacttcgtacactancgacgctacgtctacgacctacgtagtaagttactttacgtacttaacttactatactacgtactacgtaaccgtaccgtaccgttacgtacgtttaccggacgtaacggtacaacggtacgaactacgtaactaacggtacgtaggacggtactacgacctactacgtacgttacgtccttaccg

SEQ ID NO: 204634 - DNA, 722 bp, Homo sapiens
  misc_feature: GYAE6OF02GZRPU.47.62.F07.1.454.CMB.1.raw
tcagagctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagatgacccagtctccatcctccctgtctgcatctgtaggagacagagtcaaccatccacttgccaggcgagtcaggacattagactaattaatttaaagttaggtatcagacaacgaaaaccgaagggaaaccgaccccgtaaagcctccgtagactaccgtacgactgactacttaccgtaaacgtttaggaaaccgtacggggtacccaagtacgtaaggttacgaggtaggtaaggtggtagtcgtagggtaactaagtttacttttacgttacaacctatcgagactacgcctgacgtacgtaccgtaagaacgtaagttacgtacgtactaaacgttactttaacgttaacgttacgtaacctaaacttaacgttaactaactaacgttaaaccttccccgtttaacccctttaccggtttacccggtaacccggtaaccgggttaacccgtaaacgggttcggttaaacgtaaaccgtaaaccgtaaaccggttaaccggttcgggtacggttaccgttacggtacccttaacccgttacgtttccgttaccgtttcccg

SEQ ID NO: 204635 - DNA, 738 bp, Homo sapiens
  misc_feature: GYAE6OF02J3K1W.47.62.F07.1.454.CMB.1.raw
  modified_base (131)..(131): a, c, t, g, unknown or other
  misc_feature (131)..(131): n is a, c, g, or t
tcagagctcacgtacacgaccggtgctcgatttagtagtcgcataaagggaaagggggagtcagtcccaaccaggacacagcctggacatgagggtccctgctcagctcctggggctcctgctgctctggntctcaggtgccagatgtgaccacccagactcgaccctagtcctccactccctcctgtctgctatcgtaggtacggacgactagacgtcctacactctacgttcgaccgaggtcgtacgtacgtacggactattacggaccttaaattaagtttaaacgttggtactaccgaagaccgtaaacggaaaccggtaacgggaacccgtaccctaacggtcctaccgtagtaccgttacgtacgtacgttacgacctaacttaaccgttaacgggttaaccggaaaccgggttaccggtaccctaggttaacgtaacggttagtacggtaggtacgtcggtacgtcggaaggtacttagtttacttttacacactcgacgtaccgtactcggcctagcgtacgtacgtaagtaaccttagtacgaatacccgtaattacgtctaacgtactaacgtaatagttaccaacgttaacctcccggtacccttacccgtccggttaccgtaaccgggacaacggttagtaaccgtataaacccgggtactaaacggtccggttacgacggttaccctagtcccctaacgtttaccgttccgtttcgttaaccccg

SEQ ID NO: 204636 - DNA, 614 bp, Homo sapiens
  misc_feature: GYAE6OF02GKN2L.47.62.F07.1.454.CMB.1.raw
  modified_base (281)..(281): a, c, t, g, unknown or other
  misc_feature (281)..(281): n is a, c, g, or t
tcagagctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagatgacccagtctccatcctccctgtctgcatctgtaggagacagatcaccatcacttgccgaggcgagtcaggacattagctaacttatttaaattggtatcagacaagaaaccgagggaaacncccctaacctctagatctatgctgcactcctagtttgactagtaggtcgggtcccagttcgtaggtttcaggttggcgtaggtggtatcgtgggaactagtactttcgactcctacgaccatacagctacgtcgtcacctaacgtagttaatattttacgaccttaacttacctactactacgaactacggtaaccgtttacccggttaacccgttacgttacgtttacggaccgtacggggaaccctaacgtacgtaacgtactaaccgtaaaccggtaacgttacggtacggtaccgtacggacccgtaacgtacttaccgttctttaccg

SEQ ID NO: 204637 - DNA, 634 bp, Homo sapiens
  misc_feature: GYAE6OF02G8V17.47.62.F07.1.454.CMB.1.raw
  modified_base (222)..(222): a, c, t, g, unknown or other
  misc_feature (222)..(222): n is a, c, g, or t
tcagagctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagatgacccagtctccatcctcctgtctgcatctgtaggagacagagtcaccatcacttggccgggngagtcgagggtcgttgacaaatgtcttggccttggtttcagcagacaccgagggaacggcccctaagcgccgtgatctagtggtgcatactactttgacgtaaaggtcgggtacccagtacgaaggttcaggcggacgtaggtacggtcgtaggggaactagtacgttacacgtctactaacgtatcgacgccggtcctgccacgtacctagaacgtacttcgagtacctaactttacttacctacgtcttaccgtaagttactagtacttccgttacctttaccccgtacggttacccgtttacgggtaccgtaacggggtaccgtaaacgggtaacgtaaaacgtaccgtaaaacggtaccgttagggtaccggtcgtaccggtacctaacccgtacgttaccgttaccg

SEQ ID NO: 204638 - DNA, 683 bp, Homo sapiens
  misc_feature: GYAE6OF02FY84W.47.62.F07.1.454.CMB.1.raw
  modified_base (197)..(197): a, c, t, g, unknown or other
  misc_feature (197)..(197): n is a, c, g, or t
tcagagctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagatgacccagtctccatcctccctgtctgcatctgtagganacagagtcaccatcacttcgccaggcgagtcgaggacattacgactaacttaatttaaattggtatcagacaacgaaaccgaagggaacgacccctaagcctacctagactactacgatgactatacctaagtttacgggaaacgtacggggtaccctagtacgtaacggtttcaggtagggaagtggtaactcggtagggtaactagtacgttcctacttctactaactactaccgacggtcgtccgtcgcgacgtccgtagaaacgtcttaccgtagacctttaaacgtttattaccgttcgttaccttaccgtaagttacttacggtacttccggttaccctttacccggttaccggttaacccggtttaccgggaacccggttaacgggtaccgttaacgggtaaccggtaaaacgtaaccgtaaacgtaaccgttaggtacggtacctacgtaccgtaccctagttaccgtactttacccg

SEQ ID NO: 204639 - DNA, 659 bp, Homo sapiens
  misc_feature: GYAE6OF02G3I6N.47.62.F07.1.454.CMB.1.raw
tcagagctcacgtacacgaccggtgctcgatttagtagtcgcataaagggaaagggggagtcagtcccaaccaggacacagcctggacatgagggtccctgctcagctcctggggctcctgctgctctggctcccagataccagatgtgacatccagatgacccagtctccatccctccctgtctgcatctgtaggagacacagtccaccatctacttcggccgggcgtagtcgaggacattagactaatttattagcctaggtatcagacagaaaccagggtaacttcctaagctcctgatcctatagttacatcctactttcgactacggttccgggtaccctagtccgttacggttcaggtggacgtaggtgtattcggtcgggaactagtactttcaccttctaccactatcgaagcgacgtcctgaccacgtaccctagaacgtgttacgttacgacttaactttactttactagttaaactaaaaattactaaacgtgtacccgaccccgttacttacccgttacggtttaccgggacggggtaaccgggtaaccgtaaggggtacggtaaacggtaaacgtaaaccggtaaaaccgttaacggttacgggtaccggtccgtaacccggtaccttacccggtactttacccgg

SEQ ID NO: 204640 - DNA, 635 bp, Homo sapiens
  misc_feature: GYAE6OF02GM03Q.47.62.F07.1.454.CMB.1.raw
  modified_base (274)..(274): a, c, t, g, unknown or other
  misc_feature (274)..(274): n is a, c, g, or t
tcagagctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagatgacccagtctccatcctccctgtctgcatctgtaggagacagagtcaccatcacttgccaggcgagtcaggacattagcaactatttaaatgtatcagacagaaacagggaaacnccctaagctcctgactactacgatgctatcctaaagtttacgggaaaaccgtagggggtaccccaagtaccgtaaaggttcaagggttagggaaaggttgggtaacgtcgtaggggaactaaggttactttttaaccgtttaccaacctaattcaagtaccagtccctggactacgtccttagaaattattagttacaactaactatttaattaaccgtataaccgaaactagtaacttactaacttaacctccctttacccctacgtttacccggacccgttaacggggtaacctaaggtgtaactaacgtaacaaacggtaccgtagtacggactacgtacccactacttcgtgttacc

SEQ ID NO: 204641 - DNA, 797 bp, Homo sapiens
  misc_feature: GYAE6OF02FR0IJ.47.62.F07.1.454.CMB.1.raw
tcagagctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagatgacccagtctccatcctccctgtctgcatctgtaggagacagagtcaccatcacttgccaggcgagtcgaggactattagctaactaatttaattggtatactagcaagaaacaagggaacgacccctaagcctcctagactctacgatgctaatacctaagtttacgggaaaaccgtacgggggtaccctagtaccgtaaacgggtttacgaaggttacgggtaaggttagggtaacgttacgggttacgggggtaaacctacgggtttaacttttttaaccggttttaccctaaccttaacgttaccggtaacgtaccgtaaccgggttccccttaggacccgtaacgtaccccggttaagggtaaaacggttaacgtaacgtttaggaaaccctaaacttaaacttttaaccgttaaccgtttaacgtacctaaaacgttaacggttacttaacctaagtttaaacccttaccccgtttaccccgtttacccgtttacccgggttaccccgtacggggtaaacccgtaaagggttacggtaacgttaaacgttaacccgtaaaacggttaacccgttaggttaaccggtacggttaccgtaacccgtacttaccgttaccgttccggtttaaccc

SEQ ID NO: 204642 - DNA, 555 bp, Homo sapiens
  misc_feature: GYAE6OF02G3W9W.47.62.F07.1.454.CMB.1.raw
  modified_base (276)..(276): a, c, t, g, unknown or other
  misc_feature (276)..(276): n is a, c, g, or t
tcagagctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagatgacccagtctccatcctccctgtctgcatctgtaggagacagagtcaccatcacttgccaggcgagtcaggacattagcaactatttaaattggtatcagcaagaaaccagggaacnccctaagctccgtgatctacgatgcatcctaatttcggaaactcggggtcccatcgaaggttcaaggtggaagtggatcgtgggactagtacttttacttcaccatcagcagtcctgcagcctagaatactgtcgacaactatattactgtacaactagtactacaacttaactcccttaccctacgtttccggaccttacgggaaccctaaggtcgaacgttacgtaaccgaaaccgtacgtacgtcggtactcgacctacctacgttcctgttaccc

SEQ ID NO: 204643 - DNA, 622 bp, Homo sapiens
  misc_feature: GYAE6OF02JBRXN.47.62.F07.1.454.CMB.1.raw
tcagagctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagatgacccagtctccttccaccctgtctgcatctgtcggagacagagtcacatcacttgccggcagtcagagtattgataggtgttgcctggttcagcagacacgaggacgccctagcgtcctgatcgtagtggtcgactatactacgtttagacgtaaaggtcggggtaccctaagtaccgtaaggttccagggtccggacgtaaggttacggtcgtacgggaacctagtacgttacctacgttacctaccgacttacgtccgaacggtccggacctacggaccgacgtctaggaacgtcttacgtacgtacttaactttacttacgtcgttcctaccgtagttactagtacttcgtacctttacccgttccgtacgtttccggaccgtaacggacgtaaggtaacggtaactaacgtaaacgtagtacggtagtacgtagacccgtactagttcctagttaccg

SEQ ID NO: 204644 - DNA, 676 bp, Homo sapiens
  misc_feature: GYAE6OF02FE6YR.47.62.F07.1.454.CMB.1.raw
  modified_base (197)..(197): a, c, t, g, unknown or other
  misc_feature (197)..(197): n is a, c, g, or t
  modified_base (256)..(256): a, c, t, g, unknown or other
  misc_feature (256)..(256): n is a, c, g, or t
  modified_base (273)..(273): a, c, t, g, unknown or other
  misc_feature (273)..(273): n is a, c, g, or t
tcagagctcacgtacacgaccggtgctcgatttagtagtcgcataaagggaagggggagtcagtcccaaccaggacacagcctggacatgagggtccctgctcagctcctggggctcctgctgctctggctctcaggtgccagatgtgacacccagatgacccagtctccatccctccctgtctgcatctgtagganacagagtccaccatcacttgccaggcgagtcaggcattagcaactatttaaattggtancagcagaaaccaggaancccctaagctcctgatctacgatgacactcctaatttaggaaaccgtacggggtacccatacgaaggttcaggtggaagtggatcgtaggactagttaactttttactttccgaacctatacgagtcgaacgtccttgcctaacgtcccgtagaaagcttaacgttcgaaccgaaattacgttaaacttacgttacgtaacctaaacgtaagttacgtaacttaaaccttaaacttacccctttaccccgtaaccttttacccgggacccttaaccggggtaaaccccgtaaaggttcggtaaaccgtttaacgtaaacccgtaaaaacgggtaaaccgttaggtttaccgggtaccttacggaaccctaacccgtaacctttacggttaccgttttaacccc

SEQ ID NO: 204645 - DNA, 766 bp, Homo sapiens
  misc_feature: GYAE6OF02I4MJI.47.62.F07.1.454.CMB.1.raw
  modified_base (201)..(201): a, c, t, g, unknown or other
  misc_feature (201)..(201): n is a, c, g, or t
tcagagctcacgtacacgaccggtgctcgatttagtagtcgcataaagggaaagggggagtcagtcccaaccaggacacagcctggacatgagggtccctgctcagctccgtggggctcctgctgctctggctctcaggtgccagatgtgacacccagatgacccagtctccatccctcctcgtctgctatcgtgtagganacagacgtcaccatctacttgccaggcgtagcgaggactagttacgactaaattatttaaagttgtatcagacgaagaaaccgaagggaaacgaccctaaggccttaccgtgtactactacgacgttacactacttactaaacgttttacgggaaaaccggtaccggggttaccctaacgttaaccggtaaaacggtttaccgtaaagggggtaagggtaaacggggttagggtaacggttacgggttacggggtaaacttaacggttttaaccgtttttttaaccgttaccctaaaccgtttaacgttaccgaacggttaccgaacggttccttacgggacttaaccgtaccggtaaggtaaagttacttaacgttacaaaacttaacgtatttaaatttaaccgtacgttacaaaacgtgttaaaccctattaaaccttaacctacccttaccccgttattacccgggccctaagggtaaaccctaggtacgttaaccaacttaaacggaacccggtaattcggaacggttgaccctacgtaactacggttccttagttaccc

SEQ ID NO: 204646 - DNA, 794 bp, Homo sapiens
  misc_feature: GYAE6OF02HDTS3.47.62.F07.1.454.CMB.1.raw
tcagagctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagatgacccagtctccatcctccctgtctgcatctgtaggagacagagtcaccatcacttgccaggcgagtcaggacattagactaacttatttaaattggtatcagacaagaaaccgaagggaaacgacccctaagcctacgtcgtactacctacgtatcgacacgttacctaagtttacggaaacgtacgggggtaccctaacgttaccgtaaacggtttacgaacggttaagggtaacggttagggtaagttaccggtaggggtaaaccttaaaggtttaacgtttttttaaaccctttaccgtaacccgtaacgttaccgtaaaggtcctaacggtcccttacggaccgtaaccggtaccgttaagggtaaagttaagttaaccgttacgtaacgtaaaaccttaagtttaactttaaccgttacgttaaccctaaacgtaacggttaacttaccgtaaacttaacctttaccccgttacccccgttaaccgttttacccggtaccccgtttacggggtaaacccctaacgggttacggttaacttaaccggtaacccgtaaaacggtaaccgttacgggttacggtccttaccggacccgttaacccggtacgtttaccttaccggtttaaccc

SEQ ID NO: 204647 - DNA, 738 bp, Homo sapiens
  misc_feature: GYAE6OF02GWA7C.47.62.F07.1.454.CMB.1.raw
  modified_base (177)..(177): a, c, t, g, unknown or other
  misc_feature (177)..(177): n is a, c, g, or t
  modified_base (216)..(216): a, c, t, g, unknown or other
  misc_feature (216)..(216): n is a, c, g, or t
  modified_base (724)..(724): a, c, t, g, unknown or other
  misc_feature (724)..(724): n is a, c, g, or t
tcagagctcacgtacacgaccggtgctcgattttagtagtcgcataaaaggggaaaggggggggagtcagtccccaaccaggacacagcctgggacatgaggggtcccctgctcagctcctggggggctcctgctgctctggctctcaggtgccagatgtgacacccagatgacccngtctccatccctccctgtctgcatctgtaggagacagtncacatcacttggccggcgacgtcagggtcgttgacaaagtcgtacgtttggtccgttcggtttacgagtccaacggaccgtaacccgtaacggggaaaccggtaccccgttaaacggcccgtccgtacgtacgttaccgtacgtcggtacgtacgtacttaacgttacgtttacggaccgtaaaacggttccgggttaccctacgttaccgtaacggtttacgacggtacggtacgtacggtacggttccggtagggtaccgtacgttacggtacctaccggttcttacgtaccttacgtacgtacggtaccggtccgtacggtaccgacggtaccctacggtaacgtacgtttacgtacgtaaccttaacgttttaccgtaacgttcgttaccgttacgttagttacgtacgtacttaccgtaccgttacgttccgtaccgtttacgacgtaccggacgtaacgggtaactacgtaacgtaacgtacgtagtacgtacgtacgtacncgttactacgtacg

SEQ ID NO: 204648 - DNA, 692 bp, Homo sapiens
  misc_feature: GYAE6OF02GFUF7.47.62.F07.1.454.CMB.1.raw
  modified_base (309)..(309): a, c, t, g, unknown or other
  misc_feature (309)..(309): n is a, c, g, or t
tcagagctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagatgacccagtctccatccctccctgtctgcatctgtaggagacagagtcaccatcacttgccaggcagtcaggacattagacaacttatttaaattggtatcagacaagaaaccgaagggaaacgcccctaagcctacctgactctaacggntgctactcctaagtttacgggaaaaccgcgggggttacccagtacgtaacggttacgacggttagggaagtgggtattacggtgggttaaactaggtttacttttttaacctttcaaccgtattacggacgtaaccgtacggcccttggaccctaggacctaacggaaagtacttagttacgaacctaattaacttaattacgtacgtaacaacttaagttaacttacgtaattaaccttccgttaccccgttacgtttacccggaccgttaccggggaaaccgttaacggtacgggtaactaaaccgttaaaccggtaaaccggtattaccgggtacgttacgtaccgaacccgtaaccgtcgtttacctaccgtttacccg

SEQ ID NO: 204649 - DNA, 725 bp, Homo sapiens
  misc_feature: GYAE6OF02FRRXQ.47.62.F07.1.454.CMB.1.raw
tcagagctcacgtacacgaccggtgctcgatttagtagtcgcataaagggaaagggggagtcagtcccaaccaggacacagcctggacatgagggtccctgctcagctcctggggctcctgctgctctggctctcaggtcgccagatgtgacacccagatcgacccagtcctccatccctccctgtctgcatcgtagtaggagacagacgtccaccatcctacttgccgaggcgtagtcgaacggactaagttacgactaacttaatttaaagttaggtatacgagtacaacgaaaccgtaagggaaaccgtaccccgtaacctaccgtacgtaactacttagtcgcgtcgacctacgtaccgttagtttcgactagtacgtcggggtcctagtcttaggttcaggtcggacgtaggtacggacttcgtagggactacgtaatttccacgttccgtacaacctacgtacgtaccgtacgtacgtactaccgtacctaaccgtacgttaagttacgttttacggacctttaaacgttaaccgttacgttaacgtaccgtaaacgtacggttaaccggtttacccggttaacccgtttaaccgttacggtttaccggaccgtaacgggtaaccgtaacgtacgaacctaacggtaaccgtaaaccggtacggttacgtacgggtaccgtacgtaccgtaacccgtacgttcccgttacgtttacccg

SEQ ID NO: 204650 - DNA, 712 bp, Homo sapiens
  misc_feature: GYAE6OF02GVEEG.47.62.F07.1.454.CMB.1.raw
  modified_base (174)..(174): a, c, t, g, unknown or other
  misc_feature (174)..(174): n is a, c, g, or t
tcagagctcacgtacacgaccggtgctcgatttagtagtcgcataaaagggaaaggggggagtcagtcccaaccaggacacagcctggacatgagggtcccctgctcagctccgtggggctcctgctgctctggctctcgaggtcgccagatgtcgacacccagactcgacccngtcctccactcctccctgtctgctatctaggtaggacgacacgacgtccaccatccgtaccttcgaccgaggaccgacgtcgaaggacctattacgacctaaacttaatttaaacgttggtaactcacgacaacggaaaccgagggaaacctaccccttaaccctcctacctactctcctactcgcctaactccctactttcgacgtaacggtcggggtaccctataccggaaggttcaggtccggactaggtcgactcggtggggactagttactttccaccttactcgactacgtcacggtccacgtcctcgacctacgaccgtagtaagtttacgtttagtactttacgttagttctaaccgtaacggtacgggttacttaccggttaccctccgttaccgttaccgggtaccgggtaccgggaacgggttaaccggacggggttaggaacggtaacggaaagggtaaaacgttcggtacgggtacggtccgtacggacccttacgtaaccgttccgtttacgtacccttaccgg

SEQ ID NO: 204651 - DNA, 775 bp, Homo sapiens
  misc_feature: GYAE6OF02JTD1O.47.62.F07.1.454.CMB.1.raw
tcagagctcacgtacacgaccggtgctcgatttagtagtcgcataaaagggaaagggggagtcagtcccaaccaggacacagcctggacatgagggtccctgctcagctccgtggggctcctgctgctctggctctcaggtgaccagatgtcgaccacccagactgacccagtcctaccactccctccctgtctcgctatctgtacggagacagtacgtaccaactctactactcgccgaggcgtagtcgagactatacgactaacttaagttaagttagactcacgtacgaaaggaaaccggaacggaaaccgtacccgtaacgtccgaccgttacgaactaccaaacgtacgtccgtaccgtactaaccggtaaagtttaacggaaacggttaccggggaccctaagggttacgtaacggtacgtaggtacgggtaaggtcggtacgacgggtacggtatacggttacttttcctaagacccgtatacgaacgtcgtaaccggtcgtaacgtccgaacgttacgtaacgtagttaaccgttagtacgtaactaaacgtttacgtttaaccgttaacgttacgttaaaccgttaaacggttaaatacccgttaaactttaaccgtaacctttaaccccgttaccgtttaacccgttcccggttaaacccgtcgggtaaaccgaagggtttacgtaacctaaacggttacttaaacgggtacgttaacgttacggtacggtacccgtaccgacccgtaccgtagtttacccgttc

SEQ ID NO: 204652 - DNA, 778 bp, Homo sapiens
  misc_feature: GYAE6OF02JOBJT.47.62.F07.1.454.CMB.1.raw
  modified_base (252)..(252): a, c, t, g, unknown or other
  misc_feature (252)..(252): n is a, c, g, or t
  modified_base (445)..(445): a, c, t, g, unknown or other
  misc_feature (445)..(445): n is a, c, g, or t
  modified_base (511)..(511): a, c, t, g, unknown or other
  misc_feature (511)..(511): n is a, c, g, or t
tcagagctcacgtacacgaccggtgctcgatttagtagtcgcataaagggaaagggggagtcagtcccaaccaggacacagcctggacatgagggtccctgctcagcctccgtggggctcctgctgctctggctctcaggtcgccagagtgtcgaccaccccagtatcgacccagtcctaccactccctcctgtctgctatcgtgtaggagacagtagtccaactactccgtacttcgccgaggcgacgtanacggactaatacgactaaacttaattttaacgttggtactacgacgaactaacgaaaaccggaacggggtaaaaccgaccccgtaacgtcccgtaccgtagtaaccgtaccgtaacgtacgtataccgtaattaccgtaaagttttaacgggaaaccggtaccggggtaccctaagtaaccggtaaggttaanacgggtagggtaacgtacgtaagtccggtaggtaaacgtacgtttaacttttaccttacgacctanaccgtaacggtctaacggtccgtacgaccgtacgggtacctaagaacgttacgtataacgtaaccgtaacgttaacttactacgttagtaaccttaaacgtacgttaactattaaccgttaaccgtttcccgttacccgtttaaccgtttcccggaaacccgttacgggtaaaacgtacggttacgtaaacctacggttaaaccaaacggttacccggttaaggtccgttacggtacctaccgtaacgttccttaggttacccgttc

SEQ ID NO: 204653 - DNA, 691 bp, Homo sapiens
  misc_feature: GYAE6OF02JTC5X.47.62.F07.1.454.CMB.1.raw
  modified_base (132)..(132): a, c, t, g, unknown or other
  misc_feature (132)..(132): n is a, c, g, or t
  modified_base (455)..(455): a, c, t, g, unknown or other
  misc_feature (455)..(455): n is a, c, g, or t
  modified_base (480)..(480): a, c, t, g, unknown or other
  misc_feature (480)..(480): n is a, c, g, or t
  modified_base (511)..(511): a, c, t, g, unknown or other
  misc_feature (511)..(511): n is a, c, g, or t
  modified_base (666)..(666): a, c, t, g, unknown or other
  misc_feature (666)..(666): n is a, c, g, or t
  modified_base (674)..(674): a, c, t, g, unknown or other
  misc_feature (674)..(674): n is a, c, g, or t
tcagagctcacgtacacgaccggtgctcgatttagtagtcgcataaagggaaagggggagtcagtcccaaccaggacacagcctggacatgagggtccctgctcagctccgtggggctcctgctgctctggntctcgaggtcgccagatgagaccacccagtatcgaccacgttcctccatccctcccgttgtctcgactctactgggacggagtaacagtaacgtaccaccacttccgaacgtttcggccgacgggcggtaacgtcggaagtacctattaaccgaacttaaacttaagtttaacttagttactacgagacgaacggtaaaccggtaacggaaacccgtacccgtagtaccgtaccgtagtaccttacgactacgtcgtacaacttacgtaacgttaacgaacgtcggtaccagtacgtacgtcgtagtacggagtcgatacggngtactaagttcttactcgactgacngtcacgtctacgacttacgacgtagtacctnttaacctaggtacctaagtattacgtactgtaaacccttggaccttatacccgtaatcccttaaccctttacccgggaccgttaccgggtaaccgaagggttaacccaggttaacgtaacctaactaaccgtaagtaaccttggacggtacccanaccgttanacccgtttgtacttacc

SEQ ID NO: 204654 - DNA, 818 bp, Homo sapiens
  misc_feature: GYAE6OF02HTORF.47.62.F07.1.454.CMB.1.raw
tcagagctcacgtacacgaccggtgctcgatttagtagtcgcataaagggaaagggggagtcagtcccaaccaggacacagcctggacatgagggtccctgctcagctcctggggctcctgctgctctggtcccaggtgccaggtgtgacatccagatcgacccagtcctccactcccttcccgttgtctgctatcgtaggtaggagacgaaggtacgtaccaaccatccgtaacgttcggcccgggtacgacggtaccggacgggtacggttacgactaaagtcggttcgtttccggtccgtttggttacgtacgacgacgtaccgaaccggaacggggaaccggtaccccggtaaacgccgtaccgtacggtacgtaccgttaacggtacgtacgtacctacttaaccgtaaacggtttaacgggaaaaccggtaaccgggttacccgtaacgtaaccggtaacggttacggtaacggttacgggtaaggttacggtacgtacggtaacgggtaacgtaacgtttaacttttaacgttaacctaacgtacctacgtaacgtccgtagtacccgtgtaccacgtacgtaacggtaataacgtagttacgtaactaacgttacgtttaaacgttacgttaccgtaaacgtaacgtaacttacgttaacctaattacccgtacccttaacccgttaccgttccggtaaccggtacggtaaccgtaagttaccggtacgttaacgtaaccgaacggttaacgttcggtaccgtacgtaccgtaacctaccgtcgttacctacgtttaccctcttaaccgg

SEQ ID NO: 204655 - DNA, 134 bp, Homo sapiens
  misc_feature: GYAE6OF01B9SE3.45.57.F02.1.454.CMB.1.raw
  modified_base (133)..(134): a, c, t, g, unknown or other
  misc_feature (133)..(134): n is a, c, g, or t
tcagacgcgatcgacacgaccggtgctcgatttagctcgatatagttggttggctctggcacagcggccctgggctgcctggtcaaggactacttcctcgatcgcgtctgagcgggctggcaaggcgcatagnn

SEQ ID NO: 204656 - DNA, 259 bp, Homo sapiens
  misc_feature: GYAE6OF01CRNXE.45.57.F02.1.454.CMB.1.raw
  modified_base (217)..(259): a, c, t, g, unknown or other
  misc_feature (217)..(259): n is a, c, g, or t
tcagacgcgatcgacacgaccggtgctcgatttagctcgatatagttgggtttggggaggtgtgtcacaagtatttcgggctcgtgggcaccggtacgggcacgggggaggtgtgtcacaagatttgggctctgggcacacgcggccctgggctagccctggtacaaggactacttcctcgatcgcgtctgacgcgggctggcaaggcgacatacgnnnnnnnnnnnnnnnnnnnnnnnnnnnnnnnnnnnnnnnnnnn

SEQ ID NO: 204657 - DNA, 137 bp, Homo sapiens
  misc_feature: GYAE6OF01EDJ9X.45.57.F02.1.454.CMB.1.raw
  modified_base (137)..(137): a, c, t, g, unknown or other
  misc_feature (137)..(137): n is a, c, g, or t
tcagacgcgatcgacacgaccggtgctcgatttagctcgatatagttgggtttgggctctgggcacagcggccctgggctgcctggtcaaggactacttcctcgatcgcgtctgagcgggctggcaaggcgcatagn

SEQ ID NO: 204658 - DNA, 170 bp, Homo sapiens
  misc_feature: GYAE6OF01ELOMS.45.57.F02.1.454.CMB.1.raw
  modified_base (168)..(170): a, c, t, g, unknown or other
  misc_feature (168)..(170): n is a, c, g, or t
tcagacgcgatcgacacgaccggtgctcgatttagctcgatatagttgggtttggggaggtgtgtcacaagatttgggctctgggcaccgtaggcacagcggccctgggctgcctggtcaaggactacttcctcgatcgcgtctgagcgggctggcaaggcgcatagnnn

SEQ ID NO: 204659 - DNA, 205 bp, Homo sapiens
  misc_feature: GYAE6OF01E24PP.45.57.F02.1.454.CMB.1.raw
  modified_base (203)..(205): a, c, t, g, unknown or other
  misc_feature (203)..(205): n is a, c, g, or t
tcagacgcgatcgacacgaccggtgctcgatttagctcgatatagttgggtttggggaggtgtgtcacaagatttgggctctgggcaccgtgggcacggggaggtgtgtcacaagatttgggctctgggcacagcggccctgggctgcctggtcaaggactacttcctcgatcgcgtctgagcgggctggcaaggcgcatagnnn

SEQ ID NO: 204660 - DNA, 168 bp, Homo sapiens
  misc_feature: GYAE6OF01EVXPJ.45.57.F02.1.454.CMB.1.raw
  modified_base (168)..(168): a, c, t, g, unknown or other
  misc_feature (168)..(168): n is a, c, g, or t
tcagacgcgatcgacacgaccggtgctcgatttagctcgatatagttgggtttggggaggtgtgtcacaagatttgggctctgggcaccgtgggcacagcggccctgggctgcctggtcaaggactacttcctcgatcgcgtctgagcgggctggcaaggcgcatagn

SEQ ID NO: 204661 - DNA, 182 bp, Homo sapiens
  misc_feature: GYAE6OF01B91B3.45.57.F02.1.454.CMB.1.raw
  modified_base (160)..(182): a, c, t, g, unknown or other
  misc_feature (160)..(182): n is a, c, g, or t
tcagacgcgatcgacacgaccggtgctcgatttagctcgatatagttgggtttgggggaggtgtgtcacaagatttgggctctgggcacagcggccctgggctgcctggtcaaggactacttcctcgatcgcgtctgagcgggctggcaaggcgcatagnnnnnnnnnnnnnnnnnnnnnnn

SEQ ID NO: 204662 - DNA, 162 bp, Homo sapiens
  misc_feature: GYAE6OF01DLNNU.45.57.F02.1.454.CMB.1.raw
  modified_base (160)..(162): a, c, t, g, unknown or other
  misc_feature (160)..(162): n is a, c, g, or t
tcagacgcgatcgacacgaccggtgctcgatttagctcgatatagttgggtttgggctgaccaaggtcaccgtccttggtcagcccaaggccaaccccactgtcactctgttcccgccctcctctcgatcgcgtctgagcgggctggcaaggcgcatagnnn

SEQ ID NO: 204663 - DNA, 136 bp, Homo sapiens
  misc_feature: GYAE6OF01CBJN6.45.57.F02.1.454.CMB.1.raw
tcagacgcgatcgacacgaccggtgctcgatttagctcgatatagttgggtttgggctctgggcacagcggccctgggctgcctggtcaaggactacttcctcgatcgcgtctgagcgggctggcaaggcgcatag

SEQ ID NO: 204664 - DNA, 161 bp, Homo sapiens
  misc_feature: GYAE6OF01ARGT8.45.57.F02.1.454.CMB.1.raw
  modified_base (161)..(161): a, c, t, g, unknown or other
  misc_feature (161)..(161): n is a, c, g, or t
tcagacgcgatcgacacgaccggtgctcgatttagctcgatatagttgggtttggggaggtgtgtcacaagatttgggctctgggggcacagcggccctgggctgcctggtcaaggactacttcctcgatcgcgtctgagcgggctggcaaggcgcatagn

SEQ ID NO: 204665 - DNA, 137 bp, Homo sapiens; identical to SEQ ID NO: 204657
  misc_feature: GYAE6OF01AEKNF.45.57.F02.1.454.CMB.1.raw
  modified_base (137)..(137): a, c, t, g, unknown or other
  misc_feature (137)..(137): n is a, c, g, or t

SEQ ID NO: 204666 - DNA, 495 bp, Homo sapiens
  misc_feature: GYAE6OF01AGGZ1.45.57.F02.1.454.CMB.1.raw
  modified_base (331)..(331): a, c, t, g, unknown or other
  misc_feature (331)..(331): n is a, c, g, or t
  modified_base (481)..(481): a, c, t, g, unknown or other
  misc_feature (481)..(481): n is a, c, g, or t
  modified_base (483)..(483): a, c, t, g, unknown or other
  misc_feature (483)..(483): n is a, c, g, or t
  modified_base (487)..(495): a, c, t, g, unknown or other
  misc_feature (487)..(495): n is a, c, g, or t
tcagacgcgatcgacacgaccggtgctcgatttagctcgatatagttgggtttgggatcccggagggccggtcgtttttaccaaacatgacaagtagaggggcctgtcccggcttctgttggtaccagtttgcatagtgccctctgaggctgtctccgtggcatgtgatcttgactgtctgtcccaaggccacagacacagcagactcctgagtcagcccagaagaaagtacagaccctatgcaaagagtgaggagagtgagccagagaggggtccaggccatggtggagacaccccagaactctgcttctgagcccactcaggcggaagntgaggctgactattatgcagcatccgggacaccaataatggttatgtttcgcgcccgggacaggtcaccgtcttggtcagcccaaggccaaccccactcgtcactctcgtcccgccctcctctcgatcgcgtctgagcggctggcaggcncntagnnnnnnnnn

SEQ ID NO: 204667 - DNA, 159 bp, Homo sapiens
  misc_feature: GYAE6OF01A1GPT.45.57.F02.1.454.CMB.1.raw
  modified_base (159)..(159): a, c, t, g, unknown or other
  misc_feature (159)..(159): n is a, c, g, or t
tcagacgcgatcgacacgaccggtgctcgatttagctcgatatagttgggtttggggaggtgtgtcacaagatttgggctctgggcacagcggccctgggctgcctggtcaaggactacttcctcgatcgcgtctgagcgggctggcaaggcgcatagn

SEQ ID NO: 204668 - DNA, 198 bp, Homo sapiens
  misc_feature: GYAE6OF01BNOPX.45.57.F02.1.454.CMB.1.raw
  modified_base (170)..(198): a, c, t, g, unknown or other
  misc_feature (170)..(198): n is a, c, g, or t
tcagacgcgatcgacacgaccggtgctcgatttagctcgatatagttgggtttgggggaggtgtgtcacaagatttgggctctgggcaccgtgggcacagcggccctgggcctgcctggtcaaggctacttcctcgatcgcgtctgagcgggctggccaaggcgcatagnnnnnnnnnnnnnnnnnnnnnnnnnnnnn

SEQ ID NO: 204669 - DNA, 168 bp, Homo sapiens; identical to SEQ ID NO: 204660
  misc_feature: GYAE6OF01E29H8.45.57.F02.1.454.CMB.1.raw
  modified_base (168)..(168): a, c, t, g, unknown or other
  misc_feature (168)..(168): n is a, c, g, or t

SEQ ID NO: 204670 - DNA, 180 bp, Homo sapiens
  misc_feature: GYAE6OF01DJNRJ.45.57.F02.1.454.CMB.1.raw
  modified_base (154)..(154): a, c, t, g, unknown or other
  misc_feature (154)..(154): n is a, c, g, or t
  modified_base (160)..(180): a, c, t, g, unknown or other
  misc_feature (160)..(180): n is a, c, g, or t
tcagacgcgatcgacacgaccggtgctcgatttagctcgatatagttgggtttggggaggtgtgtcacaagatttgggctctgggggcacagcggccctgggctgcctggtcaaggctacttcctcgatcgcgtctgagcgggctggcaaggcncatagnnnnnnnnnnnnnnnnnnnnn

SEQ ID NO: 204671 - DNA, 167 bp, Homo sapiens
  misc_feature: GYAE6OF01CCSQJ.45.57.F02.1.454.CMB.1.raw
  modified_base (160)..(167): a, c, t, g, unknown or other
  misc_feature (160)..(167): n is a, c, g, or t
tcagacgcgatcgacacgaccggtgctcgatttagctcgatatagttgggtttggggaggtgtgtcacaagatttgggctctggggcacagcggccctgggctgcctggtcaaggactacttcctcgatcgcgtctgagcgggctggcaaggcgcatagnnnnnnnn

SEQ ID NO: 204672 - DNA, 153 bp, Homo sapiens
  misc_feature: GYAE6OF01DL8IM.45.57.F02.1.454.CMB.1.raw
  modified_base (139)..(153): a, c, t, g, unknown or other
  misc_feature (139)..(153): n is a, c, g, or t
tcagacgcgatcgacacgaccggtgctcgatttagctcgatatagttgggtttgggctacgtgggcacagcggccctgggctgcctggtcaaggactacttcctcgatcgcgtctgagcgggctggcaaggcgcatagnnnnnnnnnnnnnnn

SEQ ID NO: 204673 - DNA, 169 bp, Homo sapiens
  misc_feature: GYAE6OF01AVS88.45.57.F02.1.454.CMB.1.raw
  modified_base (157)..(169): a, c, t, g, unknown or other
  misc_feature (157)..(169): n is a, c, g, or t
tcagacgcgatcgacacgaccggtgctcgatttagctcgatatagttgggtttggggaggtgtgtcacaagattgggctctgggcacagcggcctgggctgcctggtcaaggactacttcctcgatcgcgtctgagcgggctggcaaggcgcatagnnnnnnnnnnnnn

SEQ ID NO: 204674 - DNA, 211 bp, Homo sapiens
  misc_feature: GYAE6OF01DCDFK.45.57.F02.1.454.CMB.1.raw
  modified_base (161)..(211): a, c, t, g, unknown or other
  misc_feature (161)..(211): n is a, c, g, or t
tcagacgcgatcgacacgaccggtgctcgatttagctcgatatagttgggtttggggaggtgtgtcacaagatttgggctctgggggcacagcggccctgggctgcctggtcaaggatacttcctcgatcgcgtctgagcgggctggcaaggcgcatagtnnnnnnnnnnnnnnnnnnnnnnnnnnnnnnnnnnnnnnnnnnnnnnnnnnn

SEQ ID NO: 204675 - DNA, 138 bp, Homo sapiens
  misc_feature: GYAE6OF01C8ZS4.45.57.F02.1.454.CMB.1.raw
  modified_base (137)..(138): a, c, t, g, unknown or other
  misc_feature (137)..(138): n is a, c, g, or t
tcagacgcgatcgacacgaccggtgctcgatttagctcgatatagttgggtttgggctctgggcacagcggccctgggctgcctggtcaaggactacttcctcgatcgcgtctgagcgggctggcaaggcgcatagnn

SEQ ID NO: 204676 - DNA, 221 bp, Homo sapiens
  misc_feature: GYAE6OF01EWVMW.45.57.F02.1.454.CMB.1.raw
  modified_base (219)..(221): a, c, t, g, unknown or other
  misc_feature (219)..(221): n is a, c, g, or t
tcagacgcgatcgacacgaccggtgctcgatttagctcgatatagttgggtttgggggaagaggaagactgacggtcctcccaggagttcaggtgctgggcaccttgggcacgggggaggtgtgtcacaagatttgggctctgggcacagcggccctgggctgcctggtcaaggactacttcctcgatcgcgtctgagcgggctggcaaggcgcatagnnn

SEQ ID NO: 204677 - DNA, 177 bp, Homo sapiens
  misc_feature: GYAE6OF01AVB65.45.57.F02.1.454.CMB.1.raw
  modified_base (168)..(177): a, c, t, g, unknown or other
  misc_feature (168)..(177): n is a, c, g, or t
tcagacgcgatcgacacgaccggtgctcgatttagctcgatatagttgggtttgggggaggtgtgtcacaagatttgggctctgggcaccgtgggcacagcggccctgggctgcctggtcaaggctacttcctcgatcgcgtctgagcgggctggcaaggcgcatagnnnnnnnnnn

SEQ ID NO: 204678 - DNA, 138 bp, Homo sapiens
  misc_feature: GYAE6OF01CXLGO.45.57.F02.1.454.CMB.1.raw
  modified_base (136)..(138): a, c, t, g, unknown or other
  misc_feature (136)..(138): n is a, c, g, or t
tcagacgcgatcgacacgaccggtgctcgatttagctcgatatagttgggtttgggctctggcacagcggccctgggctgcctggtcaaggactacttcctcgatcgcgtctgagcgggctggcaaggcgcatagnnn

SEQ ID NO: 204679 - DNA, 157 bp, Homo sapiens
  misc_feature: GYAE6OF01ABVVP.45.57.F02.1.454.CMB.1.raw
  modified_base (137)..(157): a, c, t, g, unknown or other
  misc_feature (137)..(157): n is a, c, g, or t
tcagacgcgatcgacacgaccggtgctcgatttagctcgatatagttggatttgggctctgggcacagcggccctgggctgcctggtcaaggactacttcctcgatcgcgtctgagcgggctggcaaggcgcatagnnnnnnnnnnnnnnnnnnnnn

SEQ ID NO: 204680 - DNA, 171 bp, Homo sapiens
  misc_feature: GYAE6OF01CN6WK.45.57.F02.1.454.CMB.1.raw
  modified_base (161)..(171): a, c, t, g, unknown or other
  misc_feature (161)..(171): n is a, c, g, or t
tcagacgcgatcgacacgaccggtgctcgatttagctcgatatagttgggtttgggggaggtgtgtcacaagatttgggctctgggcacagcggccctgggctgccctggtcaaggactacttcctcgatcgcgtctgagcgggctggcaaggcgcatagnnnnnnnnnnn

SEQ ID NO: 204681 - DNA, 729 bp, Homo sapiens
  misc_feature: GYAE6OF01A471J.45.57.F02.1.454.CMB.1.raw
  modified_base (231)..(231): a, c, t, g, unknown or other
  misc_feature (231)..(231): n is a, c, g, or t
tcagacgcgatcgacacgaccggtgctcgatttagctcgatatagttgggtttgggggctttctgagagtcacggacctcctgtgcaggaacatgaagcacctgtggttcctcctcctgctggtggcggctcccggatgcgtcctgtcccagctgcacctgcaggagtcgggcccaggactgggtgaagccttcgggagaccctgtccctcacttgcagtgtctcgtggtnactccatcagtagtagtcaattaagttttggggctgggtccgccacgccccgaggggaaggggcgtgggaggtggagttgggactgtctactcgtaggtcgggaccacctattacgacgtccccgtcctacaacgactcgacgtggtcactctactaaactaaacaccgtaccaaacgaacctaattcctacccgtagacgtcctagtaaccttcgtacggtacggaaaccgccggacggaaccgaccggaacctaaagttacgttaccgtaggtacgaacgtaaggaacgggtacgggtaccgttaagggtaactttacgttacccgttttacggaacccgttacgggtccgggggtacccgtaccggggtaaccccgttcgggtaccccgtacccgttcccgttacccgtaccggtaccgtcccccgtacccgaacccggtaacccgggacccctaaccggtttcccccggttccccgttccccccggtacccggg

SEQ ID NO: 204682 - DNA, 866 bp, Homo sapiens
  misc_feature: GYAE6OF01CW89S.45.57.F02.1.454.CMB.1.raw
tcagacgcgatcgacacgaccggtgctcgatttagctcgatatagttgggtttgggggctgtgggctcagaagcagagttctggggtgtctccaccatggcctggacccctctctggctcactctcctcactcttgcatagggtctgtactttcttctgggctgactcaggagtctgctgtgtctgtggcgttgggacagacagtcaagatcacatcgaccgacggagacacgcctacgaggagggactactatcgacaacgtacggtaaccaacacggaacggaccgggacacggccccctacgtacgttcgtactagttacggtttaaacggtaaaaacccggacccggtcccgtaccgggtacctcccgaacggtacccgtagtttaccgtcgtacgtcctacccacccgtaacgaaacggaaacctacgtacggtacccttttaccgtaccgaacctaacgtaccgtaacgttacgggacctaccgggaacgggtaccggaaagtaacggtcgggaacggtccgttaacgtaaccgtttaacgtttacgttaccggtacgaacggtactaaacccgggttacccgggaaaccctaaaccgtaaaggtttaaacggttaacgggtttaacttttacggggttttacccggaacccggggtacccccgggtaaaccgggtaacggttacccccggttaccggtttaccccggttacggtaaccccgtaaccgggtaaccccccggtaaaccggtaaccccccaaaacccccggttaccgttacccggttaccccgttaaccccgttaccccggtttacccccctttaacccccccgaccccgttttcccccgttaacccccggg

SEQ ID NO: 204683 - DNA, 139 bp, Homo sapiens
  misc_feature: GYAE6OF01A6FSA.45.57.F02.1.454.CMB.1.raw
  modified_base (137)..(139): a, c, t, g, unknown or other
  misc_feature (137)..(139): n is a, c, g, or t
tcagacgcgatcgacacgaccggtgctcgatttagctcgatatagttgggtttgggctctgggcacagcggccctgggctgcctggtcaaggactacttcctcgatcgcgtctgagcgggctggcaaggcgcatagnnn

SEQ ID NO: 204684 - DNA, 216 bp, Homo sapiens
  misc_feature: GYAE6OF01BYMAF.45.57.F02.1.454.CMB.1.raw
  modified_base (166)..(216): a, c, t, g, unknown or other
  misc_feature (166)..(216): n is a, c, g, or t
tcagacgcgatcgacacgaccggtgctcgatttagctcgatatagttgggtttgggggaggtgtgtcacaagatttgggctctgggcaccgtgggcacagcgccctgggctgcctggtcaaggctacttcctcgatcgctctgagcgggctggcaaggcgcatagnnnnnnnnnnnnnnnnnnnnnnnnnnnnnnnnnnnnnnnnnnnnnnnnnnn

SEQ ID NO: 204685 - DNA, 203 bp, Homo sapiens
  misc_feature: GYAE6OF01DYZ7Z.45.57.F02.1.454.CMB.1.raw
  modified_base (165)..(166): a, c, t, g, unknown or other
  misc_feature (165)..(166): n is a, c, g, or t
  modified_base (170)..(203): a, c, t, g, unknown or other
  misc_feature (170)..(203): n is a, c, g, or t
tcagacgcgatcgacacgaccggtgctcgatttagctcgatatagttgggtttgggggaggtgtgtcacaagatttgggctctgggcaccgtgggcacagcggaccctagggctgcctggtcaaggcttacttcctcgatcgcgtctgagcggctggcaaggcgnntagnnnnnnnnnnnnnnnnnnnnnnnnnnnnnnnnnn

SEQ ID NO: 204686 - DNA, 579 bp, Homo sapiens
  misc_feature: GYAE6OF01AU2R2.45.57.F02.1.454.CMB.1.raw
  modified_base (61)..(61): a, c, t, g, unknown or other
  misc_feature (61)..(61): n is a, c, g, or t
  modified_base (131)..(131): a, c, t, g, unknown or other
  misc_feature (131)..(131): n is a, c, g, or t
  modified_base (179)..(179): a, c, t, g, unknown or other
  misc_feature (179)..(179): n is a, c, g, or t
  modified_base (188)..(188): a, c, t, g, unknown or other
  misc_feature (188)..(188): n is a, c, g, or t
  modified_base (213)..(215): a, c, t, g, unknown or other
  misc_feature (213)..(215): n is a, c, g, or t
  modified_base (222)..(222): a, c, t, g, unknown or other
  misc_feature (222)..(222): n is a, c, g, or t
  modified_base (236)..(236): a, c, t, g, unknown or other
  misc_feature (236)..(236): n is a, c, g, or t
  modified_base (241)..(241): a, c, t, g, unknown or other
  misc_feature (241)..(241): n is a, c, g, or t
  modified_base (263)..(263): a, c, t, g, unknown or other
  misc_feature (263)..(263): n is a, c, g, or t
  modified_base (267)..(267): a, c, t, g, unknown or other
  misc_feature (267)..(267): n is a, c, g, or t
  modified_base (277)..(277): a, c, t, g, unknown or other
  misc_feature (277)..(277): n is a, c, g, or t
  modified_base (293)..(293): a, c, t, g, unknown or other
  misc_feature (293)..(293): n is a, c, g, or t
  modified_base (337)..(337): a, c, t, g, unknown or other
  misc_feature (337)..(337): n is a, c, g, or t
  modified_base (343)..(343): a, c, t, g, unknown or other
  misc_feature (343)..(343): n is a, c, g, or t
  modified_base (353)..(353): a, c, t, g, unknown or other
  misc_feature (353)..(353): n is a, c, g, or t
  modified_base (365)..(365): a, c, t, g, unknown or other
  misc_feature (365)..(365): n is a, c, g, or t
  modified_base (372)..(372): a, c, t, g, unknown or other
  misc_feature (372)..(372): n is a, c, g, or t
  modified_base (395)..(395): a, c, t, g, unknown or other
  misc_feature (395)..(395): n is a, c, g, or t
  modified_base (453)..(453): a, c, t, g, unknown or other
  misc_feature (453)..(453): n is a, c, g, or t
tcagacgcgatcgacacgaccggtgctcgatttagctcgatataggttgggttgggggaanaggaagactgacggtcctcccaggagttcaggtgctgggcaccgttgggcacggggagtgtgtcacaagntttgggctcgtgggcacagtcgcctggctgcctggtcaaggctactcngatcgcgtngagcgggctggcaaggcgcagtcgnnngtgctangcgtcagtcgcgangtgancgaacgtgtaccgcgtcgaagnacgngacgtgcgancgtagcgttaacgacngttacgacctggccgaacggtgaaccttcacggttctacggacncggttnaacggtaccnggttcgaaactntaccggntaagggccttagcgtaactaggntccgtagtacgtacgtagcggtccttaacggtcgtctaacgtacgggttacgacggtntacgtacgtctcgtacgtacgtacgtacgtacgtacgtacgtcgtacgtacgacgcgtacgtcgtcgtacgacgtacgcgtagtagtacgtacgtacgtacgtacgacgtacgtacgtcgtacgtc

SEQ ID NO: 204687 - DNA, 215 bp, Homo sapiens
  misc_feature: GYAE6OF02HM03Q.45.57.F02.1.454.CMB.1.raw
  modified_base (214)..(215): a, c, t, g, unknown or other
  misc_feature (214)..(215): n is a, c, g, or t
tcagacgcgatcgacacgaccggtgctcgatttagctcgatatagttggtttgggaagaggaagactgacggtcctcccaggagttcaggtgctgggcaccttgggcacgggaggtgtgtcacaagatttgggctctgggcacagcggccctgggctgcctggtcaaggactacttcctcgatcgcgtctgagcgggctggcaaggcgcatagnn

SEQ ID NO: 204688 - DNA, 156 bp, Homo sapiens
  misc_feature: GYAE6OF02GCQPR.45.57.F02.1.454.CMB.1.raw
  modified_base (156)..(156): a, c, t, g, unknown or other
  misc_feature (156)..(156): n is a, c, g, or t
tcagacgcgatcgacacgaccggtgctcgatttagctcgatatagttggttgggaggtgtgtcacaagattgggctctggggcacagcggccctgggctgcctggtcaaggactacttcctcgatcgcgtctgagcgggctggcaaggcgcatagn

SEQ ID NO: 204689 - DNA, 183 bp, Homo sapiens
  misc_feature: GYAE6OF02H1FSZ.45.57.F02.1.454.CMB.1.raw
  modified_base (163)..(183): a, c, t, g, unknown or other
  misc_feature (163)..(183): n is a, c, g, or t
tcagacgcgatcgacacgaccggtgctcgatttagctcgatatagttgggtttggggaggtgtgtcactaagatttgggctctagggcacagcggccctgggctgcctggtcaaggacgtacttcctcgatcgcgtctggagcgggctggcaaggcgcatagnnnnnnnnnnnnnnnnnnnnn

SEQ ID NO: 204690 - DNA, 137 bp, Homo sapiens; identical to SEQ ID NO: 204657
  misc_feature: GYAE6OF02F5KG4.45.57.F02.1.454.CMB.1.raw
  modified_base (137)..(137): a, c, t, g, unknown or other
  misc_feature (137)..(137): n is a, c, g, or t

SEQ ID NO: 204691 - DNA, 138 bp, Homo sapiens; identical to SEQ ID NO: 204675
  misc_feature: GYAE6OF02IWBRG.45.57.F02.1.454.CMB.1.raw
  modified_base (137)..(138): a, c, t, g, unknown or other
  misc_feature (137)..(138): n is a, c, g, or t

SEQ ID NO: 204692 - DNA, 491 bp, Homo sapiens
  misc_feature: GYAE6OF02IPWNI.45.57.F02.1.454.CMB.1.raw
  modified_base (485)..(491): a, c, t, g, unknown or other
  misc_feature (485)..(491): n is a, c, g, or t
tcagacgcgatcgacacgaccggtgctcgatttagctcgatatagttgggtttgggatcccggagggccggtcgtttttaccaaacatgacaagtagaggggcctgtcccggcttctgttggtaccagtttgcatagtgccctctgaggctgtctccgtggcatgtgatcttgactgtctgtcccaaggccacagacacagcagactcctgagtcagcccagaagaaagtacagaccctatgcaaaagagtgaggagagtgagccagagaggggtccaggccatggtggagacaccccagaactctgcttctgagcccactcaggcgaagatgagctgactattattgcagcatccgggacaccaataatggttatgtttcgcgcccggacaaggtcacgtctggtcagcccaaggccaacccactgtcactctgttcccgccctcctctcgactcgcgtctgagcggctggcgaaggcgcatgnnnnnnn

SEQ ID NO: 204693 - DNA, 214 bp, Homo sapiens
  misc_feature: GYAE6OF02HIOXQ.45.57.F02.1.454.CMB.1.raw
  modified_base (172)..(176): a, c, t, g, unknown or other
  misc_feature (172)..(176): n is a, c, g, or t
  modified_base (178)..(214): a, c, t, g, unknown or other
  misc_feature (178)..(214): n is a, c, g, or t
tcagacgcgatcgacacgaccggtgctcgatttagctcgatatagttggggtttgggggaggtgtggtccacaagatttgggctctgggcaccgtgggcacagcggccctgggcctgcctggtcaaggctacttcctcgatcgcgtctgagcgggctggcaaggcgcatagnnnnncnnnnnnnnnnnnnnnnnnnnnnnnnnnnnnnnnnnnn

SEQ ID NO: 204694 - DNA, 161 bp, Homo sapiens
  misc_feature: GYAE6OF02F5UBM.45.57.F02.1.454.CMB.1.raw
  modified_base (160)..(161): a, c, t, g, unknown or other
  misc_feature (160)..(161): n is a, c, g, or t
tcagacgcgatcgacacgaccggtgctcgatttagctcgatatagttgggtttgggggaggtgtgtcacaagatttgggctctgggcacagcggccctgggctgcctggtcaaggactacttcctcgatcgcgtctgagcgggctggcaaggcgcatagnn

SEQ ID NO: 204695 - DNA, 162 bp, Homo sapiens
  misc_feature: GYAE6OF02HX5T1.45.57.F02.1.454.CMB.1.raw
  modified_base (160)..(162): a, c, t, g, unknown or other
  misc_feature (160)..(162): n is a, c, g, or t
tcagacgcgatcgacacgaccggtgctcgatttagctcgatatagttgggtttgggggaggtgtgtcacaagatttgggctctgggcacagcggccctgggctgcctggtcaaggactacttcctcgatcgcgtctgagcgggctggcaaggcgcatagnnn

SEQ ID NO: 204696 - DNA, 185 bp, Homo sapiens
  misc_feature: GYAE6OF02I06ER.45.57.F02.1.454.CMB.1.raw
  modified_base (167)..(185): a, c, t, g, unknown or other
  misc_feature (167)..(185): n is a, c, g, or t
tcagacgcgatcgacacgaccggtgctcgatttagctcgatatagttgggtttgggggaggtgtgtcacaagatttgggctctgggcaccgtggcacagcggccctgggctgcctggtcaaggctacttcctcgatcgcgtctgagcgggctggcaaggcgcatagnnnnnnnnnnnnnnnnnnn

SEQ ID NO: 204697 - DNA, 160 bp, Homo sapiens
  misc_feature: GYAE6OF02FO5RI.45.57.F02.1.454.CMB.1.raw
tcagacgcgatcgacacgaccggtgctcgatttagctcgatatagttgggtttgggctgaccaaggacggtgaccttggtcagcccaaggccaaccccactgtcactctgttcccacccctcctctcgatcgcgtctgagcgggctggcaaggcgcatag

SEQ ID NO: 204698 - DNA, 226 bp, Homo sapiens
  misc_feature: GYAE6OF02HLXYX.45.57.F02.1.454.CMB.1.raw
  modified_base (219)..(226): a, c, t, g, unknown or other
  misc_feature (219)..(226): n is a, c, g, or t
tcagacgcgatcgacacgaccggtgctcgatttagctcgatatagttgggtttgggggaagaggaagactgacggtcctcccaggagttcaggtgctgggcaccttgggcacgggggaggtgtgtcacaagatttgggctctgggcacagcggccctgggctgcctggtcaaggactacttcctcgatcgcgtctgagcgggctggcaaggcgcatagnnnnnnnn

SEQ ID NO: 204699 - DNA, 667 bp, Homo sapiens
  misc_feature: GYAE6OF02I49KA.45.57.F02.1.454.CMB.1.raw
  modified_base (229)..(229): a, c, t, g, unknown or other
  misc_feature (229)..(229): n is a, c, g, or t
tcagacgcgatcgacacgaccggtgctcgatttagctcgatatagttgggtttgggggctgtgggctcagaagcagagttctgggggtgtctccaccatggcctggacccctctctggctcactctcctcactctttgcatagggtctgtactttcttctgggctgactcaggagtctgctgtgtctgtggccttgggacagacagtcaagatcacatcgccacggganacagcctcgaaggagggcactatgacaaactcggtaaccaacgagaacgaccggacacggccctctacgtcgtcagttggttaacggaaaaccggaccggcccgtacgggactacccgacgaccgtacttctcgtcggcctaccacctacgaacggaacacgacgtcttaccgtacgaccataccacgtcggactacggaacgggacgaaagacgtaggacggtactagacttagttagtcgacagtacgtacggtaccggaacctaactaaagttaggttacggtttagtttccgggttttaccgccggttacccggttacggaacccgtaacgggttcctacccggtttaccgtcggtaccgaaccgcccgaaccggtaccccaacccgttactccgtacctaccgtacccgttcccgttacccctacccgttccg

SEQ ID NO: 204700 - DNA, 861 bp, Homo sapiens
  misc_feature: GYAE6OF02F14IP.45.57.F02.1.454.CMB.1.raw
tcagacgcgatcgacacgaccggtgctcgatttagctcgatatagttgggtttgggggctgtgggctcagaagcagagttctggggtgtctccaccatggcctggacccctctctggctcactctcctcactctttgcatagggtctgtactttcttctgggctgactcaggagtctgctgtgtctggtggccttgggacagacagtcaaagatcacatcgaccacggagacacgcctcgagacgggcactatgactaaacgtggtaaccaacgagaacggccgggaacaccggtacccctacttacgttggtcctagttacggttttaacgggaaaaaccggtcccggtaccccgttacccgggggaccttaccccgaaggtacccggtactttcctaccgtcggtccctacccacccttcgaaacggaaacctacgaacggtcctttaccgttaccgaccctaacgttaccgaccgttacgggtacccttacggaaccgggaaccgggaaagtaacggtcgggaacgggtaccttacggtaaactttacgtttaagtttccggacgtaacgggttaccgtaaccgtacccgggggtaaacccttaaaccgtaaaacggtttaaggttacggggttttaaactttccgggttttaaccgggtacccgggtaacccccgggggtaaaccgttaaacccgggttcccgtaccccgtttacggtttcccgggtaaccgtacccggtaaccccccggtacggtaaaccccccgtaacccccgttaacggtttaccggttaacccgttacccgtttacccgttccccggtttaccccccttaaccccgttcccgtttacccccgg

SEQ ID NO: 204701 - DNA, 216 bp, Homo sapiens
  misc_feature: GYAE6OF02HOPQL.45.57.F02.1.454.CMB.1.raw
  modified_base (206)..(216): a, c, t, g, unknown or other
  misc_feature (206)..(216): n is a, c, g, or t
tcagacgcgatcgacacgaccggtgctcgatttagctcgatatagttgggtttgggggaggtgtgtcacaagatttgggctctgggcaccgtgggcatgggggaggtgtgtcacaagatttgggctctgggcacagcggccctgggctgcctggtcaaggactacttcctcgatcgcgtctgagcgggctggacaaggcgcatagnnnnnnnnnnn

SEQ ID NO: 204702 - DNA, 140 bp, Homo sapiens
  misc_feature: GYAE6OF02GNCMB.45.57.F02.1.454.CMB.1.raw
  modified_base (137)..(140): a, c, t, g, unknown or other
  misc_feature (137)..(140): n is a, c, g, or t
tcagacgcgatcgacacgaccggtgctcgatttagctcgatatagttggatttgggctctgggcacagcggccctgggctgcctggtcaaggactacttcctcgatcgcgtctgagcgggctggcaaggcgcatagnnnn

SEQ ID NO: 204703 - DNA, 773 bp, Homo sapiens
  misc_feature: GYAE6OF02FIFGD.45.57.F02.1.454.CMB.1.raw
  modified_base (252)..(252): a, c, t, g, unknown or other
  misc_feature (252)..(252): n is a, c, g, or t
tcagacgcgatcgacacgaccggtgctcgatttagctcgatatagttgggtttgggggctgtgggctcagaagcagagttctggggtgtctccaccatggcctggacccctctctggctcactctcctcactctttgcatagggtctgtacttttcttctgggctgactcaggagtctgctgtgtctgtggccttgggacagacagtacaagatcacatcgccacggagacacgcctacaggagggcactangacaaactgtaacaacagaaggccggacacggcccctctacttgtcatagtttacggtaaaaccgaccggtcccgtaccgggactcccgacgaaccgtacttaccgtctcggcctacccaccctcgaacggaaccaccgacgtccttaccttacgaccctactaccgacgtacgggacctacgtacgggacggaaggtacgtacggaggtctacggtaacttaagttagttacgccgtaacgtaccgtaacgtaccggggtaacctaacccgtaaagttaacgttagggtttacgtttacggtttttaccgggacccgggtaccccgggtaacccgtaaaccgggttacccgttaccccgttacccggttttacgggtacccggtacccgggtaaccccggaacccgggtaaccccccgtaaaccccccgtaaccgtttaccccgttaacccgttaaccccgtttcccggtttacccgggtttaccccccccggtccccgtttaccccgtttacccccggg

SEQ ID NO: 204704 - DNA, 544 bp, Homo sapiens
  misc_feature: GYAE6OF02G2OI0.45.57.F02.1.454.CMB.1.raw
  modified_base (252)..(252): a, c, t, g, unknown or other
  misc_feature (252)..(252): n is a, c, g, or t
  modified_base (393)..(393): a, c, t, g, unknown or other
  misc_feature (393)..(393): n is a, c, g, or t
  modified_base (544)..(544): a, c, t, g, unknown or other
  misc_feature (544)..(544): n is a, c, g, or t
tcagacgcgatcgacacgaccggtgctcgatttagctcgatatagttgggtttgggatcccggagggccggtcgtttttaccaaacatgacaagtagaggggcctgtcccggcttctgttggtaccagtttgcatagtgccctctgaggctgtctccgtggcatgtgatcttgactgtctgtcccaaggccacagacacagcagactcctgagtcagcccagaagaaagtacagaccctaatcgacaaaagngtgaggagagtgagccagagagggtccaggccatggtggagacacccagaactctgcttctgacgcccactcaggcgaagatgagctgacgtattatgcagcagtccggacacaatatcggttatgtttcgcgcccggaanacgggtaccaccgttctacggtcacgacccaaggccaacccgtatcgtcactctacgtccccacctcctacgtcgtactcgtctcgagtacgccgggtctacgggtaccaaacgggtccgagtaacgtacgtcaagcgtatacactgacgn

SEQ ID NO: 204705 - DNA, 166 bp, Homo sapiens
  misc_feature: GYAE6OF02FJKGA.45.57.F02.1.454.CMB.1.raw
  modified_base (162)..(166): a, c, t, g, unknown or other
  misc_feature (162)..(166): n is a, c, g, or t
tcagacgcgatcgacacgaccggtgctcgatttagctcgatatagttgggtttgggggaggtgtgtcacaagatttgggctctgggggcacagcggccctgggctgcctggtcaaggactacttcctcgatcgcgtctgagcgggctggcaaggcgcatagnnnnn

SEQ ID NO: 204706 - DNA, 165 bp, Homo sapiens
  misc_feature: GYAE6OF02FYRD6.45.57.F02.1.454.CMB.1.raw
  modified_base (155)..(155): a, c, t, g, unknown or other
  misc_feature (155)..(155): n is a, c, g, or t
  modified_base (161)..(165): a, c, t, g, unknown or other
  misc_feature (161)..(165): n is a, c, g, or t
tcagacgcgatcgacacgaccggtgctcgatttagctcgatatagttgggtttgggctgaccaaggacggtgaccttggtcagcccaaggccaaccccactgtcactctgttcccacccctcctctcgatcgcgtctgagcgggctggcaaggcncatagnnnnn

SEQ ID NO: 204707 - DNA, 921 bp, Homo sapiens
  misc_feature: GYAE6OF02JBCWL.45.57.F02.1.454.CMB.1.raw
  modified_base (270)..(270): a, c, t, g, unknown or other
  misc_feature (270)..(270): n is a, c, g, or t
tcagacgcgatcgacacgaccggtgctcgatttagctcgatatagttgggtttgggggctgtgggctcagaagcagagttctgggggtgtctccaccatggcctggacccctctctggctcactctcctcactctttgcatagggtctgttacttttcttcgtgggctaggactacgaggtagtcgtgcttgttcgtcgttggtcggtccgtttaggggaccaagacgagttacgaaagtactcgaactagaccggacccgaacgggaanaacgaccggtaccctacgggaacgggtaccggacctaacgttataacggtaaccgtaaaaaccggttaccgggtaaaccccaaaacggtaacgggaaacccggggaccccgggtaaccggacccggtacccctttacgttacctttacggtaccgttaagtttacgggtttaaacggtaaaaacccgggtccccggtaacccgtacccgggaacctaacccggtaccggtaaccgtaccgttccgttcggtaccggtacctacccactaaaccggaacggtaaacctccgtaacgtttcccttaccgtaacgtaccctagttaacccgtacggtccggacccgtaggtaaccgggtaggaaagttcgggacggacggttcgtaacgttaacgttaatttccggtataaccgtacgtacccgtaaaccgggtaccctaaaccgaacggttaaatttaacgggtttacgttttaacgggtttcccggtttaaccgggacccggaaccgggtaacttacccggtacccgttacccgggtttcgtacgggtacccaacccgggaaacccttaaccccgggaaccccttacccgaacgtttacccgtaccctttaccgttaacccgtcccctacccccggttaccccgtccttcgg

SEQ ID NO: 204708 - DNA, 803 bp, Homo sapiens
  misc_feature: GYAE6OF02H0PX7.45.57.F02.1.454.CMB.1.raw
  modified_base (112)..(112): a, c, t, g, unknown or other
  misc_feature (112)..(112): n is a, c, g, or t
tcagacgcgatcgacacgaccggtgctcgatttagctcgatatagttgggtttgggggctgtgggctcagaagcagagttctggggtgtctccaccatggcctggacccctntctggctcactctcctcactcttgcatagggtctgtactttctctggctgactcaggagtctgctgtgtctggtcggtccgttgggacaggacagtacaaaggtactcgaactatcgaccgagggtacaccagccctagaggtacgggacctaacttaacgtcgtaacctaaaaccggttcgggtaaacccaaacgtaacggaacggtaccggggaaccgaccgggttacccccttacgttaaccgtttacggtaccgtaggtttaacggtttaaacgggtaaaaacccggtcccgggtaccccgtacgggtaacctaccccgaacggtaccgtacgttccgtcgtacggtccttacccgaaccgtacgaacggaaaccgtacgtaacgttcccgttaccggttagaacccgtacttaccgaacggttaccgggtaacctacgggagggaccggtaagacggtacggacggtacgtacggtactaagttagttacgacgtaggaccgtacggttaccggaaccaacgttaagtaaggttcgttaagttccggttaccgacccggtaccgggtaacgtaacggttcccgtaccgttaccgttcgggtaaccgaccggtaacccgtaacccgcccgtaaccgtacgtaccgtacgttccgttaccgttacccgtcccgtacccttcgtacccg

SEQ ID NO: 204709 - DNA, 753 bp, Homo sapiens
  misc_feature: GYAE6OF02IQB6Z.45.57.F02.1.454.CMB.1.raw
  modified_base (214)..(214): a, c, t, g, unknown or other
  misc_feature (214)..(214): n is a, c, g, or t
  modified_base (285)..(285): a, c, t, g, unknown or other
  misc_feature (285)..(285): n is a, c, g, or t
tcagacgcgatcgacacgaccggtgctcgatttagctcgatatagttgggtttgggaacctatgaacattctgtaggggccactgtcttctccacggtgctccttcatgcgtgacctggcagctgtagcttctgtactttcttctgggctgactcaggagtctgctgtgtctgtggccttgggacagacagtcaagatcaacatcgccacgganacagcctcgaagacgggcactatcgacaaactcggtaaccaaacgaagaacggccgggaacacggcccctntacgttgtacattacggtttagggtaaaaaccggtacccggcccgtaccgggactcccgacggtaccgtattcctacgtcggtacctcccaccgtacaacggtaaacaccgtacgtcctttaccgttacgaaccctacgttaccgaccgttacgggtaacctacggacgggtacggaaagtacgtaggacggtacgtacgttaacttaagtttagttcgacaacgtctaacgtaccgggacctaaacgtaaataacggttacgtttagttacggtttaccggacccgggtaacccgggtaaccgtaacggtccgttacccggtttaccgttacggtaccgtaaccgggacccgaaccggtaccccgtaaacccgtaccggtccgtaccctaacctttacccgtacccgtttaccccgttccccgttacccgttcctaacccggttacgtcccggttaccggtacccgg

SEQ ID NO: 204710 - DNA, 213 bp, Homo sapiens
  misc_feature: GYAE6OF02JJ4KC.45.57.F02.1.454.CMB.1.raw
  modified_base (167)..(168): a, c, t, g, unknown or other
  misc_feature (167)..(168): n is a, c, g, or t
  modified_base (170)..(213): a, c, t, g, unknown or other
  misc_feature (170)..(213): n is a, c, g, or t
tcagacgcgatcgacacgaccggtgctcgatttagctcgatatagttgggtttgggggaggtgtgtcacaagatttgggctctgggggcacaagcggccctgggctgcctggtcaaggacttacttcctccctcgcgttctgagcgggctcggacaggcgctatagnntnnnnnnnnnnnnnnnnnnnnnnnnnnnnnnnnnnnnnnnnnnnn

SEQ ID NO: 204711 - DNA, 167 bp, Homo sapiens
  misc_feature: GYAE6OF01C959V.5.15.B04.1.454.CMB.1.raw
  modified_base (130)..(167): a, c, t, g, unknown or other
  misc_feature (130)..(167): n is a, c, g, or t
tcagatcagacacgcacgaccggtgctcgatttagacagtatatatccggcgggtctggcaaggcgcatagctgcctggtcaaggactacttcccgtgtctgatctgagcgggctggcaaggcgcatagnnnnnnnnnnnnnnnnnnnnnnnnnnnnnnnnnnnnnn

SEQ ID NO: 204712 - DNA, 179 bp, Homo sapiens
  misc_feature: GYAE6OF01BK9PY.5.15.B04.1.454.CMB.1.raw
  modified_base (166)..(179): a, c, t, g, unknown or other
  misc_feature (166)..(179): n is a, c, g, or t
tcagatcagacacgcacgaccggtgctcgattagacagtatatatccgcgggcacgaccggtgctcgatttagacagtatatatccgcgggctggcaaggcgcatagctgcctggtcaaggactacttcccgtgtctgatctgagcgggctggcaaggcgcatagnnnnnnnnnnnnnn

SEQ ID NO: 204713 - DNA, 176 bp, Homo sapiens
  misc_feature: GYAE6OF01DABH8.5.15.B04.1.454.CMB.1.raw
  modified_base (166)..(176): a, c, t, g, unknown or other
  misc_feature (166)..(176): n is a, c, g, or t
tcagatcagacacgcacgaccggtgctcgattagacagtatatatccgcgggcacgaccggtgctcgatttagacagtatatatccgcgggctggcaaggcgcatagctgcctggtcaaggactacttcccgtgtctgatctgagcgggctggcaaggcgcatagnnnnnnnnnnn

SEQ ID NO: 204714 - DNA, 147 bp, Homo sapiens
  misc_feature: GYAE6OF02I9IKS.5.15.B04.1.454.CMB.1.raw
  modified_base (128)..(147): a, c, t, g, unknown or other
  misc_feature (128)..(147): n is a, c, g, or t
tcagatcagacacgcacgaccggtgctcgatttagacagtatatatccgcgggctggcaaggcgcatagctgcctggtcaaggactacttcccgtgtctgatctgagcgggctggcaaggcgcatagnnnnnnnnnnnnnnnnnnnn

SEQ ID NO: 204715 - DNA, 136 bp, Homo sapiens
  misc_feature: GYAE6OF02FFZQ4.5.15.B04.1.454.CMB.1.raw
  modified_base (128)..(136): a, c, t, g, unknown or other
  misc_feature (128)..(136): n is a, c, g, or t
tcagatcagacacgcacgaccggtgctcgatttagacagtatatatccgcgggctggcaaggcgcatagctgcctggtcaaggactacttcccgtgtctgatctgagcgggctggcaaggcgcatagnnnnnnnnn

SEQ ID NO: 204716 - DNA, 191 bp, Homo sapiens
  misc_feature: GYAE6OF02I5BR0.5.15.B04.1.454.CMB.1.raw
  modified_base (159)..(159): a, c, t, g, unknown or other
  misc_feature (159)..(159): n is a, c, g, or t
  modified_base (165)..(191): a, c, t, g, unknown or other
  misc_feature (165)..(191): n is a, c, g, or t
tcagatcagacacgcacgaccggtgctcgattagacagtatatatccgcgggcacgaccggtgctcgtatttagacagtatatatccgcgggctggcaaggcgcatagctgcctggtcaaggactacttccgtgtctgatctgagcgggctggcaggcncatagnnnnnnnnnnnnnnnnnnnnnnnnnnn

SEQ ID NO: 204717 - DNA, 553 bp, Homo sapiens
  misc_feature: GYAE6OF01COXZT.3.16.B05.1.454.CMB.1.raw
  modified_base (233)..(233): a, c, t, g, unknown or other
  misc_feature (233)..(233): n is a, c, g, or t
  modified_base (275)..(275): a, c, t, g, unknown or other
  misc_feature (275)..(275): n is a, c, g, or t
  modified_base (310)..(310): a, c, t, g, unknown or other
  misc_feature (310)..(310): n is a, c, g, or t
  modified_base (427)..(427): a, c, t, g, unknown or other
  misc_feature (427)..(427): n is a, c, g, or t
  modified_base (442)..(442): a, c, t, g, unknown or other
  misc_feature (442)..(442): n is a, c, g, or t
  modified_base (445)..(445): a, c, t, g, unknown or other
  misc_feature (445)..(445): n is a, c, g, or t
tcagagacgcactccacgaccggtgctcgatttagagctcacgtatttgggtttggggggtctcaggaggcagcgctctcgggacgtcctccaccatggcctggctctgctattcctcaccctcctcactcgagggcacgagggtcctgggcccagtctgccctgactcagcctgcctcgtgtctgggtctcctggacagtcgatcatcgccatcctcctgccactggaaccngtcagtgacgtttggtgttatacgtatgtctctgtatcaacngcaccaggacaaacgaccccaaatcataatttacngatgtacagtaactcgcctgtacgggttctaagtcgtcttcgtctaggttacaagtctggacaacgaccggtcctcctgaccgtatccgtcgtcgggcctcgaggctagacggacgngctgtattagtacgngcngctacatatacagcagcgagcgacgtgggttcacggtaacgtacgggaccaacgggttccaccggttccgacctacgtacgaccgaccaaccggccccaacccgtacg

SEQ ID NO: 204718 - DNA, 707 bp, Homo sapiens
  misc_feature: GYAE6OF01C99XT.3.16.B05.1.454.CMB.1.raw
  modified_base (254)..(254): a, c, t, g, unknown or other
  misc_feature (254)..(254): n is a, c, g, or t
tcagagacgcactccacgaccggtgctcgatttagagctcacgtagttgggtttgggggggtctcaggaggcagcgctctcgggacgtctccaccagtcggcctgggctctgcgtattccctcaccctctcactcgagggcacgagggtccctagggcccagtctgccctgactcgacgcctcgccctccgtgtcgtgggtcctccgtggacagtcgatcatccgcctatctccgtgaccgtacgtaggaaccngactaggtgtacgggtttgggttaggttaactacgttatcgtcgtacgtaggtaactacgaacgcgacaccgacggaccaaaccggtaccccctaaaactcgtaattaactttactagtaagttacgtacgtacgtaacgtccggtacctacggtagggttactaagtcgtacctttacgtcgttaacggtaactaacgtccgtacgactaaccgacgtccctacgtacgactactcgcgtcggtacctacgagtcgtacgtacggaacgacgtactcgtaattactacgtacgtacagtacctaatacgtactacggaacggacgtaacgcgtaaggaccgtacggttcgggtaccgtaaccgggaacgtaccgggtaacggtaccgccggtacccgtcccgtacccgtacgtaccgaccgaccccggaaccgtccccgtaaccccgtacgg

SEQ ID NO: 204719 - DNA, 664 bp, Homo sapiens
  misc_feature: GYAE6OF01C4Y3T.3.16.B05.1.454.CMB.1.raw
tcagagacgcactccacgaccggtgctcgatttagagctcacgtattgtgtttggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcatcgccatctcctgcactggaaccagcagtgacgttggtgttatactatgtctctggtatcaacagccaccaggacaaacgacccccaaactctaattaatttatgtatgtactaagtaacgtccggccctacgtagggtttactaacgtcgtcttctcgttggtaactagtctggactaacgaccggtccctacccgtacgtacctatcctacgtcgggtcctccgacggtcgtaggaacggacggacggtcgttagtaactttacgttaccgtggacctacggtacttacaacttaacgtaaccgaacgccgaacgaccgacgaccggtacggttcggggttacccgttacgggtaaccggtacggggaacccgtaacgggttccccgtaacccggttcccgtacccgtaccggttacccgaaccggtaccccgaaccggtaccccctaaacccccg

SEQ ID NO: 204720 - DNA, 880 bp, Homo sapiens
  misc_feature: GYAE6OF01EJ2C3.3.16.B05.1.454.CMB.1.raw
tcagagacgcactccacgaccggtgctcgatttagagctcacgtatttggggtttgggggggggtctcaggaggcagcgctctcgggacgtctccaccatggcctgggctctgctattcctcaccctcctcactcagggcacgagggtcctgggcccagtctgccctgactcagcctgcctccgtgtctgggtctcctggacagtcgatcatccgcctattcctcctgcacgtggaaccagcaggtgtacggttggtgttataactatgtcgtccgtggtatcaacacgaccaccgaggaccaaaccgacccccaaactactaatttaactttagtagtattcggtactaaggttaacgttccggtacccttacggtaggggttttacctaacgttccgtctttaccgtacgttacggttaacctaaggttccgtacggtaacctaaaccggacccggttaccccttaccccgttaccggtaacccttacgtttccggtacgggttaccggggtacccgttccgggaacgggtaccggtacgggaagggaccggttacggtacgtttaacggttaaacgttttaaccgtttaccggtacgggtacccgtaacggttccgttaacgtaacgttaacgtaaacgaacggtacctaaacgggtaccgtaaccggtacccggttaacggggggttacggggttaacccggtttaaccgggggaaacccggttaccgggggtaaaccccgttaacccggggttacccccggttaaccccgggttacccccggtaacccccgtaaaccccgggttacccggaaacccccgggtaaccccccggaaaccccgggttaccccccctaaaccccccggtttaacccggg

SEQ ID NO: 204721 - DNA, 829 bp, Homo sapiens
  misc_feature: GYAE6OF01D8PWL.3.16.B05.1.454.CMB.1.raw
tcagagacgcactccacgaccggtgctcgatttagagctcacgtagttgggttgggggggtctcaggaggcagcgctctcgggacgtcctccaccatggcctggctctgctattcctcaccctcctcactcagggcacgagggtcctagggccagtctgccctgactcacgcctcgccttcgtgtcgtcgggtcctccgtgggactagtcgactcactccgcctagtcctaccgtgacctacgttaggaaacctgctaggtcggtacggtttgggtaagttaataacgttagtccgttccgtcctacggtactaccgaactacgaccctaaccgaaggaacccgtaaaaccgaccccctaaaactaccgtaaactttaaccgttttaagacggtaacgttacgttaccgtaacgtaaccgttcccggtacccgttacggtttacgggttttactaacgttccggttacctttacgtacgttacggttaacgtaagtcgtacggacctaaccggtacccggtccctacccgtacgtaccttacgttccgtacgtccggtacctacggtacggtacgttaagggaaccgtacgggtactggttaacgttaacgttacgttacgtaaccgtacttacggtacttaaccgaagtttaaccgtaacggtaaccggtacgtaacggtacgtaacggtaccggttaacgggttacgggttaacccgttaacggggtaaacccgttcgggtaaacccgtacggttaccgtaccccggttacgtacccgtacggtacccaccggttaacccccgaacccgtcccgaacccgtttaccg

SEQ ID NO: 204722 - DNA, 845 bp, Homo sapiens
  misc_feature: GYAE6OF01ELYVP.3.16.B05.1.454.CMB.1.raw
  modified_base (692)..(692): a, c, t, g, unknown or other
  misc_feature (692)..(692): n is a, c, g, or t
tcagagacgcactccacgaccggtgctcgatttagagctcacgtatttggggtttggggggggtctcgaggaggcagcgctcgtcgggacgtctccaccatcggcctgggctctgctacttcctccaccctctcacctcgagggcacgagggtccgtcgggccagtctcgtccctgactcacgtcctcgtcctttcgtcgttcgtcgggtcctcgtagacgtcgtcgacttcgacgtccgcctattcctccggtacgaccgtaacgttaaccggaaccgacggaacggttaggttacggtttaccgggtttagggtttaacgtttaaccttaaacgttcgtttccgttccgttaccggttaggttaacctaaccgaacgtaccgaccccaaaccggtaacggaaaacccctaacccccggtaacccctaaattacctttaaaagtttaaacgttcgttacgttagttaccgtaacgttaaacgttcccggttcccggtaccggtttaacggttacgttacctaacgttccgttcttacgttacgttaagtaacgtcgtacgcgtaacccgccgtacccgtccttacgactcctacggttcctccggtaccgtaccagacggttagacggtaaacgcccggtattacggttaactttacggtagtaccgtgaaccgtttccaataacgttaanacgaacgtcgtaaccgagacccgggttagtacgggtttaaccggtggttacccggtacggaaacggttccggaaacgttcccggaccccttacgggtaccccgaccgttaccggaacctaaacccgaccccgtaaccggtccctaaccgtcgg

SEQ ID NO: 204723 - DNA, 829 bp, Homo sapiens
  misc_feature: GYAE6OF01ANQC6.3.16.B05.1.454.CMB.1.raw
  modified_base (257)..(257): a, c, t, g, unknown or other
  misc_feature (257)..(257): n is a, c, g, or t
  modified_base (278)..(278): a, c, t, g, unknown or other
  misc_feature (278)..(278): n is a, c, g, or t
tcagagacgcactccacgaccggtgctcgatttagagctcacgtagtttggggtttggggggggtctcaggaggcagcgctcgtcgggacgtctcaccatggcctggctctgctattccctcaccctcctcactcgagggcaacggcggtccgtcgggacccagtctcgccctagacctcgacgtcctcgccttccggtgtccggttggtccctcgtagacgagtaccgatactcgtcccgactacttccgtaccgngaccgtacgtacggaacctgngtacgttcggtaacggtttgggttaagtttaactaattacgttacgtccgtttaccgtaggttactaacaacgaccgaccgtaacccgaaggacccgaaacccgtacccctaaacgttacgtaatttaacttttaggtatagtacgtacgttaacggaaccgttccgacccggttacgtacggtttactacgtcgttacttcgtacgttgtaacgtcggtactaccggaacgtaaccggtacccgtccgttaccgtacctaaccggttaccgttccgttaccgggttaccggtacccggttaccgggaaacggtacccggttaacgggaacgggtaaccggtaaccggtacgttaaacggtttaaacgtttaaccggttaatccggaaacgtcgttacgtaactaagtaaaccgtacgaaacgtccgagtaccgaggtccgtaacgggttccggtagtaaccggtacgttaacgggaccctacgggtacccgtaccgtccgacccggtaacgttcccgggaaacccaccggaaccctcccgaaccgtaccg

SEQ ID NO: 204724 - DNA, 995 bp, Homo sapiens
  misc_feature: GYAE6OF01ESI36.3.16.B05.1.454.CMB.1.raw
  modified_base (185)..(185): a, c, t, g, unknown or other
  misc_feature (185)..(185): n is a, c, g, or t
  modified_base (849)..(849): a, c, t, g, unknown or other
  misc_feature (849)..(849): n is a, c, g, or t
tcagagacgcactccacgaccggtgctcgatttagagctcacgtagttggggtttgggggggggtctcgagggaggcagcgctcgtcgggacgtctccaccagtcggcgtcggctctgctacttcctcaccctcctcactacgaggcacgacgggtcgtcgggccagtcgtacgccgtgactcgngcctcgccgttcgtcgttcgtcgggtacctcgtagacgcgtacgtcgtacgtaacgtccgaacgttcttccgtaccgtacgaaccgtacgtaaccggggaacctacgtaacggtaacggtcgggtttaccggttttagggggttaacctttaaagttaaccgtttacgttaccggtttacctttaaccgggttaacgttaaaccgtccgtaaaaccgtaccgaaccggtaaaccccggaaggtaaaccccgaaaaccccggtaaaccccgtaaaccgtaaccttttaaaacgtttaaagtttaccgtacgggttaacttaccggttaacgggaaccgtttacccggggtacccgttaaaccgggtttaccgggtttaaaacgggttacccggtttaaccgttaaccggtttccgtttaaacggtttaccgggttttaaaccggttaaacgggtaaacctttaccggggtaaacccgtaaccccggtacccggttaaaccccggttaccccttaaccgggtaaacccgtttaaccggttccttaccgggtttaacccgttaccgggttaccggttaacccgggaccgggttaaacgggtaccggtaaccgggttaacggttaaccgttacgggttaaacttaaccggtttaaacgtcggttaacncgttaaccggtataaacgtagtaaaccgtaaggactacggtaaccgtagaccgtggtaccggttacggtccgtaggaccggagttaccgaaacgtcgtcgaacccggacgtaccgaccgtacccgacgaacccggcctaggtaccg

SEQ ID NO: 204725 - DNA, 508 bp, Homo sapiens
  misc_feature: GYAE6OF02HCSZJ.3.16.B05.1.454.CMB.1.raw
  modified_base (311)..(311): a, c, t, g, unknown or other
  misc_feature (311)..(311): n is a, c, g, or t
  modified_base (383)..(383): a, c, t, g, unknown or other
  misc_feature (383)..(383): n is a, c, g, or t
  modified_base (432)..(432): a, c, t, g, unknown or other
  misc_feature (432)..(432): n is a, c, g, or t
tcagagacgcactccacgaccggtgctcgatttagagctcacgtagttggggtttgggggggtctcagggaggcagcgctcgtcgggacgtctccaccatggcctgggctctgctattcctcaccctcctcactcagggcacaggtcctgggcccagtctgccctgactcagcctgcctccgtgtctgggtctcctggacagtcgatcatcgccatctcctgcactggaaccagcctagtgacgttggtggttagtaactatgtctcctggtatcaacagcacccaggcaacgccccaaatcactaattancgatgtcagtaatcggccctcgagggtttcaatcgcttctctggttacaagtctggcaacgacggcctcccngaccatctcgtggctccgaggctgaggcgagctgattatactgcagctnatatacaagcagcagcagtgggtctaggactcgggacaggtcacgtcgccacgtcacgcccaaggcccaaccctcg

SEQ ID NO: 204726 - DNA, 796 bp, Homo sapiens
  misc_feature: GYAE6OF02IUB7D.3.16.B05.1.454.CMB.1.raw
tcagagacgcactccacgaccggtgctcgatttagagctcacgtaagtttgggggtttggggggggtctcaggacggcagaccgctctcgggacgtctccaccatggccctgggctctgcctattccctcaccctccgtcactccagggcacagggtcctgggcccaggtctgccctgactacgagccctgccctccggtgtactgggtcctccgtggtacgtggtcgatcgatccgccgtatctccgtgcctacgttccggaaccacggccgtacggttcgaacggtttggtacggtttaacttaacctagttcgtccttaccttaggtactcgtaacgacgtccaacccgtacggaccgaaaccggaccccctaaactcgtaattaagtttagtaggattcggtactaacggttaaccgtacccggtacccgtacggttaacggggtttacctaacgtaccgttacgtttacctcggttaacggttaaaccgaaggttaccgttacgggaaccgtaaacgcccggggtaccctacccgtacggtaacctacgttccgtaccggtacggtcctacgtacggtactagggacgtacgtacggtacgtagttacttacttcgtacgaacgtacgtactactaacgtacgttaacgacgtactacgacgacgtccgtaacggttcgggtaccgttacggaacggttccggaaccgttaacggtaccttaacccgggttccgttaacccgtacggttaccgaccggtacccgttaaccggtaccccctaccgtaccggg

SEQ ID NO: 204727 - DNA, 817 bp, Homo sapiens
  misc_feature: GYAE6OF02I8MAI.3.16.B05.1.454.CMB.1.raw
  modified_base (165)..(165): a, c, t, g, unknown or other
  misc_feature (165)..(165): n is a, c, g, or t
  modified_base (173)..(173): a, c, t, g, unknown or other
  misc_feature (173)..(173): n is a, c, g, or t
  modified_base (221)..(221): a, c, t, g, unknown or other
  misc_feature (221)..(221): n is a, c, g, or t
tcagagacgcactccacgaccggtgctcgatttagagctcacgtagttgggtttgggggggtctcaggaggcagcgctctcgggacgtctccaccatggcctgggctctgctattcctcaccctcctcactcagggtcacagggtcctgggcccaggtctgcccnactgctcncgtcctcgtctcggtcgtcctcgagacgtacgtacgtctacacgtccnctactcctctcgacctacggtaaccgaacggacgacgtaggtacggttagggtttaggtttaacgtaaacttaactcgttccgttccgtacggtacgtaaccaaccgaacgtcccgaaccgtaaccggaaccgaaacccgtaacccccgtaaaacccctaaagtaaacctttaaaagttttacgtacggtacgtacggtaacgttaacgtaacgttccgggtacccgtaccgtttaggggtttacgttaactcgttccgttcttccggttacgtacgtaacgtcgtcgtaccgaacgtccgtacccgtcccgtaccgtaccgtacctcgttccggtaccggtccgtacctaggggtcgtacggaacgggtacgaaccgggtgtacgttaaggttaacctttaggaccgagtaccgtacgttactaagtaaaccgtacgtacgaacggtacgacgacgtaaccgtcgggttaacgggttccggtttaaaccgggacgttaaacggggccaaaccggttcccggttacctaccccggttacccgtccggttacacccggtaaccccggtaaccgaaccccccgtaacccgtactccgg

SEQ ID NO: 204728 - DNA, 736 bp, Homo sapiens
  misc_feature: GYAE6OF02HCZ77.3.16.B05.1.454.CMB.1.raw
  modified_base (244)..(244): a, c, t, g, unknown or other
  misc_feature (244)..(244): n is a, c, g, or t
  modified_base (575)..(575): a, c, t, g, unknown or other
  misc_feature (575)..(575): n is a, c, g, or t
tcagagacgcactccacgaccggtgctcgatttagagctcacgtagttggggtttgggggggggtctcaggaggcagcgctctcgggacgtctccaccatggcctgggctctgctattcctcaccctctcactcgagggcacgagggtcctgggcccagtctcgccctgactcagcctgcctcgtgtcgtgggtctccgtggactagtcgatcatcgcctatcctccgtgccacgtcggaaccngcgtaggttcgtacggtttgggtagttaataacttagtcgtcctccgtaggtaactacgaacacgaccaacccgaaggaccaaaccgacccctaaactcgtaaatttaacgtttatacgtagttacgtactaacgttaacgtcccggtaccttacggttacggggttttactaacgttccgttaccttcgttacgttacggttaacacggttcgtacggaccaacgcccggtccttcccgtacgaccctacttcctcggtcggtcctacggtacggtcggtacggacgggtaacgtacggtctaggttaactttacgtacgtcgacgtacnccgtaataacgtaactaacgaacgtcgaccgactacgtacgtaacgggttcgggttaccgttacgggacggttaacgggaaccggtacgtaccgggtacccgttaccggacccgtacggtccgaccggtaaccgtaaccccggaccctaaccccgttccgg

SEQ ID NO: 204729 - DNA, 867 bp, Homo sapiens
  misc_feature: GYAE6OF02HKPRH.3.16.B05.1.454.CMB.1.raw
  modified_base (125)..(125): a, c, t, g, unknown or other
  misc_feature (125)..(125): n is a, c, g, or t
  modified_base (213)..(213): a, c, t, g, unknown or other
  misc_feature (213)..(213): n is a, c, g, or t
  modified_base (257)..(257): a, c, t, g, unknown or other
  misc_feature (257)..(257): n is a, c, g, or t
tcagagacgcactccacgaccggtgctcgatttagagctcacgtagttggggttggggggggtctcgaggagggcagcgctcgtcgggacgtctccgaccgatcggcctgggctctgctattccncacctctcacgtcgagggacacgtaggtcctgggcctggtctgccctggactctagcctgcctcgtgtcgtcggtactccgtggaacngtcgaagtcacgtcaccgtgttcctacctgacacgtacgaaccnggtctaagggttcgacggtttaggtacggttaactaaacgtcgttcgttaacctcggtaggtacacgaacgacgtccaacccgtaggaacctaaaccgaccccgtttaaattaccgtaaacgtttaaacgtttaccgaaacggttcgtacgtttacgtacgggttaaccgtaccgggtacccggttccgggttaagggttaccttacgtaccgtttcgggtacctttacggggtaagtttaacgaccggttccgtacggtaaccgtaaccctcccggggtacccttaccccggaagtcccgtttaaatccggtaaccggtcggtaaccgttcccggacggtttaccggaacggacgggttaccggaacgggttacttagggttaaaaccttcgggttaaacctcgggtaacgttaccggaatttaacccgaaggttaaccggaaacgtccggtaacggtacccggagtaccgtcggttaacgggtcgtttacccgacgggttaccggtaccggtaaccgggtacggttacccggtaaaccccgttccgggtaccgttaacccgggtccgaaacccggtaccccgggtccggtaacccttccccggtacgg

SEQ ID NO: 204730 - DNA, 706 bp, Homo sapiens
  misc_feature: GYAE6OF02H8QXJ.3.16.B05.1.454.CMB.1.raw
  modified_base (164)..(164): a, c, t, g, unknown or other
  misc_feature (164)..(164): n is a, c, g, or t
  modified_base (173)..(173): a, c, t, g, unknown or other
  misc_feature (173)..(173): n is a, c, g, or t
  modified_base (252)..(252): a, c, t, g, unknown or other
  misc_feature (252)..(252): n is a, c, g, or t
  modified_base (287)..(287): a, c, t, g, unknown or other
  misc_feature (287)..(287): n is a, c, g, or t
  modified_base (478)..(478): a, c, t, g, unknown or other
  misc_feature (478)..(478): n is a, c, g, or t
tcagagacgcactccacgaccggtgctcgatttagagctcacgtatttggggtttggggggggtctcgaggaggcagcgctcgtcgggacgtctccaccagtcggccgtggctctgcttattccctccaccctcctcaccgtgacggcagtcggtccgcggccngtctcgccngtactcacgctcgccgtcgtgtcgtcggttctcgagacgagtcatctactccgactcgtctcctgacaacgtacgaccngcgtaggtgttacggttggtacgttaactacgttnttccgtcttaccgttaagtaacaaacgcgacccgaacgaacgaaccaaacccgtaaccctaaatactaattattcgacgtactgtacgacgtacgtccggtcttacggtacgtttacctactcgtctcgtagttacgtacgtagtcgacgaaccacgtccgtcctaccgactactagtccgtacgtcgacncggtacgacggtacgtagacggtacgttacgtagttacttacgttacgacgacgtacgtagtaactacgtaacgacgtaacgacgtacggacgtacggtacgttacgggttacgtaaccgggttaccgacggtaacggtaccggttaccggtaccgtaaccgtcccgttaaccgaaccggtaccgaacccggtacccggaacccgtacccgtacccgttacgttaccg

SEQ ID NO: 204731 - DNA, 703 bp, Homo sapiens
  misc_feature: GYAE6OF02ICAJ6.3.16.B05.1.454.CMB.1.raw
  modified_base (314)..(314): a, c, t, g, unknown or other
  misc_feature (314)..(314): n is a, c, g, or t
  modified_base (539)..(539): a, c, t, g, unknown or other
  misc_feature (539)..(539): n is a, c, g, or t
  modified_base (547)..(547): a, c, t, g, unknown or other
  misc_feature (547)..(547): n is a, c, g, or t
  modified_base (550)..(550): a, c, t, g, unknown or other
  misc_feature (550)..(550): n is a, c, g, or t
  modified_base (563)..(563): a, c, t, g, unknown or other
  misc_feature (563)..(563): n is a, c, g, or t
tcagagacgcactccacgaccggtgctcgatttagagctcacgtatgggtttggggggggtctcaggaggcagcgctctcgggacgtctccaccatggcctgggctctgctattcctcaccctcctcactcaggcacaggtcctgggcccaggtctgccctgactcacgcctcgtcctccgtgtcgtcgggtctccgtggtacacggttcgacttcacgtccgcctaattccttccgagtacacgtacgggaaaccagtccgtagtcggtacgttggttaggttaataacttagtgtccgtacgtgtatacaanacgcaccaggaaccaacgaccccaaagtactaagttaacttagacgtatcgtactaagtaactcccgtccgtacggtacgggtttatacggtacttcgttacttacgtagttactaaagttcggtaacgacgtaacctaccggtccttacccgtagaccttacgtcgttcgtacccgggtcaccgaggtacctgggaacggacgtcgtctaagttagttttaacncgtagtcnctnaactattaacganacgataaccgctaaccggtaacgtcgggttcgggtaaccgttacgggacgttaccgggtaaactaccgggtacgtacccggtacccgtccgtaaccgtaaccgacccggtaacccgtaacccgacccgtaacccttccgg

SEQ ID NO: 204732 - DNA, 377 bp, Homo sapiens
  misc_feature: GYAE6OF01DPO6K.44.12.B01.1.454.CMB.1.raw
  modified_base (373)..(377): a, c, t, g, unknown or other
  misc_feature (373)..(377): n is a, c, g, or t
tcagacagtatatacacgaccggtgctcgatttagtagtgtagattccgcgggggccgattcaccatctccagagacaattcgaagaacacactatatctggaaatgaatagcctgagagccgaggacacggctgtctactactgtgcgagagatggggctcgtggatacagatatgacatgctctactccaatggtatggacgcctggggccaagggaccacggtcgccgtctcctcagcctccaccaagggcccatcggtcttccccctggcacctcctccaagagcacctctgggggcacagcggccctgggctgcctggtcaaggactacttccacgtctactgctgagcgggctggcaggcgcatagnnnnn

SEQ ID NO: 204733 - DNA, 168 bp, Homo sapiens
  misc_feature: GYAE6OF01E1I7E.44.12.B01.1.454.CMB.1.raw
  modified_base (133)..(168): a, c, t, g, unknown or other
  misc_feature (133)..(168): n is a, c, g, or t
tcagacagtatatacacgaccggtgctcgatttagtagtgtagatttagggtttgggcacacgcggccctgggctgcctggtcaaggactacttcctactatactgtctgagcgggctggcaaggcgcatagnnnnnnnnnnnnnnnnnnnnnnnnnnnnnnnnnnnn

SEQ ID NO: 204734 - DNA, 384 bp, Homo sapiens
  misc_feature: GYAE6OF01BLML2.44.12.B01.1.454.CMB.1.raw
  modified_base (380)..(384): a, c, t, g, unknown or other
  misc_feature (380)..(384): n is a, c, g, or t
tcagacagtatatacacgaccggtgctcgatttagtagtgtagattccgcgggggccggattcaccatctccagtagacaattcgaagaacacacgtatatctagggaaatgaatagcctgagagccgaggacacggctgtctactactgtgcgagagatgggggctcgtggatacagatatgacatgctctactccaattgtatggacgcctggggccaagggaccacggtcgccgtctcctcagcctccaccaagggcccatcggtcttcccctggcaccctcctccaagagcacctctgggggcacagcggccctgggctgcctggtcaaggactacttccacgtctactgctgagcgggctggcaaggcgcatagnnnnn

SEQ ID NO: 204735 - DNA, 219 bp, Homo sapiens
  misc_feature: GYAE6OF01CGW3W.44.12.B01.1.454.CMB.1.raw
  modified_base (218)..(219): a, c, t, g, unknown or other
  misc_feature (218)..(219): n is a, c, g, or t
tcagacagtatatacacgaccggtgctcgatttagtagtgtagatttgggattgggggaagaggaagactgacggtcctcccaggagttcaggtgctgggcaccttgggcacggggaggtgtgtcacaagatttgggctctgggcacagcggccctgggctgcctggtcaaggactacttcctatatactgtctgagcgggctggcaaggcgcatagnn

SEQ ID NO: 204736 - DNA, 308 bp, Homo sapiens
  misc_feature: GYAE6OF01BEYBQ.44.12.B01.1.454.CMB.1.raw
  modified_base (296)..(308): a, c, t, g, unknown or other
  misc_feature (296)..(308): n is a, c, g, or t
tcagacagtatatacacgaccggtgctcgatttagtagtgtagatttgaggtttggggggtgtggtggtctccactcccgccttgacggggctgctatctgcctccctggccatcactggctccaggctgaagatgagggtgattattactgccagtcctatgacagcagcctcagtggttgggtgttcggcggagggaccaagctgaccgtcctgggtcagcccaaggctgccccctggtcactctgttcccgcctcctctatatactgtctgagcggctggcaaggcgcatagnnnnnnnnnnnnn

SEQ ID NO: 204737 - DNA, 466 bp, Homo sapiens
  misc_feature: GYAE6OF01B9V7X.44.12.B01.1.454.CMB.1.raw
  modified_base (232)..(232): a, c, t, g, unknown or other
  misc_feature (232)..(232): n is a, c, g, or t
  modified_base (454)..(466): a, c, t, g, unknown or other
  misc_feature (454)..(466): n is a, c, g, or t
tcagacagtatatacacgaccggtgctcgatttagtagtgtagatttaggagtttgggggctgttcctggaaggtgttggtaccagagggtcaccatctcctgcactgggagcagatccaacatcgggacagattctgatgtccactggtaccaacaccttccaggaacagcccccaaatcctcatctttggtaacaactatcggccctcaggggtccctgaccgattttcnggctccaagtctggcacctcagcctccctggccatcactgggctccaggctgaagatgagggtgattatactgccagtcctatgacagcagcctcagtggttgggtgttcggcggaggaccaagctgaccgtccgtgggtcagcccaaggctcgcccctggtcactctcgttcccgccctcctctatactactgtctgagcgggctggcaaggcgacatagnnnnnnnnnnnnn

SEQ ID NO: 204738 - DNA, 379 bp, Homo sapiens
  misc_feature: GYAE6OF01BB08N.44.12.B01.1.454.CMB.1.raw
  modified_base (374)..(379): a, c, t, g, unknown or other
  misc_feature (374)..(379): n is a, c, g, or t
tcagacagtatatacacgaccggtgctcgatttagtagtgtagattccgcgggggccgattcaccatctccagagacaattcgaagaacacactatatctggaaatgaatagcctgagagccgaggacacggctgtctactactgtgcgagagatggggctcgtggatacagatatgacatgctctactccaatggtatggacgcctggggccaagggaccacggtcgccgtctcctcagcctccaccaagggcccatcggtcttcccctggcaccctgctccaggagcacctctggggcacagcggccctgggctgccctggtcaaggactacttcctatatactgtctgagcgggctggcaaggcgcatagnnnnnn

SEQ ID NO: 204739 - DNA, 178 bp, Homo sapiens
  misc_feature: GYAE6OF01C1OWL.44.12.B01.1.454.CMB.1.raw
  modified_base (139)..(178): a, c, t, g, unknown or other
  misc_feature (139)..(178): n is a, c, g, or t
tcagacagtatatacacgaccggtgctcgatttagtagtgtagatttaggttgggcacgaggcggccctgggtctgacctgggtccaagggacctacgttcctatatactctgacgcggctaggccaaggcgcactagnnnnnnnnnnnnnnnnnnnnnnnnnnnnnnnnnnnnnnnn

SEQ ID NO: 204740 - DNA, 509 bp, Homo sapiens
  misc_feature: GYAE6OF01BJJLU.44.12.B01.1.454.CMB.1.raw
  modified_base (170)..(170): a, c, t, g, unknown or other
  misc_feature (170)..(170): n is a, c, g, or t
  modified_base (246)..(246): a, c, t, g, unknown or other
  misc_feature (246)..(246): n is a, c, g, or t
  modified_base (315)..(315): a, c, t, g, unknown or other
  misc_feature (315)..(315): n is a, c, g, or t
tcagacagtatatacacgaccggtgctcgatttagtagtgtagattccgcggggagctcaggaagcagagcctggagcatctccactatggcctgggctccactacttctcaccctcctcgctcactgcacaggttcttgggccaattttatgctgactccacccccctntgtgtcggagtctccggggaagacggtaaccatctcctgcacccgcagcactggcagcattgccagcaacttttgngcagtggtaccagcagcgcccgggcagtgcccccaccactgtgatctatgaggatacccaacgaccctntggggtcccctgatcggttctctggctcatcgacagctcctccaactctgccctccctcaccatcctctggactgaagactgaggacgaggctgactactactgtcagttcttatgatagcagcaatcatggtgtagttgggcggagggtacaaggctacgaccgtcctaggtcagccccgaaggcctacccgg

SEQ ID NO: 204741 - DNA, 130 bp, Homo sapiens
  misc_feature: GYAE6OF01A8KTB.44.12.B01.1.454.CMB.1.raw
  modified_base (130)..(130): a, c, t, g, unknown or other
  misc_feature (130)..(130): n is a, c, g, or t
tcagacagtatatacacgaccggtgctcgatttagtagtgtagatttgggtttgtgcacagcggccctgggctgcctggtcaaggactacttcctatatactgtctgagcgggctggcaaggcgcatagn

SEQ ID NO: 204742 - DNA, 538 bp, Homo sapiens
  misc_feature: GYAE6OF01CUGZ7.44.12.B01.1.454.CMB.1.raw
  modified_base (259)..(259): a, c, t, g, unknown or other
  misc_feature (259)..(259): n is a, c, g, or t
  modified_base (521)..(538): a, c, t, g, unknown or other
  misc_feature (521)..(538): n is a, c, g, or t
tcagacagtatatacacgaccggtgctcgatttagtagtgtagatttgggtgtgagctggatccgtcagcccccagggaaggccctggagtggcttgcacacatcttctcgaatgacgaaaaatcctacagtacatctctgaagagcagtttaaccatctccaaggacacctccaaaaggcaggtgtctttagtatgaccaacatggaccctgcggacacaggcacatattactgtgcacgggtaatggacgggaaaanaacagctggttctgtattataagtcttacatctggacgtcgtggggcaaagggaccacggtcaccgtctcctcagctccacaacgggcccagtccggtccttccccgtggcccgccctcgcctccgaggacgcctaccgtcggtcggggccacgcggccggcccgtgggcctcgcccgtggtaccgaaggtacctactttcctaatacgtacctgtcgtggacggtccgggtcgtcgggacaacgggtccgcgtaagtagcnnnnnnnnnnnnnnnnnn

SEQ ID NO: 204743 - DNA, 503 bp, Homo sapiens
  misc_feature: GYAE6OF01D1GYW.44.12.B01.1.454.CMB.1.raw
  modified_base (381)..(381): a, c, t, g, unknown or other
  misc_feature (381)..(381): n is a, c, g, or t
  modified_base (425)..(425): a, c, t, g, unknown or other
  misc_feature (425)..(425): n is a, c, g, or t
tcagacagtatatacacgaccggtgctcgatttagtagtgtagattccgcgggggtagctcaggaagcagagcctggagcatctccactatggcctgggctccactacttctcaccctcctcgctcactgcacaggttcttgggccaattttatgctgactcacccccctctgtgtcggagtctccggggaagacggtaaccatctcctgcacccgcagcactggcagcattgccagcaactttgtgcagtggtaccagcagcgcccgggcagtcgcccccacactgtgatctatgaggatacccaacgaccctcgtcggggtcccctgactcggttctctggctcatcgacagctcctccactctcgccctccctcaccntcctctggactgaagctgaggacgaggctgactactactgtacngttcttatgatagcagcaatcatgtgtatcgggcggtaggaccagcgtagaccctcgtagtcacgcccaggctcccgg

SEQ ID NO: 204744 - DNA, 460 bp, Homo sapiens
  misc_feature: GYAE6OF01D1S6O.44.12.B01.1.454.CMB.1.raw
  modified_base (450)..(460): a, c, t, g, unknown or other
  misc_feature (450)..(460): n is a, c, g, or t
tcagacagtatatacacgaccggtgctcgatttagtagtgtagatttgagtttgggggctgttcctggaaggtgttggtaccagagggtcaccatctcctgcactgggagcagatccaacatcgggacagattctgatgtccactggtaccaacaccttccaggaacagcccccaaactcctcatctttggtaacaactatcggccctcaggggtccctgaccgattctctggctccaagtctggcacctcagcctcctggccatcactgggctccaggctgaagatgaggtgattattactgccagtcctatgacagcagcctcagtggttggtgttcggcggagggaccaagctgaccgtcctggtcagcccaaggctcgccccctggtcactctcgttccccaccctcctctatatactgtctgagcgggctggcaaggcgcatagnnnnnnnnnnn

SEQ ID NO: 204745 - DNA, 247 bp, Homo sapiens
  misc_feature: GYAE6OF01D5MDT.44.12.B01.1.454.CMB.1.raw
  modified_base (218)..(218): a, c, t, g, unknown or other
  misc_feature (218)..(218): n is a, c, g, or t
  modified_base (224)..(247): a, c, t, g, unknown or other
  misc_feature (224)..(247): n is a, c, g, or t
tcagacagtatatacacgaccggtgctcgatttagtagtgtagatttgggtttaggggggaagaggaagactgacggtcctcccaggagttcaggtgctcgggcaccttgggcacgggggaggtgtgtcacaagtatttgggctctgggcacagcggccctgggctgcctggtcaaggactacttcctatatactgtctgagcgggctggcaagggcncatagnnnnnnnnnnnnnnnnnnnnnnnn

SEQ ID NO: 204746 - DNA, 376 bp, Homo sapiens
  misc_feature: GYAE6OF01AFCQW.44.12.B01.1.454.CMB.1.raw
  modified_base (374)..(376): a, c, t, g, unknown or other
  misc_feature (374)..(376): n is a, c, g, or t
tcagacagtatatacacgaccggtgctcgatttagtagtgtagattccgcgggggccgattcaccatctccagagacaattcgaagaacacactatatctggaaatgaatagcctgagagccgaggacacggctgtctactactgtgcgagagatggggctcgtggatacagatatgacatgctctactccaatggtatggacgcctggggccaagggaccacggtcgccgtctcctcagcctccaccaagggcccatcggtcttcccctggcaccctcctccaagagcacctctgggggcacagcggccctgggctgcctggtcaaggactacttcctatatactgtctgagcgggctggcaaggcgcatagnnn

SEQ ID NO: 204747 - DNA, 481 bp, Homo sapiens
  misc_feature: GYAE6OF01ETDRA.44.12.B01.1.454.CMB.1.raw
  modified_base (237)..(237): a, c, t, g, unknown or other
  misc_feature (237)..(237): n is a, c, g, or t
  modified_base (366)..(366): a, c, t, g, unknown or other
  misc_feature (366)..(366): n is a, c, g, or t
  modified_base (369)..(369): a, c, t, g, unknown or other
  misc_feature (369)..(369): n is a, c, g, or t
  modified_base (372)..(373): a, c, t, g, unknown or other
  misc_feature (372)..(373): n is a, c, g, or t
  modified_base (375)..(375): a, c, t, g, unknown or other
  misc_feature (375)..(375): n is a, c, g, or t
  modified_base (377)..(377): a, c, t, g, unknown or other
  misc_feature (377)..(377): n is a, c, g, or t
  modified_base (379)..(379): a, c, t, g, unknown or other
  misc_feature (379)..(379): n is a, c, g, or t
  modified_base (381)..(381): a, c, t, g, unknown or other
  misc_feature (381)..(381): n is a, c, g, or t
  modified_base (385)..(385): a, c, t, g, unknown or other
  misc_feature (385)..(385): n is a, c, g, or t
  modified_base (392)..(392): a, c, t, g, unknown or other
  misc_feature (392)..(392): n is a, c, g, or t
  modified_base (462)..(465): a, c, t, g, unknown or other
  misc_feature (462)..(465): n is a, c, g, or t
  modified_base (467)..(470): a, c, t, g, unknown or other
  misc_feature (467)..(470): n is a, c, g, or t
  modified_base (472)..(481): a, c, t, g, unknown or other
  misc_feature (472)..(481): n is a, c, g, or t
tcagacagtatatacacgaccggtgctcgattttagtagtgtagatttgggtgtgacgctggatccgtcagcccccagggaaggccctggagtggcttgcacacatcttctcgaatgacgaaaaatcctacagtacatctctgaagagcagtttaaccatctccaaggacacctccaaaaggcaggtggtctttagtatgaccaacatggaccctgcggacacaggcacatattacngtgcacgggtaatggacgggaaagaaacagcgtggtttctgtattataagtcttaccatctggacgtcgtggggacaaagggaccacggtcaccgtctcctcagcttccaccaagggccatcgctcccngcnccnncncngncnctcngggcacngcgcctggctgcctggcaaggctacttcctatatactgtctgacgcgggtctggcgaaggcgctagtagnnnngnnnncnnnnnnnnnn

SEQ ID NO: 204748 - DNA, 584 bp, Homo sapiens
  misc_feature: GYAE6OF01C2AKE.44.12.B01.1.454.CMB.1.raw
  modified_base (312)..(312): a, c, t, g, unknown or other
  misc_feature (312)..(312): n is a, c, g, or t
  modified_base (562)..(562): a, c, t, g, unknown or other
  misc_feature (562)..(562): n is a, c, g, or t
  modified_base (565)..(584): a, c, t, g, unknown or other
  misc_feature (565)..(584): n is a, c, g, or t
tcagacagtatatacacgaccggtgctcgatttagtagtgtagatttgagtttgggggctgttcctggaaggtgttggtaccagagggtcaccatctcctgcactgggagcagatccaacatcgggacagattctgatgtccactggtaccaacaccttccaggaacacgcccccaaactcctcatctttaggtaacaactatccggccctcgacggggtcccctgaccgattcctctggctccaagtctggccacctcacgccctccctggcccatccacgtcgggctccgaggctagaagatggagggtntatttacttacgtgacctagtcctatcgacagcacgcctcgaggttgggttgggtcgttcgggacggtaacgggaaccaagcgtacggtacccgtcggtcgggtcacgtacccgaacggtcctcccggccccccgttcggtccctaccgttccgttcccgttacccccctaccccttccgttaccttaacgttaccttaccgtcgttacgtcggacggtccgggtcgtgggaccgtacggcgacagtgcngcnnnnnnnnnnnnnnnnnnnn

SEQ ID NO: 204749 - DNA, 682 bp, Homo sapiens
  misc_feature: GYAE6OF01AH2IW.44.12.B01.1.454.CMB.1.raw
tcagacagtatatacacgaccggtgctcgatttagtagtgtagattccgcgggggtagctcaggaagcagagcctggagcatctccactatggcctgggctccactacttctcaccctcctcgctcactgcacaggttcttgggccaattttatgctgactcaccccccctctgtgtcggagtctccggggaagacggtaaccatctcctgcacccgcagcactggcagcattgccagcaactttgtgcagtcggtaccagcagccggcccgggcagtccgcccccaccactgtgatctatgaggactacccaaccgaccctcgtcggggtccctgacgttcggttctcgtcggcctccatcgacacgcctcctaccaacttcctcgccccttccctacctaccctacttcctcgtacggtaacctaggaaacgtacgtagggacgggaacggacgggtcctacgtaaccttacttaccgtcgtaccgtacgttctttaagtaggtactacggtccaacgtactaattccgtaagtttcgggttagggttaaccggtttccgggggaaccgggtaaccgggggtaacccgaacgggtcccgttaacccgggtaccccggttaccggttaaccgggtaccgaacccggtaccccggtaaacgggtccccgttacccccccggg

SEQ ID NO: 204750 - DNA, 470 bp, Homo sapiens
  misc_feature: GYAE6OF01EJLMN.44.12.B01.1.454.CMB.1.raw
  modified_base (458)..(470): a, c, t, g, unknown or other
  misc_feature (458)..(470): n is a, c, g, or t
tcagacagtatatacacgaccggtgctcgatttagtagtgtagattccgcggggggccgattcaccatctccagagacaattcgaagaacacactatatctggaaatgaatagcctgagagccgaggacacggctgtctactactgtgcgagagagtggggctcgtggatacagatatgacatgctctactccaatggtatggacgccgtggggccaagggaccacgggtccgcccgtctcctcacgccctccaccgaacgggcccactccggtccttcccccctcgtccaccctcctaccaacgacgccaccctcgtcgggggccacgacggccggcccgtggggcctcggtcccgttcgggtaccgaaacgggtaccttaccgttcccgtaccgtacgtccggccgttcgtcggtacggccggggtcgtcgggaccgaacgggcgaccagtagcgnnnnnnnnnnnnn

SEQ ID NO: 204751 - DNA, 551 bp, Homo sapiens
  misc_feature: GYAE6OF01EEGLO.44.12.B01.1.454.CMB.1.raw
  modified_base (529)..(551): a, c, t, g, unknown or other
  misc_feature (529)..(551): n is a, c, g, or t
tcagacagtatatacacgaccggtgctcgatttagtagtgtagatttgagtttgggggctgttcctggaaggtgttggtaccagagggtcaccatctcctgcactgggagcagatccaacatcgggacagattctgatgtccactggtaccaacaccttccaggaaccagccccccaaaactccctcattctttaggtaaaccaactatccggccctcgacggggtccctgaccgattctctggcctaccaagtctggcaccctcagccctccctggccatcacgtgggcctccaggctagaagagtggaggtgtatttattactcgccagtcctatcgacagcacgtcctcgaggttgggttgggtcggttcgggacggacgggaccaagtctcggacccgtccgtcgggcacggacccaacggcctcccggcccccgtcggtcctaccttcccttccgtccccctaccccttccctacttactactacctcgtcgtgacggtcggcgtggacgacggcgacacgtgnnnnnnnnnnnnnnnnnnnnnnn

SEQ ID NO: 204752 - DNA, 437 bp, Homo sapiens
  misc_feature: GYAE6OF01EFMX5.44.12.B01.1.454.CMB.1.raw
  modified_base (242)..(242): a, c, t, g, unknown or other
  misc_feature (242)..(242): n is a, c, g, or t
  modified_base (419)..(437): a, c, t, g, unknown or other
  misc_feature (419)..(437): n is a, c, g, or t
tcagacagtatatacacgaccggtgctcgatttagtagtgtagattccgcggggggccgattcaccatctccagagacaattcgaagaacacactatatctggaaatgaatagcctgagagccgaggacacggctgtctactactgtgcgagagagtggggctcgtggatacagatatgacatgctctactccaatggtatggacgccgtggggaccaagggaccacggtcgccgtctcctnagcctccacgaacggccatccggtcctcccctggccaccctcctaccaacgacgccacctcgtcgggggcacgacggccggcccgtgggcctcgccgttacggtacgaacggtaccttaccttcctaattactacgttgtcgtggacggcgggtcgtggacaacggccgacgatagnnnnnnnnnnnnnnnnnnn

SEQ ID NO: 204753 - DNA, 508 bp, Homo sapiens
  misc_feature: GYAE6OF01AGXDI.44.12.B01.1.454.CMB.1.raw
  modified_base (479)..(480): a, c, t, g, unknown or other
  misc_feature (479)..(480): n is a, c, g, or t
  modified_base (483)..(485): a, c, t, g, unknown or other
  misc_feature (483)..(485): n is a, c, g, or t
  modified_base (487)..(487): a, c, t, g, unknown or other
  misc_feature (487)..(487): n is a, c, g, or t
  modified_base (490)..(508): a, c, t, g, unknown or other
  misc_feature (490)..(508): n is a, c, g, or t
tcagacagtatatacacgaccggtgctcgatttagtagtgtagatttgagtttgggggctgttcctggaaggtgttggtaccagagggtcaccatctcctgcactgggagcagatccaacatcgggacagattctgatgtccactggtaccaacaccttccaggaacagccccccaaactccctcatctttggtaacaactatcggccctcaggggtcccctgaccgattctctggctccaagtctggcacctcagcctccctggccatcactgggctccaggctgaagatgagggtgattactactgtgcagcatgggatgacaggccggaacggcgtgggtgttcgggcggacgggacctaaggttcgaccgtccgtaggtcacgcccgaaggcctcgcccccgtgtcacctctccgttccccgccctcctctactactctcgtctgacggcggtcgtggccaaggccgacagtagnnagnnngnacnnnnnnnnnnnnnnnnnnn

SEQ ID NO: 204754 - DNA, 803 bp, Homo sapiens
  misc_feature: GYAE6OF01CQLOF.44.12.B01.1.454.CMB.1.raw
  modified_base (174)..(174): a, c, t, g, unknown or other
  misc_feature (174)..(174): n is a, c, g, or t
tcagacagtatatacacgaccggtgctcgatttagtagtgtagattccgcggggagctcaggaagcagagcctggagcatctccactatggcctgggctccactacttctcaccctctcgctcactgcacgaggttcttgggcctaattttatgctgacctcccaccccccctntgtcgtcggtagtccgtaccggggaagaccggtaaccatcctcctgccacccgcacgcacgtggacagctattcgaccagtacctaacgtttgtcgcgtaaggtcggtaccacggcgaccgggcccgggacccgggacaccggttccccgacccccccacgtaccgttggtaacgtacttaccgtagtacggaaccggtaaccctaacccccggaaaccggtccccgttcgggtccggggtaccctggtacgtttccggtctccgtcgcctccgtagaccgactaccgtcccttaccgtaccctaccttccgtcccgtaccccttacccctacctaacctacgttccgttaccgtacggtaaccgtacggtaaacggtcggtacgggaacggtacgtacggtctaaaccggtacctacgttaccggttacgttaccgttacgtttattacgtacggttaacgtacgtcgaaactacgtaacgttcgtaggttacgggttggttacccgggttacgggggaaccgggaaccgggtaaccggtaacggtccggttacccgggttaacccgtaccgggtaacggtacccggaacccggtacccccggtacggttccccccgttacccccggg

SEQ ID NO: 204755 - DNA, 670 bp, Homo sapiens
  misc_feature: GYAE6OF01AG0T9.44.12.B01.1.454.CMB.1.raw
  modified_base (173)..(173): a, c, t, g, unknown or other
  misc_feature (173)..(173): n is a, c, g, or t
  modified_base (252)..(252): a, c, t, g, unknown or other
  misc_feature (252)..(252): n is a, c, g, or t
tcagacagtatatacacgaccggtgctcgatttagtagtgtagattccgcgggggtagctcaggaagcagagcctggagcatctccactatggcctgggctccactacttctcaccctcctcgctcactgcacaggttcttgggcctaattttatgctgactcaccccccctntgtgtcggagtcgtccggggaagacggtaaccagtctcctgccacccgcagcactggcagcattcgccagcaactttgngctagtcggtaccagcacgccggcccgggcagtccgccccccacgactgtgactcagtgaggactacccgaaccgaccctcgtcgggtccctgtacttcggttctcgtcggcctcctatccgactacgcccttccctacccaaccttccgtccgtcccctacccctccaccctacttcctaccgtcggaactggaaacgtacgtagggaacggacggacggtctacggtaaccttaccgtacgttcgtactaacgtttccttaagtacgtagtacgacctaaggtactaacttctaagttgggttacgggttaacggttccggggaacgggtaaccgggaccctaacggtccgtaccggtacccggttaccggttacgggaccgtaacccggcccggaaaccggtcccgtacccccgg

SEQ ID NO: 204756 - DNA, 626 bp, Homo sapiens
  misc_feature: GYAE6OF01BCB8K.44.12.B01.1.454.CMB.1.raw
  modified_base (613)..(613): a, c, t, g, unknown or other
  misc_feature (613)..(613): n is a, c, g, or t
tcagacagtatatacacgaccggtgctcgatttagtagtgtagatttgaggtttgggggggcacaagaggcagcactcaggacaatctccagcatggcctggtctcctctcctcctcactctcctcgctcactgcacgagggtcctgggcccactctgtgctgacgcagcccgccctcagtgtcgtgggtctccgtggacagtcgatcaccatcctcctgccacgtcgggtccagacaatgactagttgggagtaattaacttaaccttcgttcctccgttaggtataccaaaccaacactaccgaacggaaccaaacccgacccccaaactctaacgtttacttttcgactcgagtgacgaccgtaccgtacgtaggttcgtttactaacgtcgtccttctcgtcgtcctacctacgtcgtcggcccaccgacccgtcctcccgtgtccgtacttcgtcgtccggtccgtcccggtcgtgggacgacgcggtctagtacttatcgtcgcgtctactacttactacgttcgtagtacgttcggttgggtacggtcggacggtacggtccacgtccgtaccgtccgtacgtagtccgacgacccgtaggtcccncccgtcccgtccg

SEQ ID NO: 204757 - DNA, 645 bp, Homo sapiens
  misc_feature: GYAE6OF01DQAH6.44.12.B01.1.454.CMB.1.raw
  modified_base (154)..(154): a, c, t, g, unknown or other
  misc_feature (154)..(154): n is a, c, g, or t
  modified_base (172)..(172): a, c, t, g, unknown or other
  misc_feature (172)..(172): n is a, c, g, or t
  modified_base (198)..(198): a, c, t, g, unknown or other
  misc_feature (198)..(198): n is a, c, g, or t
  modified_base (222)..(222): a, c, t, g, unknown or other
  misc_feature (222)..(222): n is a, c, g, or t
  modified_base (257)..(257): a, c, t, g, unknown or other
  misc_feature (257)..(257): n is a, c, g, or t
  modified_base (273)..(273): a, c, t, g, unknown or other
  misc_feature (273)..(273): n is a, c, g, or t
  modified_base (403)..(403): a, c, t, g, unknown or other
  misc_feature (403)..(403): n is a, c, g, or t
tcagacagtatatacacgaccggtgctcgatttagtagtgtagattccgcgggggtagctcaggaagcagagcctggagcatctccactatggcctgggctccactacttctcaccctctcgctcactgcacaggttcttgggccaattttacngctgactccacccccctntgtgtccggagtccgtaccggggaanacggtaaccatctcctgcacccgnacgcactggcacgctattcgccagtcaacgtttgngacgagtcggtaaccnggaccaggcccggcccgggctaacgtccgcccccgacaccgttgtgaacttcgtagtcggagacctaacccaacgtcccgtcgtcgggtaccctgtacgttcggtctcgtcgtacctccgaagtccgacncgtcctcctaccagtcctcgtccctccctacacctactcctcgtacgtacgtaggaacgtacgacggacggaacggtcggtacctacgtaaccgttactacgtttacgtacttacgtttacttagtaggtaattacgacacgtaacaactcgaacgttggtaggttccgttaggggcggtaacggaccgacgtccgtacgaccgttacgtacgaccgtacgacccgtaacggtcctacccgg

SEQ ID NO: 204758 - DNA, 439 bp, Homo sapiens
  misc_feature: GYAE6OF01CB5SU.44.12.B01.1.454.CMB.1.raw
  modified_base (183)..(183): a, c, t, g, unknown or other
  misc_feature (183)..(183): n is a, c, g, or t
  modified_base (273)..(273): a, c, t, g, unknown or other
  misc_feature (273)..(273): n is a, c, g, or t
  modified_base (390)..(390): a, c, t, g, unknown or other
  misc_feature (390)..(390): n is a, c, g, or t
  modified_base (399)..(399): a, c, t, g, unknown or other
  misc_feature (399)..(399): n is a, c, g, or t
  modified_base (403)..(439): a, c, t, g, unknown or other
  misc_feature (403)..(439): n is a, c, g, or t
tcagacagtatatacacgaccggtgctcgatttagtagtgtagattccgcgggggggccgattcaccatctccagagacaattcgaagaacacactatatctggaaatgaatagcctgagagccgaggacacggctgtctactactgtgcgagagatgggggctcggtggatacagatatganatgctctactcaatggtatggacgccgtggggccaaagggaccacggtcgccgtctcctcagcctccacaaggcccatcggtcttccccngcacctgctcaggacgcacctcgtggggcacgacgccggccctgggactgccgtggtcaaggtacttacttcctatactacgtgtacgtgacggcgggctagggcaaagggccgaanagtaggcancgtnnnnnnnnnnnnnnnnnnnnnnnnnnnnnnnnnnnnn

SEQ ID NO: 204759 - DNA, 376 bp, Homo sapiens
  misc_feature: GYAE6OF02FS4B0.44.12.B01.1.454.CMB.1.raw
  modified_base (375)..(376): a, c, t, g, unknown or other
  misc_feature (375)..(376): n is a, c, g, or t
tcagacagtatatacacgaccggtgctcgatttagtagtgtagattccgcgggggccgattcaccatctccagagacaattcgaagaacacactatatctggaaatgaatagcctgagagccgaggacacggctgtctactactgtgcgagagatggggctcgtggatacagatatgacatgctctactccaatggtatggacgcctggggccaagggaccacggtcgccgtctcctcagcctccaccaagggcccatcggtcttccccctggcaccctgctccaggagcacctctgggggcacagcggccctgggctgcctggtcaaggactacttcctatatactgtctgagcgggctggcaaggcgcatagnn

SEQ ID NO: 204760 - DNA, 378 bp, Homo sapiens
  misc_feature: GYAE6OF02IKRAO.44.12.B01.1.454.CMB.1.raw
  modified_base (375)..(378): a, c, t, g, unknown or other
  misc_feature (375)..(378): n is a, c, g, or t
tcagacagtatatacacgaccggtgctcgatttagtagtgtagattccgcgggggccgattcaccatctccagagacaattcgaagaacacactatatctggaatgaatagcctgagagccgaggacacggctgtctactactgtgcgagagatggggctcgtggatacagatatgacatgctctactccaatggtatggacgcctggggccaagggaccacggtcgccgtctcctcagcctccaccaagggcccatcggtcttccccctggcaccctcctccaagagcacctctggggggcacagcggccctggggctgcctggtcaaggctacttcctatatactgtctgagcgggctggcaaggcgcatagnnnn

SEQ ID NO: 204761 - DNA, 378 bp, Homo sapiens
  misc_feature: GYAE6OF02HK8OZ.44.12.B01.1.454.CMB.1.raw
  modified_base (374)..(378): a, c, t, g, unknown or other
  misc_feature (374)..(378): n is a, c, g, or t
tcagacagtatatacacgaccggtgctcgatttagtagtgtagattccgcgggggccgattcaccatctccagagacaattcgaagaacacactatatctggaaatgaatagcctgagagccgaggacacggctgtctactactgtgcgagagatggggctcgtggatacagatatgacatgctctactccaatggtatggacgcctggggccaagggccacggtcgccgtctcctcagcctccaccaagggcccatcggtcttccccctggcaccctcctccaagagcacctctgggggcacagcggccctgggctgcctggtcaaggactacttcctcgatcgcgtctgagcgggctggcaaggcgcatagnnnnn

SEQ ID NO: 204762 - DNA, 379 bp, Homo sapiens
  misc_feature: GYAE6OF02HJMG2.44.12.B01.1.454.CMB.1.raw
  modified_base (375)..(379): a, c, t, g, unknown or other
  misc_feature (375)..(379): n is a, c, g, or t
tcagacagtatatacacgaccggtgctcgatttagtagtgtagattccgcgggggccgattcaccatctccagagacaattcgaagaacacactatatctggaaatgaatagcctgagagccgaggacacggctgtctactactgtgcgagagatggggctcgtggatacagatatgacatgctctactccaatggtatggacgcctggggccaagggaccacggtcgccgtctcctcagcctccaccaagggcccatcggtcttcccctggccaccctcctccaagagcacctctgggggcacagcggccctgggctgcctggtcaaggactacttcctatatactgtctgagcgggctggcaaggcgcatagnnnnn

SEQ ID NO: 204763 - DNA, 465 bp, Homo sapiens
  misc_feature: GYAE6OF02GXV9H.44.12.B01.1.454.CMB.1.raw
  modified_base (294)..(294): a, c, t, g, unknown or other
  misc_feature (294)..(294): n is a, c, g, or t
  modified_base (363)..(363): a, c, t, g, unknown or other
  misc_feature (363)..(363): n is a, c, g, or t
  modified_base (439)..(439): a, c, t, g, unknown or other
  misc_feature (439)..(439): n is a, c, g, or t
  modified_base (445)..(465): a, c, t, g, unknown or other
  misc_feature (445)..(465): n is a, c, g, or t
tcagacagtatatacacgaccggtgctcgatttagtagtgtagatttgagtttgggggctgttcctggaaggtgttggtaccagagggtcaccatctcctgcacctgggagcagatccgaacatcgggacagattctgatgtccactggtaccaacaccttccaggaacagcccccaaactcctcatctttggtaacaactatcggcctcagggtccctgaccgattctctggctccaagtctggcacctcagcctcctggccatcactgggctccaggctgaagatgagggtnattattactgccagtcctatgacagcagcctcagtggtggtgttcggcgagggaccaagctgaccgtcngggtcagcccaaggctgcccctggcactctcgttcccaccctcctctatactactgtctgagcggctggcaaggcncatagnnnnnnnnnnnnnnnnnnnnn

SEQ ID NO: 204764 - DNA, 279 bp, Homo sapiens
  misc_feature: GYAE6OF02G53LO.44.12.B01.1.454.CMB.1.raw
  modified_base (247)..(279): a, c, t, g, unknown or other
  misc_feature (247)..(279): n is a, c, g, or t
tcagacagtatatacacgaccggtgctcgatttagtagtgtagatttgggtttaggggtggcccaagctagctggacgggcacggttcaaccacgggtccaccggtctcctcagcttccaccaagggcccatcggtcttcccctggcgcctgctcaggagcacctctggggcacagcggccctgggcctgcctggtcaaggctacttcctatatacgtgtctgagcgggctggcgaaggcgcatagnnnnnnnnnnnnnnnnnnnnnnnnnnnnnnnnn

SEQ ID NO: 204765 - DNA, 274 bp, Homo sapiens
  misc_feature: GYAE6OF02GBRK6.44.12.B01.1.454.CMB.1.raw
  modified_base (246)..(274): a, c, t, g, unknown or other
  misc_feature (246)..(274): n is a, c, g, or t
tcagacagtatatacacgaccggtgctcgatttagtagtgtagatttaggggtttgggtgcccaagctgctggagggcacggtcaccacggtcaccgtctccgtccagcttccaccaagggcccgatccggtcttccccctggcgccctgctcaggagcacctctgggggcacacgcggccctgggcctgcctggtcaaggcctacttccacgtctactgctggagcgggctggcaaggcgcatgnnnnnnnnnnnnnnnnnnnnnnnnnnnnn

SEQ ID NO: 204766 - DNA, 191 bp, Homo sapiens
  misc_feature: GYAE6OF02HPXWR.44.12.B01.1.454.CMB.1.raw
  modified_base (189)..(191): a, c, t, g, unknown or other
  misc_feature (189)..(191): n is a, c, g, or t
tcagacagtatatacacgaccggtgctcgatttagtagtgtagatttgggtttgtgggaggtgtgtcacaagatttgggctctgggcaccgtgggcacggggaggtgtgtcacaagatttgggccctgggctgcctggtcaaggactacttcctatatactgtctgagcgggctggcaaggcgcatagnnn

SEQ ID NO: 204767 - DNA, 560 bp, Homo sapiens
  misc_feature: GYAE6OF02GHHM5.44.12.B01.1.454.CMB.1.raw
  modified_base (268)..(268): a, c, t, g, unknown or other
  misc_feature (268)..(268): n is a, c, g, or t
  modified_base (270)..(271): a, c, t, g, unknown or other
  misc_feature (270)..(271): n is a, c, g, or t
  modified_base (275)..(275): a, c, t, g, unknown or other
  misc_feature (275)..(275): n is a, c, g, or t
  modified_base (278)..(278): a, c, t, g, unknown or other
  misc_feature (278)..(278): n is a, c, g, or t
  modified_base (282)..(282): a, c, t, g, unknown or other
  misc_feature (282)..(282): n is a, c, g, or t
  modified_base (284)..(284): a, c, t, g, unknown or other
  misc_feature (284)..(284): n is a, c, g, or t
  modified_base (288)..(288): a, c, t, g, unknown or other
  misc_feature (288)..(288): n is a, c, g, or t
  modified_base (293)..(293): a, c, t, g, unknown or other
  misc_feature (293)..(293): n is a, c, g, or t
  modified_base (296)..(296): a, c, t, g, unknown or other
  misc_feature (296)..(296): n is a, c, g, or t
  modified_base (299)..(299): a, c, t, g, unknown or other
  misc_feature (299)..(299): n is a, c, g, or t
  modified_base (304)..(304): a, c, t, g, unknown or other
  misc_feature (304)..(304): n is a, c, g, or t
  modified_base (308)..(309): a, c, t, g, unknown or other
  misc_feature (308)..(309): n is a, c, g, or t
  modified_base (318)..(318): a, c, t, g, unknown or other
  misc_feature (318)..(318): n is a, c, g, or t
  modified_base (332)..(332): a, c, t, g, unknown or other
  misc_feature (332)..(332): n is a, c, g, or t
  modified_base (338)..(338): a, c, t, g, unknown or other
  misc_feature (338)..(338): n is a, c, g, or t
  modified_base (342)..(342): a, c, t, g, unknown or other
  misc_feature (342)..(342): n is a, c, g, or t
  modified_base (406)..(406): a, c, t, g, unknown or other
  misc_feature (406)..(406): n is a, c, g, or t
  modified_base (408)..(408): a, c, t, g, unknown or other
  misc_feature (408)..(408): n is a, c, g, or t
tcagacagtatatacacgaccggtgctcgatttagtagtgtagatttggtttcgggtgggcccaagcgtggctggagggcacggtcaccgacggtcaccgtctcctcgacgcgttccaccaagggcccactccggtcttcccctcggccgccctagctccgaggacgcgacctcgtcggggctacagccggccctgggctggcctcggtccaacggtccgtacttcctagtactactgtctgacgcggctcggcaagcgcgactagcngnngtgngtntatntnctcngacanacncgngcacnccannatgatgcgngtcacgtacgcgcngcgtcngacncgctctctcgctcacgtcgcgacgacgacgcctccgtcgtcgtcgtcgtcgcgtcgcgcgtcgngngtgacgcgtacgtagtacgtacgtcgcgacgtctactacgtacgaggaggacgacgtacgtacgttacgttcggtcggtacggacggacgacgtcgtacgtcgtacgtacgtacgtacgacgacgtcgtccgtccgtccgtaccgtacgtcg

SEQ ID NO: 204768 - DNA, 411 bp, Homo sapiens
  misc_feature: GYAE6OF02I1PI0.44.12.B01.1.454.CMB.1.raw
  modified_base (385)..(411): a, c, t, g, unknown or other
  misc_feature (385)..(411): n is a, c, g, or t
tcagacagtatatacacgaccggtgctcgatttagtagtgtagattccgcggggggccgattcaccatctccagagacaattcgaagaacacactatatctggaaatgaatagcctgagagccgaggacacggctgtcctactattgtgcgagagatggggctcgtggatacagatatgacatgctctactccaatggtatggacgcctgggggccaagggaccacgggtcgccgtctcctcagcctccaccaaggccccatcggtcttccccctggccaccctccctccaacgagcaccctctgggggcacagccggccctgggcctgcctggtcaaggactacttctatactactgtctgagcggctggcaaggcgcatacgnnnnnnnnnnnnnnnnnnnnnnnnnnn

SEQ ID NO: 204769 - DNA, 388 bp, Homo sapiens
  misc_feature: GYAE6OF02I9Y9W.44.12.B01.1.454.CMB.1.raw
  modified_base (375)..(388): a, c, t, g, unknown or other
  misc_feature (375)..(388): n is a, c, g, or t
tcagacagtatatacacgaccggtgctcgatttagtagtgtagattccgcgggggccgattcaccatctccagagacaattcgaagaacacactatatctggaaatgaatagcctgagagccgaggacacggctgtctactactgtgcgagagatggggctcgtggatacagatatgacatgctctactccaatggtatggacgcctgggggccaagggaccacggtcgccgtctcctcagcctccaccaagggcccatcggtcttccccctggccaccctcctccaagagcacctctggggcacagcggccctgggctgcctggtcaaggactactccacgtctactgctgagcggctggcaaggcgcatagcnnnnnnnnnnnnnn

SEQ ID NO: 204770 - DNA, 577 bp, Homo sapiens
  misc_feature: GYAE6OF02H571B.44.12.B01.1.454.CMB.1.raw
  modified_base (544)..(544): a, c, t, g, unknown or other
  misc_feature (544)..(544): n is a, c, g, or t
  modified_base (548)..(548): a, c, t, g, unknown or other
  misc_feature (548)..(548): n is a, c, g, or t
  modified_base (552)..(552): a, c, t, g, unknown or other
  misc_feature (552)..(552): n is a, c, g, or t
  modified_base (557)..(557): a, c, t, g, unknown or other
  misc_feature (557)..(557): n is a, c, g, or t
  modified_base (560)..(561): a, c, t, g, unknown or other
  misc_feature (560)..(561): n is a, c, g, or t
  modified_base (563)..(568): a, c, t, g, unknown or other
  misc_feature (563)..(568): n is a, c, g, or t
  modified_base (570)..(576): a, c, t, g, unknown or other
  misc_feature (570)..(576): n is a, c, g, or t
tcagacagtatatacacgaccggtgctcgatttagtagtgtagatttgagtttagggggggctgttcctggaaggtgttggtaccagagggtcaccatctcctgcactaggagcagatccaacatcgggacagattctgtatgtccactggtacctaaccacctttccaggaactagccccccaaactccctcatctttggtaacaactatcggcctcgaggggtccctggaccgattctctggctccgaagtctggcacctcagcctcctggccatcacgtgggcctccaggctgaagtatggagggtgattattactgccagtcctatcgacagcgagccgtcgaggttgggttggggtgtttcgggcggacgggtaaccaaggctggaccgtcgtaggggtcacgtacccgaaggtcctacgtccccccgtcggtacctacgtcccgttcgttaccccccacccttccttacttacttactacgttcgttcccgtaggtacggtccgggcttgggaccgtaaagggccgactaagttacgnctgnatgntacgncgnngnnnnnncnnnnnnnc

SEQ ID NO: 204771 - DNA, 598 bp, Homo sapiens
  misc_feature: GYAE6OF02HO8A4.44.12.B01.1.454.CMB.1.raw
  modified_base (169)..(169): a, c, t, g, unknown or other
  misc_feature (169)..(169): n is a, c, g, or t
  modified_base (215)..(215): a, c, t, g, unknown or other
  misc_feature (215)..(215): n is a, c, g, or t
  modified_base (244)..(244): a, c, t, g, unknown or other
  misc_feature (244)..(244): n is a, c, g, or t
  modified_base (269)..(269): a, c, t, g, unknown or other
  misc_feature (269)..(269): n is a, c, g, or t
  modified_base (445)..(445): a, c, t, g, unknown or other
  misc_feature (445)..(445): n is a, c, g, or t
tcagacagtatatacacgaccggtgctcgatttagtagtgtagattccgcggggagctcaggaagcagagcctggagcatctccactatggcctgggctccactacttctcaccctcctcgctcactgcacaggttcttgggccaattttatgctgactcacccccctntgtgtcggagtctccggggaagacggtaaccatctcctgcacccgnagcactggcagcattgccagcaactttgngcagtggtaccagcagcgcccgggnagtcgccccccacactgtgatctatgaggataccccaacgccctcgtcggggtaccctggtactcggttctcgttggctccatccgacacgcctcctaccgaacttcctcgcccctccctcaccctatcctctggactgaatactggaggacgaggcctaggacctaacgttacgngttacaggttcttacgtgtaactagctaacgactaaacgtcaagttggtaggttacgttccgggacgggtaacgggtaccccaaaggtccgttaccgggacccgttccgttacgggtccaacggtaccccggtaagggtcccttacccccggg

SEQ ID NO: 204772 - DNA, 504 bp, Homo sapiens
  misc_feature: GYAE6OF02FXZQZ.44.12.B01.1.454.CMB.1.raw
  modified_base (434)..(434): a, c, t, g, unknown or other
  misc_feature (434)..(434): n is a, c, g, or t
tcagacagtatatacacgaccggtgctcgatttagtagtgtagattccgcgggggtagctcaggaagcagagcctggagcatctccactatggcctgggctccactacttctcaccctcctcgctcactgcacaggttcttgggccaattttatgctgactcacccccctctgtgtcggagtctccggggaagacggtaaccatctcctgcacccgcagcactggcagcattgccagcaactttgtgcagtggtaccagcagcgcccgggcagtgccccccacactgtgatctatgaggataccccaaacgaccctcgtggggtcccctgactcggttctctggctccatcgacagctcctccaactctcgccctccctcaccatctctggactgaagactgaggacgaggctgactactactgtcagtcttangatagcagcaatcatgtgtagttcggaggacggaccaggcctgaccgtcaggtccagcccaggcctaccg

SEQ ID NO: 204773 - DNA, 389 bp, Homo sapiens
  misc_feature: GYAE6OF02IJECG.44.12.B01.1.454.CMB.1.raw
  modified_base (380)..(389): a, c, t, g, unknown or other
  misc_feature (380)..(389): n is a, c, g, or t
tcagacagtatatacacgaccggtgctcgatttagtagtgtagattccgcggggggccgattcaccatctccagagacaattcgaagaacacactatatctggaaatgaatagcctgagagccgaggacacggctgtctactactgtgcgagagatggggctcgtggatacagatatgacatgctctactccaatggtatggacgcctggggccaagggaccacggtcgccgtctcctcagcctccaccaagggcccatcggtcttccccctggccacccctcctccaagacgcacctcgtggggcacgagcggccctgggctgcctggtcaaggactacttccacgtctactgctgagcgggctggcaaggcgcatagnnnnnnnnnn

SEQ ID NO: 204774 - DNA, 466 bp, Homo sapiens
  misc_feature: GYAE6OF02G0GVS.44.12.B01.1.454.CMB.1.raw
  modified_base (286)..(286): a, c, t, g, unknown or other
  misc_feature (286)..(286): n is a, c, g, or t
  modified_base (318)..(318): a, c, t, g, unknown or other
  misc_feature (318)..(318): n is a, c, g, or t
  modified_base (451)..(451): a, c, t, g, unknown or other
  misc_feature (451)..(451): n is a, c, g, or t
  modified_base (458)..(466): a, c, t, g, unknown or other
  misc_feature (458)..(466): n is a, c, g, or t
tcagacagtatatacacgaccggtgctcgatttagtagtgtagatttgagtttgggggctgttcctggaaggtgttggtaccagagggtcaccatctcctgcactgggagcagatccaacatcgggacagattctgatgtccactggtaccaacaccttccaggaacagcccccaaactcctcatcttggtaacaactatcggccctcaggggtccctgaccgattctctggctccaagtctggcacctcagcctccctggccatcactgggctccaggctgaagntgagggtgattattactgccagtcctatgacngcagcctgagtggtgggtgttcggcggagggaccaagctgaccgtcgtgggtcagcccgaaggctcgcccctcggtcactctcgttccccgcctcctctactactactcgtctgcggccgggctggcacggcncgatagnnnnnnnnn

SEQ ID NO: 204775 - DNA, 393 bp, Homo sapiens
  misc_feature: GYAE6OF02J0HPQ.44.12.B01.1.454.CMB.1.raw
  modified_base (303)..(303): a, c, t, g, unknown or other
  misc_feature (303)..(303): n is a, c, g, or t
  modified_base (384)..(393): a, c, t, g, unknown or other
  misc_feature (384)..(393): n is a, c, g, or t
tcagacagtatatacacgaccggtgctcgatttagtagtgtagattccgcgggggccgattcaccatctccagagacaattcgaagaacacactatatctggaaatgaatagcctgagagccgaggacacggctgtctactactgtgcgagagatggggctcgtggatacagatatgacatgctctactccaatggtatggacgcctgggggccaaggggacccacgggtccgccgtctcctcagccctccaccaagggcccatcggtcttccccctggccaccctcctccaagagcacctcnggggcacgagcggccctgggcctgccgtggtcaacggactactcctatactactgtctgagcgggctggcaggcgcatagnnnnnnnnnn

SEQ ID NO: 204776 - DNA, 284 bp, Homo sapiens
  misc_feature: GYAE6OF02HO5X7.44.12.B01.1.454.CMB.1.raw
  modified_base (261)..(261): a, c, t, g, unknown or other
  misc_feature (261)..(261): n is a, c, g, or t
  modified_base (267)..(284): a, c, t, g, unknown or other
  misc_feature (267)..(284): n is a, c, g, or t
tcagacagtatatacacgaccggtgctcgatttagtagtgtagattccgcgggaaagaaacagctggtttctgtattataagtcttaccatctggacgtctggggcaaagggaccacggtcaccgtctcctcagcttccaccaagggcccatcggtcttccccctggcgccctgctccaggagcacctctgggggcacagcggccctgggctgcctggtcaaggctacttccacgtctactgctgagcgggctggcaggcncatagnnnnnnnnnnnnnnnnnn

SEQ ID NO: 204777 - DNA, 492 bp, Homo sapiens
  misc_feature: GYAE6OF02JLQZW.44.12.B01.1.454.CMB.1.raw
  modified_base (311)..(311): a, c, t, g, unknown or other
  misc_feature (311)..(311): n is a, c, g, or t
  modified_base (435)..(435): a, c, t, g, unknown or other
  misc_feature (435)..(435): n is a, c, g, or t
  modified_base (438)..(438): a, c, t, g, unknown or other
  misc_feature (438)..(438): n is a, c, g, or t
  modified_base (440)..(441): a, c, t, g, unknown or other
  misc_feature (440)..(441): n is a, c, g, or t
  modified_base (445)..(446): a, c, t, g, unknown or other
  misc_feature (445)..(446): n is a, c, g, or t
  modified_base (450)..(454): a, c, t, g, unknown or other
  misc_feature (450)..(454): n is a, c, g, or t
  modified_base (457)..(457): a, c, t, g, unknown or other
  misc_feature (457)..(457): n is a, c, g, or t
  modified_base (459)..(492): a, c, t, g, unknown or other
  misc_feature (459)..(492): n is a, c, g, or t
tcagacagtatatacacgaccggtgctcgatttagtagtgtagattccgcggggggccgattcaccatctccagagacaattcgaagaacacactatatctggaaatgaatagcctgagagccgaggacacggctgtctactattgtgcgagagatggggctcgtggatacgagatatgacatgctctactccaatggtactgggaccgcctgggggcctaaggggacccacgggtcgccgtctcctcagcctccaccgaagggccccatcggtcttcccccgtggccacccctcctccaacgagccaccncgtcgggggcacgacgccgggccctcgggactcgcccgtggtaccaacgggtacctaacgttccctaagtctaacgtcgtctcggagtacgggcgttggccaaaggtccggcaagttcgatcgnacncnncganngtgnnnnngancnnnnnnnnnnnnnnnnnnnnnnnnnnnnnnnnnn

SEQ ID NO: 204778 - DNA, 592 bp, Homo sapiens
  misc_feature: GYAE6OF02FJUHN.44.12.B01.1.454.CMB.1.raw
  modified_base (272)..(272): a, c, t, g, unknown or other
  misc_feature (272)..(272): n is a, c, g, or t
  modified_base (387)..(387): a, c, t, g, unknown or other
  misc_feature (387)..(387): n is a, c, g, or t
  modified_base (398)..(398): a, c, t, g, unknown or other
  misc_feature (398)..(398): n is a, c, g, or t
  modified_base (423)..(423): a, c, t, g, unknown or other
  misc_feature (423)..(423): n is a, c, g, or t
  modified_base (449)..(449): a, c, t, g, unknown or other
  misc_feature (449)..(449): n is a, c, g, or t
  modified_base (458)..(458): a, c, t, g, unknown or other
  misc_feature (458)..(458): n is a, c, g, or t
tcagacagtatatacacgaccggtgctcgatttagtagtgtagattccgcggggagctcaggaagcagagcctggagcatctccactatggcctgggctccactacttctcaccctcctcgctcactgcacaggttcttgggccaattttatgctgactcaccccccctctgtgtcggagtctccggggaagacggtaaccatctcctgcacccgcagcactggcagcattgccagctaactttgtgcagtggtaccagcagccgcccgggnagtcgccccccacactgtgatcatgaggactaccccaacgacccctcgtcggggtccctggacttcgggttctcttggcctccatccgacagctcctccaactctcgccctcccncacctatcctnggacctgaaacgactggaggaccgnggcttcgaaccttactactcgtaacngttcttaangtagtgacgagtaccaattcgaagtcggttaggtacgttccggggacgggtaacgggaaccctaagggtccttaacggacccggtttaccgtagggttacccaccggtaccccgaagggtcccttacccccggg

SEQ ID NO: 204779 - DNA, 593 bp, Homo sapiens
  misc_feature: GYAE6OF02HUQQF.44.12.B01.1.454.CMB.1.raw
  modified_base (287)..(287): a, c, t, g, unknown or other
  misc_feature (287)..(287): n is a, c, g, or t
  modified_base (295)..(295): a, c, t, g, unknown or other
  misc_feature (295)..(295): n is a, c, g, or t
  modified_base (559)..(559): a, c, t, g, unknown or other
  misc_feature (559)..(559): n is a, c, g, or t
  modified_base (564)..(564): a, c, t, g, unknown or other
  misc_feature (564)..(564): n is a, c, g, or t
  modified_base (566)..(566): a, c, t, g, unknown or other
  misc_feature (566)..(566): n is a, c, g, or t
  modified_base (568)..(568): a, c, t, g, unknown or other
  misc_feature (568)..(568): n is a, c, g, or t
  modified_base (571)..(571): a, c, t, g, unknown or other
  misc_feature (571)..(571): n is a, c, g, or t
  modified_base (574)..(575): a, c, t, g, unknown or other
  misc_feature (574)..(575): n is a, c, g, or t
  modified_base (577)..(580): a, c, t, g, unknown or other
  misc_feature (577)..(580): n is a, c, g, or t
  modified_base (582)..(583): a, c, t, g, unknown or other
  misc_feature (582)..(583): n is a, c, g, or t
  modified_base (586)..(592): a, c, t, g, unknown or other
  misc_feature (586)..(592): n is a, c, g, or t
tcagacagtatatacacgaccggtgctcgatttagtagtgtagatttaggagtttgggggctgttcctggaaggtgttggtaccagagggtcaccatctcctgcactgggagcagatccaacatcgggacagattctgatgtccactggtaccaacaccttccaggaacagcccccaaaatcctcatctttggtaacaactatcggccctcaggggtccctgaccgattttcgtgctccaagtctggcacctcagcctcctgccatcacgtggctccaggctgaagntgagggtnattatactgccagttcctagtcggacagtcagccctgagttggttaggtgttcggcggacggaaccaagtctacggtaccgtcgtgggtaccacggtacccgaaaggccctaccggccccccgttcggtacccgtaactttccccgtaccggtttccccccgcccccttcccttaccgttaattaaccgtaaccgtttcggttccacgggtaccggtcgggtccgtacggaaccggtaacggtccgaacgtacgtaaggtcacntgacncncncangcnngnnnngnngcnnnnnnng

SEQ ID NO: 204780 - DNA, 574 bp, Homo sapiens
  misc_feature: GYAE6OF02HF7E3.44.12.B01.1.454.CMB.1.raw
  modified_base (170)..(170): a, c, t, g, unknown or other
  misc_feature (170)..(170): n is a, c, g, or t
  modified_base (246)..(246): a, c, t, g, unknown or other
  misc_feature (246)..(246): n is a, c, g, or t
  modified_base (397)..(397): a, c, t, g, unknown or other
  misc_feature (397)..(397): n is a, c, g, or t
tcagacagtatatacacgaccggtgctcgatttagtagtgtagattccgcggggagctcaggaagcagagcctggagcatctccactatggcctgggctccactacttctcaccctcctcgctcactgcacaggttcttgggccaattttatgctgactccacccccctntgtgtcggagtctccggggaagacggtaaccatcctcctgcacccgcagcactggcagcattgccagcaactttgngcagtcggtaccagcagcgcccggggcagtcgcccccacactgtgatctatggaggactaacctaacgaccctcgtcggggtccctggacttcggttctcgtggcctccatccgacagcctcctccaactctcgccctccctcaccatccncgtggactgaagctggacggacgaggctagactactactgtcagttcttatgatcgcagctaaatcaagttgtaggtacgttacggggacgggtaacgggaaccctaaggtcccgtacggtaacccggttcgtaacgggtcccaaccgggtaccccgtaacggtcccttaccccggg

SEQ ID NO: 204781 - DNA, 974 bp, Homo sapiens
  misc_feature: GYAE6OF02FR2QD.44.12.B01.1.454.CMB.1.raw
  modified_base (188)..(188): a, c, t, g, unknown or other
  misc_feature (188)..(188): n is a, c, g, or t
  modified_base (207)..(207): a, c, t, g, unknown or other
  misc_feature (207)..(207): n is a, c, g, or t
  modified_base (243)..(243): a, c, t, g, unknown or other
  misc_feature (243)..(243): n is a, c, g, or t
tcagacagtatatacacgaccggtgctcgatttagtagtgtagatttgaggtttgggggggcacaagaggcagcactcaggacaatctccagcatggcctggtctcctctcctcctcactctcctcgctcactgcacaggtcctgggcccactctgtgctgacgcagccgccctcagtgtctgggtcncctggacagtcgatcaccntctcctgcactgggtccagcaactgacagttcgganacgttataacccgttggtccttccctagggtactaccgaaaccaaccacttcccgaagggaccaaaaccgacccccgaaaacttcctaaacgtttaaccgtttttaacggacgttacccgaaagggtttcgaacggtaccccggtaacccggtttccggtaaacgggtttcggtttttacccgttaaaaccgtcccggttacccgttttccgttacccggttacggggtacccttaccccggtaaaaccggttccccgtaccggggtaccccccaaccggtaccccgggtcccccgttacccccgttcgtacccgggtaacttcccggttacccggttacgggggtccccgttaaccccggggtacccttaccgggaaacggggtaacccgggtaacgggttacccgttacggtaaacccttaacggtttacccgtaccgggtacccggggttacccttaccgttaaaccgtttttaaaccccgaaaccgttttacccggttttaacgggtaaaccggtttaacccgggttttgggggtttaccgggtttacccgggggtaacccgggggttaaccggggtaaccccgttaaccccggtaaccccgggttaccgggttaaccccccgggtttacccgttaacccggggtttaccccgtaacccgggtaaccccccggtaaacggggttccccccgtttaccccgggtacccccccccggttttacccgggg

SEQ ID NO: 204782 - DNA, 693 bp, Homo sapiens
  misc_feature: GYAE6OF02H9H94.44.12.B01.1.454.CMB.1.raw
  modified_base (370)..(370): a, c, t, g, unknown or other
  misc_feature (370)..(370): n is a, c, g, or t
tcagacagtatatacacgaccggtgctcgatttagtagtgtagattccgcgggggtagctcaggaagcagagcctggagcatctccactatggcctgggctccactacttctcaccctcctcgctcactgcacaggttcttgggccaattttatgctgactcaccccccctctgtgtcggagtcgtccggggagacggtaaccatcctcctgccacccgcagcactggcagcattgccagctaactttgtcgcagttcggtaccaggcaggccgcccgggcaggtccgccccccacactgcgatctagtcggaggactaccccaacgccctcgtcggggtccctgactcggttctcgtcgctcatcgacncgctcctacactcgccgcctccctacacctatcctcgtggtaactaggtaaacgcgtaggaacgggacgaggtccttacgtaaccttacgtacgttcggtactaacgtttcgttagtacgtactacgcgaacgtaacctaacgttccgtaagtttacggggttaggtttaacccgggtttaccgggggacggggggtaaacccgggtaacccgtaaagggtcccccgttttaacgggaacccccgggttttacccgtaaacgggggttcccccgaaaccgggttaccccccgttaacgggggtccccttaccccccccggggg

SEQ ID NO: 204783 - DNA, 571 bp, Homo sapiens
  misc_feature: GYAE6OF02F0XLF.44.12.B01.1.454.CMB.1.raw
  modified_base (171)..(171): a, c, t, g, unknown or other
  misc_feature (171)..(171): n is a, c, g, or t
  modified_base (246)..(246): a, c, t, g, unknown or other
  misc_feature (246)..(246): n is a, c, g, or t
  modified_base (268)..(268): a, c, t, g, unknown or other
  misc_feature (268)..(268): n is a, c, g, or t
  modified_base (380)..(380): a, c, t, g, unknown or other
  misc_feature (380)..(380): n is a, c, g, or t
  modified_base (462)..(462): a, c, t, g, unknown or other
  misc_feature (462)..(462): n is a, c, g, or t
tcagacagtatatacacgaccggtgctcgatttagtagtgtagattccgcgggggtagctcaggaagcagagcctggagcatctccactatggcctgggctccactacttctcaccctcctcgctcactgcacaggttcttgggccaattttatgctgactcacccccctntgtcgtcggagtctccggggaagacggtaaccatctcctgcaccgcagcactggcagcattgccagcaactttgncagtgaccagcagccgcccggnagtcgccccccacactcgtgattctatgaggactaaccccgaacgaccctcgtcggggtcccctgtactcggttctcgtggccttccatcgacacgtctccctcaaacgtcncgtccctccctacgacctacgtcctctcgggacctaggaagacctggaggtacgaggctagacctagtactgtcagttctangatgctagactaatcaagtgtaggtttacgccgggaaggtaacgggaacccaagggtccctcggaacccggttcctaggtaccgaccgtcccgaacggtccttacccgg

SEQ ID NO: 204784 - DNA, 801 bp, Homo sapiens
  misc_feature: GYAE6OF02H277Q.44.12.B01.1.454.CMB.1.raw
  modified_base (170)..(170): a, c, t, g, unknown or other
  misc_feature (170)..(170): n is a, c, g, or t
  modified_base (684)..(684): a, c, t, g, unknown or other
  misc_feature (684)..(684): n is a, c, g, or t
  modified_base (726)..(726): a, c, t, g, unknown or other
  misc_feature (726)..(726): n is a, c, g, or t
tcagacagtatatacacgaccggtgctcgatttagtagtgtagattccgcgggagctcaggaagcagagcctggagcatctccactatggcctgggctccactacttctcaccctcctcgctcactgcacaggttcttgggccaattttatgctgactccaccccccctntgtcgtcggacgtcgtccggggaagaccggtaaccattcctcctgccacccgcagccacgtcggccaggtccagttcgacccaggaccttaacgttttcgtacgtccgaggttcgggttaaccacggaccgacggccggccccggggacgtaaggttccccggacccccccaacccgtacgttaccggtcgtacgtacccgttaagttacgggaggtaacctaacccccgtaaaccgcccccgttacggtccgggggttaccccttcgtacggtttacccggttccgttaccggtcgtaccgtcccgtaacgtaccgtacgaacccggtctaccccggtacctaaacctttcccgtacccgtccccgtttcccctacctaacccttctcccgtttccggcgtaacgttccgggaaacgttacgacgggaacggacggtaccgtagttaccggtaaccttacgttccgtagttaccgacgtttcgttaagttcgaacgttacgtacgacgttaanaactttcgaaagttggttacgtacggttcggggtaacccggngggaaaccctgggtacctaccgtaccggttacggtacggttaccgaaccgtacccggtacggcccgttaccccgg

SEQ ID NO: 204785 - DNA, 586 bp, Homo sapiens
  misc_feature: GYAE6OF02H2RK1.44.12.B01.1.454.CMB.1.raw
  modified_base (258)..(258): a, c, t, g, unknown or other
  misc_feature (258)..(258): n is a, c, g, or t
  modified_base (565)..(566): a, c, t, g, unknown or other
  misc_feature (565)..(566): n is a, c, g, or t
  modified_base (568)..(586): a, c, t, g, unknown or other
  misc_feature (568)..(586): n is a, c, g, or t
tcagacagtatatacacgaccggtgctcgatttagtagtgtagatttgggtgtgagctggatccgtcagcccccagggaaggccctggagtggcttgcacacatcttctcgaatgacgaaaaatcctacagtacatctctgaagagcagtttaaccatctccaaggacacctccaaaaggcaggtggtctttagtatgaccaacatggaccctgcggacacaggcacatattactgtgcaggttaatggacgggaaanaaacagctggtttctgtattataagtcttaccatctggacgtcgtggggcaaacggggccacggtcaccgtcctacctcgagcttcccaccgaacgggcccagtccggtccttcccccgtggccgcccctggcctccgacggcgccacccgtcgtcgggggccaccgacgggccggtccccgtggggcccgttcggcccttggggtaccgtaacgggtacccttaaccgtttcccgtaaccttccgtttaactcggccgttcggacggtcccggggcgttacgggcgaacggggcgcgaacgtagcnngnnnnnnnnnnnnnnnnnnn

SEQ ID NO: 204786 - DNA, 1045 bp, Homo sapiens
  misc_feature: GYAE6OF02HYATR.44.12.B01.1.454.CMB.1.raw
  modified_base (173)..(173): a, c, t, g, unknown or other
  misc_feature (173)..(173): n is a, c, g, or t
tcagacagtatatacacgaccggtgctcgatttagtagtgtagattccgcggggagctcaggaagcagagcctggagcatctccactatggcctgggctccactacttctcaccctcctcgctcactgcacaggttcttcgggcctaattttatcgctgactccacccccctntcgtcgtcggagtccgtaccggggaacgacggtaaccactccgttcctagccacccgtcgacgcctaccgttcgggaccgaggtacctagtttaccggaccacggaccttaaaccgttttcggtacggaccggtaacggttacgggttaacccagggacccgtaaccgggccgggacccccggggtactacgggttacccgaccccccccgtaaccgtaccgttagtacgggtaaaccttaccggttaaagttacggggaaacccgggtaacctttaaaacccccccggaaaccggttacccccgtttcggggtttaaccccggggggttaccccttagggttaacccggtttcccgggtttttaccgcccgtttccggggttacccttaaccgtaccgttacccggggtaaccttaccgggtccctttaccccgttaaccccgtaaacgtttccccggttacccggtcccccctttacccccggtttacctaaccccggttacgttaccccggtttaccggtaaccgggtaccgttaacgggtaaacggtacccgtacggggtaaaccgggtacggtaccggtacgtaaccgggttacccttaaacgtaccggtttccgtacgttaaccggttttacgttaaaccggtacggtaacgttaccgtaactaccgggttaactaaacgttccgttaagggtttcggggttacgtttaacccggggttttaaccggggaccgggggttaaaccgggttaaccccggaacgggtttacccgggttacccggtttaaacccccggggttcggtaaacccgggttccccggaaacccgggtaacccggggtacccgtaccccggtttaaccccccggg

SEQ ID NO: 204787 - DNA, 303 bp, Homo sapiens
  misc_feature: GYAE6OF02FP531.44.12.B01.1.454.CMB.1.raw
  modified_base (288)..(303): a, c, t, g, unknown or other
  misc_feature (288)..(303): n is a, c, g, or t
tcagacagtatatacacgaccggtgctcgatttagtagtgtagattccgcgggcatccggggtccctgaccgattcagcgccagcgggtctgggacagacttcgcactcaccatcaacggcctgcagggtgaagatcttgcaacttattactgtcagcagtattttgaaaggcccctcactttcggcggggggaccagggtggaactcagacgaactgtggctgcaccatctgtcttcatcttccgccatctgatattactgtctgagcggctggcaaggcgcatagnnnnnnnnnnnnnnnn

SEQ ID NO: 204788 - DNA, 467 bp, Homo sapiens
  misc_feature: GYAE6OF02F7Y4N.44.12.B01.1.454.CMB.1.raw
  modified_base (237)..(237): a, c, t, g, unknown or other
  misc_feature (237)..(237): n is a, c, g, or t
  modified_base (290)..(290): a, c, t, g, unknown or other
  misc_feature (290)..(290): n is a, c, g, or t
  modified_base (415)..(415): a, c, t, g, unknown or other
  misc_feature (415)..(415): n is a, c, g, or t
  modified_base (418)..(419): a, c, t, g, unknown or other
  misc_feature (418)..(419): n is a, c, g, or t
  modified_base (421)..(424): a, c, t, g, unknown or other
  misc_feature (421)..(424): n is a, c, g, or t
  modified_base (426)..(467): a, c, t, g, unknown or other
  misc_feature (426)..(467): n is a, c, g, or t
tcagacagtatatacacgaccggtgctcgatttagtagtgtagattccgcggggggccgattcaccatctccagagacaattcgaagaacacactatatctggaaatgaatagcctgagagccgaggacacggctgtctactactgtgcgagagatggggctcgtggatacagatatgacatgctctactccaatggtatggacgccgtggggcccaagggaccacggtcgccgtcncctcacgccctccaccaacggcccatcggtcttccccctggccaccccgtccnccaagacgcacctcgtgggggcacgacgccggcccgtgggcgtcgccgtggtccaaaggcctaacttccgtaatatacgtgtcctggacggtcgggcgtcggcgtaaggccggtaccaagtacgngcnngnnnngnnnnnnnnnnnnnnnnnnnnnnnnnnnnnnnnnnnnnnnnnn

SEQ ID NO: 204789 - DNA, 545 bp, Homo sapiens
  misc_feature: GYAE6OF02HO5MJ.44.12.B01.1.454.CMB.1.raw
  modified_base (489)..(489): a, c, t, g, unknown or other
  misc_feature (489)..(489): n is a, c, g, or t
  modified_base (493)..(493): a, c, t, g, unknown or other
  misc_feature (493)..(493): n is a, c, g, or t
  modified_base (498)..(498): a, c, t, g, unknown or other
  misc_feature (498)..(498): n is a, c, g, or t
  modified_base (504)..(545): a, c, t, g, unknown or other
  misc_feature (504)..(545): n is a, c, g, or t
tcagacagtatatacacgaccggtgctcgatttagtagtgtagattccgcggggggccgattcaccatctccagagacaattcgaagaacacactatatctggaaatgaatagcctgagagccgaggacacggctgtctactactgtgcgagagatggggctcgtggatacagatatgacatgctctactccaatggtatggacgccgtggggccaaagggaccacggtcgccgtctcctcacgcctaccaccaacgggccccaatccgggtccttcccccgtaggccaacccccgtcctaccgaagagacccaacccgtcgtcggggggccacgaggccggcccttcggggcctcggccgtcgggttaccgaaagggtaaccttacctttacccttaattaaccgttaccgttaggtttcccgttaggaaacgggtccccggggtatttccgggggaacgaaaccggggccggtaaccaagtaggganccgngaccnaagcannnnnnnnnnnnnnnnnnnnnnnnnnnnnnnnnnnnnnnnnn

SEQ ID NO: 204790 - DNA, 409 bp, Homo sapiens
  misc_feature: GYAE6OF02H884R.44.12.B01.1.454.CMB.1.raw
  modified_base (400)..(409): a, c, t, g, unknown or other
  misc_feature (400)..(409): n is a, c, g, or t
tcagacagtatatacacgaccggtgctcgatttagtagtgtagattccgcggggggccgattcaccatctccagagacaattcgaagaacacactatatctggaaatgaatagcctgagagccgaggacacggctgtctactactgtgcgagagatggggctcgtggatacagatatgacatgctctactccaatggtatggacgcctgggggccaaaggggccacgggtcgccgtctcctcagccctccaccaagggcccatcggtcttccccctggccacccctcctccaagacgcacctcgtgggggcacacggccggcccgtgggcctcgccgtggtcaaacggacttaccttcctaatatactgtctggagcgggcgtggcgaaggcacgatagnnnnnnnnnn

SEQ ID NO: 204791 - DNA, 683 bp, Homo sapiens
  misc_feature: GYAE6OF02IEZ1H.44.12.B01.1.454.CMB.1.raw
  modified_base (170)..(170): a, c, t, g, unknown or other
  misc_feature (170)..(170): n is a, c, g, or t
  modified_base (178)..(178): a, c, t, g, unknown or other
  misc_feature (178)..(178): n is a, c, g, or t
  modified_base (197)..(197): a, c, t, g, unknown or other
  misc_feature (197)..(197): n is a, c, g, or t
  modified_base (209)..(209): a, c, t, g, unknown or other
  misc_feature (209)..(209): n is a, c, g, or t
  modified_base (244)..(244): a, c, t, g, unknown or other
  misc_feature (244)..(244): n is a, c, g, or t
  modified_base (262)..(262): a, c, t, g, unknown or other
  misc_feature (262)..(262): n is a, c, g, or t
  modified_base (278)..(278): a, c, t, g, unknown or other
  misc_feature (278)..(278): n is a, c, g, or t
  modified_base (378)..(378): a, c, t, g, unknown or other
  misc_feature (378)..(378): n is a, c, g, or t
  modified_base (395)..(395): a, c, t, g, unknown or other
  misc_feature (395)..(395): n is a, c, g, or t
  modified_base (414)..(414): a, c, t, g, unknown or other
  misc_feature (414)..(414): n is a, c, g, or t
tcagacagtatatacacgaccggtgctcgatttagtagtgtagattccgcggggagctcaggaagcagagcctggagcatctccactatggcctgggctccactacttctcaccctcctcgctcactgcacaggttcgtggccgaatttagcgctagactccaccccctntgtgtcgngtcgtccgggagacgtacntctctgcaccgnacgcacgtggcagcagttcgccagctaacgtttgngacgagttcggaccagcncggccggccccggtanacggtccgacccccctacaccgttggtacgacttacctagacggacggtacctaaccccgaacgtccccttggtcggggtccctaggtcttcggtctcgnggtcctacgctacgacncgtcctacctctaacttcnccgtcccctacctccacctacttccgtcgtaccggtacctacggaaacgttccggagggaaaccggccgggtacggtccctaacggttacctaccgttacctgggttcctaggtttaaccttgttagtaacgaccgttaccgaagtaccttaaggtcttaagttgggttaacggtccggggttcggggaccgggtaaacgtacgtccggttccgacccggtttggaccggttaccgaccgaccgggtaacctcccggtcccgtccccgg

SEQ ID NO: 204792 - DNA, 321 bp, Homo sapiens
  misc_feature: GYAE6OF02G5AHA.44.12.B01.1.454.CMB.1.raw
  modified_base (302)..(321): a, c, t, g, unknown or other
  misc_feature (302)..(321): n is a, c, g, or t
tcagacagtatatacacgaccggtgctcgatttagtagtgtagatttgagtttggggggtgtggtggtctccactcccgccttgacggggctgctatctgcctccctggccatcactgggctccaggctgaagatgagggtgattattactgccagtcctatgacagcagcctcagtggttgggtgttcggcggagggaccaagctgaccgtcctgggtcagcccaaggctgccccctggtcactctgttccccacctcctctatattactgtctggacgcgggctggcaaggcgcaatagnnnnnnnnnnnnnnnnnnnn

SEQ ID NO: 204793 - DNA, 700 bp, Homo sapiens
  misc_feature: GYAE6OF02FSZF0.44.12.B01.1.454.CMB.1.raw
  modified_base (301)..(301): a, c, t, g, unknown or other
  misc_feature (301)..(301): n is a, c, g, or t
  modified_base (484)..(484): a, c, t, g, unknown or other
  misc_feature (484)..(484): n is a, c, g, or t
  modified_base (583)..(583): a, c, t, g, unknown or other
  misc_feature (583)..(583): n is a, c, g, or t
tcagacagtatatacacgaccggtgctcgatttagtagtgtagattccgcgggggtagctcaggaagcagagcctggagcatctccactatggcctgggctccactacttctcaccctcctcgctcactgcactaggttcttgggcctaattttatgctgactccacccccctctgtgtcggagtcgtccggggaagaccggtaaccatctcctgccacccgcacgcacgtggcagcattcgccagactaacgtttgtcgctaggttcggtaacccaggtcacggcccggaccccgggggntaccggtacccgcccccccaaccgtacgttcggtagtacgttacctagtacggaacggtaacctaaccccggaaaccgtccccgttacgggttccggggttaccctaggtccgtttaccggttcctcgttccggtcctaccgtactccgaacgacgtcccttaccctactaaccgtccgtccnccccttaccccataccctacgtcctcgtacgtactacggaacgacgtgggaacgacggcgtacgtacgtaccttacgttctacgtacacgtttctaacnggtaactacggacaacgtactatcgtagtgttacggtacggtacggacgggtaacggacaacggtccgtaccgtaccgttacgacggtaccgtaacgcccggtacgtccgtaccccg

SEQ ID NO: 204794 - DNA, 693 bp, Homo sapiens
  misc_feature: GYAE6OF02F2OSK.44.12.B01.1.454.CMB.1.raw
tcagacagtatatacacgaccggtgctcgatttagtagtgtagattccgcgggggtagctcaggaagcagagcctggagcatctccactatggcctgggctccactacttctcaccctcctcgctcactgcacaggttcttgggccaatttttatgctgactccaccccccctctgtgtcggtagtcgtaccggggaagacggtaaccatctctgccaccgcagcactgcagcatgccagctactttgtgcagtgtaccagcaggccggcccggcagtccgccccccacctacgtgtgactctatgaggactaaccccaacgacccctcgtccgggtccctgtacgttccggttctcgtcggtcctacctacgtcgactcgtccctcctacctaacttctccgccccttcccctacctaccctacgtcctctacggtaaccgtagtaacacgtacgggaacgggtaaccggacggtacgttacgtaccttaaccgttacgtcgtaccagtttaccttagtacgagttacgacaacggactaacttacgtagttacgggttacggttacggtaccggggtaccgggaaccgggtaaccgtaacggtaccggtttaacccggtacccggtttacggttaaccgggtaccggtaaccccggtaccccggtaacgggtccccgtttacccccccggg

SEQ ID NO: 204795 - DNA, 787 bp, Homo sapiens
  misc_feature: GYAE6OF02HX9YA.44.12.B01.1.454.CMB.1.raw
tcagacagtatatacacgaccggtgctcgatttagtagtgtagattccgcggggagctcaggaagcagagcctggagcatctccactatggcctgggctccactacttctcaccctcctcgctcactgcacaggttcttgggccaattttatgctcgactcacccccctctgtgtcggagtcgtccggggaagacggtaaccatctcctgcacccgcagcacgtggcagcattcgccagctaacttgtcgcagtcggtaccagcacggccggcccgggacacggtcgcccccccacgtactggtgaacttcctagtcgaggactaccccgaaccgtaccctcggtccggggtccctaggtacgttcccgggtttctaccgttcgggcccttcccgtagttccggaactacggtccctacccttacccgaaaccttccgtaccgtccccctttaccccgtaccaacccgtacttccctttaccgtcgggtaaacccttagggtaaaaccggaccgtttagggaccgggggtaaaccggacggtaccggttactaacccgttaaacttaccgtcgtttaccgaacggtttccgttttaaagacggttaacgttacgaaccggtactaaccgtaaattccaaaggtttcgggtttcgggtttacggttccgggggaacgggtaaccgggggtaacccaaaggggttcccgttaccgggtaacccgtttacccgttaaggggtacccctaaaccgggtacccccggtaagggtcccccgttaacccccggg

SEQ ID NO: 204796 - DNA, 732 bp, Homo sapiens
  misc_feature: GYAE6OF02GD6HK.44.12.B01.1.454.CMB.1.raw
  modified_base (258)..(258): a, c, t, g, unknown or other
  misc_feature (258)..(258): n is a, c, g, or t
tcagacagtatatacacgaccggtgctcgatttagtagtgtagatttagggtttagggggactccgtgtgccccaccattcggaccacctctttgctacacactcctgcgtgcgtgaccgaccccttcctgggtcttgtcccaggtcaccttgaaggagtctggtcctgtgctggtacgaaacccacagacgaccctcacgctgacctgcaccatctcgttggttctctctcaacgattattacgaagtgggtagtgngcgtggactccgtacgaccgaccccgagggaccggtccgtggtaggtcggtcttcgctacactacgttccttccgtacgtaacgtaacgtaaaccgtaaaaacctcccgtaaacgtacgtaaccgtattcctacgtaggtaaagtacgtaccgttaacgtttaaccacttaccgtaaccgaaccggtaaccctaacccgtaacggtaaacggtcgtacggttacgtttacgtttaagtacgtaccgaaccgtaactacggtaccgtacccgtaggaccgactaacgcggtacactactatacgtgtagtacgtaacgtaggacggaacggaaagtacgacgtttacggttagtttactaggttactttaagtaaccttaccgttaacgtcgtacgtacggtggtcggaaggtaaccggtacgaccggttacgtaccgtaccgttcgtaacgtcgacgttcccgaccgtaaccgg

SEQ ID NO: 204797 - DNA, 701 bp, Homo sapiens
  misc_feature: GYAE6OF02H0MKS.44.12.B01.1.454.CMB.1.raw
tcagacagtatatacacgaccggtgctcgatttagtagtgtagattccgcggggagctcaggaagcagagcctggagcatctccactatggcctgggctccactacttctcaccctcctcgctcactgcacagggtcctgggcccagtctgtgttgacgcagccgtcctcagtcgtctgccggccccaggacagagggtccacgatctcctgctcgtaggaacgtaacctccgtaaagtggttaggaaaattaacttataggtaacttaccgtaggtaacctagacctaacctcccaagggactcgaaccgacccccctaaaacgtccttacaagttttatacggtaactaaaataacgtaaacgccgacccttacgaacggttacttacgtacgaacctgtttcgacgtcgttacctacgtaagtcggtcgacgtactccgaacgcccctaaccgcggacctacgtaccgacccgtacgccgaagacggtacgggaaccgacgtaacgtacttacgtaccggtagaccggtaacggtgtaagtacgacacggtaccgtagtacggtacgtcgtaggtacgtcggtcgttaccggtacggtacggtaacggtaccgtacggtacgtacccggttaaccgtacgtaccgacgtaacccgagacccgtccgtacccccgtaggtacctaccgtacgttccccg

SEQ ID NO: 204798 - DNA, 695 bp, Homo sapiens
  misc_feature: GYAE6OF02GPF1M.44.12.B01.1.454.CMB.1.raw
  modified_base (119)..(119): a, c, t, g, unknown or other
  misc_feature (119)..(119): n is a, c, g, or t
  modified_base (151)..(151): a, c, t, g, unknown or other
  misc_feature (151)..(151): n is a, c, g, or t
  modified_base (171)..(171): a, c, t, g, unknown or other
  misc_feature (171)..(171): n is a, c, g, or t
  modified_base (213)..(213): a, c, t, g, unknown or other
  misc_feature (213)..(213): n is a, c, g, or t
  modified_base (414)..(414): a, c, t, g, unknown or other
  misc_feature (414)..(414): n is a, c, g, or t
  modified_base (440)..(440): a, c, t, g, unknown or other
  misc_feature (440)..(440): n is a, c, g, or t
  modified_base (472)..(472): a, c, t, g, unknown or other
  misc_feature (472)..(472): n is a, c, g, or t
  modified_base (489)..(489): a, c, t, g, unknown or other
  misc_feature (489)..(489): n is a, c, g, or t
  modified_base (525)..(525): a, c, t, g, unknown or other
  misc_feature (525)..(525): n is a, c, g, or t
  modified_base (588)..(588): a, c, t, g, unknown or other
  misc_feature (588)..(588): n is a, c, g, or t
tcagacagtatatacacgaccggtgctcgatttagtagtgtagattccgcggggagctcaggaagcagagcctggagcatctccactatggcctgggctccactacttctcaccctccncgctcactgcacaggttctggcctaattttangctgacctcccacccccctntcgtcggtcggagttccggtaccggggaagtaccggtaaccnttccgtcctcgccaacccgctagccctacgtcggaccaacgcgttaacttcgaccgtagtacctaaccgtttgtcgacgtacggtcgtaccagcgacggccggcccgggcagtcccgcccccaactcgtaggcgacttacgtagtcggaagccctaaacccgacggtccctcggtcgggtaccctggtaccgttccggttnccggttcgccgtacctacgcgaaccngtaccctcctacgacttccggctcccctaccncgtactcgtccttacgnggttacctagaacgcgtagggccgaacggtcggtanaccggtaacccttataccgtcgttattacgggttatacgtatacgtcgaccaggtacacgttntaaggttccgagggttacgtggaacgggtaacccggaacgtcgttaccggtcggtacccgtttacggaccgtaaccgccggtacccgaccgggttccctaccccggg

SEQ ID NO: 204799 - DNA, 758 bp, Homo sapiens
  misc_feature: GYAE6OF02G436T.44.12.B01.1.454.CMB.1.raw
  modified_base (235)..(235): a, c, t, g, unknown or other
  misc_feature (235)..(235): n is a, c, g, or t
  modified_base (253)..(253): a, c, t, g, unknown or other
  misc_feature (253)..(253): n is a, c, g, or t
  modified_base (260)..(260): a, c, t, g, unknown or other
  misc_feature (260)..(260): n is a, c, g, or t
  modified_base (486)..(486): a, c, t, g, unknown or other
  misc_feature (486)..(486): n is a, c, g, or t
  modified_base (640)..(640): a, c, t, g, unknown or other
  misc_feature (640)..(640): n is a, c, g, or t
tcagacagtatatacacgaccggtgctcgatttagtagtgtagattccgcggggagctcaggaagcagagcctggagcatctccactatggcctgggctccactacttctccaccctccgtcgctcactcgcactaggttcgttgggcctaattttatgctgactcccacccccccttcggtggtccggacgttcggtaccgggaagtaccggtaacctactcctccgtcgaccncccgcgagcagtcggcanctagtcnccgaagtcttaacgtttgataccgaggtcggtaaccgacggtcgaaccggcccggcccgggacgtaccggtccccgacccccccgaactacgtcgtaacggtactactagtacggacggaacctaacccgaaccggttccgtaccggtccgggtaccctgtaaccgttcccgttacgtccgtttaccggcctaccgtacgtaccgtaccaccgtccccgttacccnccggttaaacctcccgtcccgtaccccttccccaccctaccgtacctccggttaccggagttaacccggaggtaacgtaccgaggtaccgggactacggtcggttaactaccttaccgtcgttacgtacgttacgtttacgttagtacggtaancggtacgaacaacctttaggtactaggttaggttacgggtacgttccggggaaagggtcccgaacggtcggtacctacggtaccgaccggtagccgaccaccggtcgttccctcccgg

SEQ ID NO: 204800 - DNA, 492 bp, Homo sapiens
  misc_feature: GYAE6OF01DO3ED.12.10.A10.1.454.CMB.1.raw
  modified_base (488)..(488): a, c, t, g, unknown or other
  misc_feature (488)..(488): n is a, c, g, or t
tcagatacgacgtacacgaccggtgctcgatttagcgtcgatctcagggggcaggagtcagtcccagtcaggacacagcatggacatgagggtccccgctcagctcctggggctcctgctgctctggctcccaggtgccagatgtgacatccagttgacccagtctccatccttcctgtctgcatctataggagacagagtcaccatcacttgccgggccagtcaggacattagcaattatttaggctggtatcagcagaagccagggaagcccctaacgtcctgatctatggtgcatccactttgcatagtggggtcccatcaaggttcagcggcagtggatcgtggacagaattcactctcacatcaccagcctgcagcctagaagtattttgactaactttattactgtacaactaggtttattatttaccctgttatttcggcccttgggacctagagtacgattatcaaacgactgtgctgcncatc

SEQ ID NO: 204801 - DNA, 551 bp, Homo sapiens
  misc_feature: GYAE6OF01AY83O.12.10.A10.1.454.CMB.1.raw
  modified_base (408)..(408): a, c, t, g, unknown or other
  misc_feature (408)..(408): n is a, c, g, or t
tcagatacgacgtacacgaccggtgctcgatttagcgtcgatctcagggggcaggagtcagtcccagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctattaaattggtatcagcagaaaccagggaaacgcccctaaggtcctgatctatgctgcatccagtttgactaaagtcgggtcccaatcgtaaaggttcagtggctaggtgggtctagggactaggtatttcacttctacacctatcagcagtctgacaaccgtgaagtnttctgtactaaactttattacctagtacaacgtagtacgtaactacgttacccctccgtacgtttcggacggtaacgggaccgaagggtaggaacggtacgtacgtaaaccggacgtcggtacggactcgtacctaccgtacg

SEQ ID NO: 204802 - DNA, 578 bp, Homo sapiens
  misc_feature: GYAE6OF01EFZ6D.12.10.A10.1.454.CMB.1.raw
  modified_base (196)..(196): a, c, t, g, unknown or other
  misc_feature (196)..(196): n is a, c, g, or t
  modified_base (277)..(277): a, c, t, g, unknown or other
  misc_feature (277)..(277): n is a, c, g, or t
tcagatacgacgtacacgaccggtgctcgatttagcgtcgatctcaggggggcaggagtcagtcccagtcaggacacagcatggacatggagggtccccgctcagctcctggggctcctgctgctctggctcccaggtgccagatgtgacatccagttgacccagtctccatccttcctgtctgcatctatagganacagagtccaccatcacttggccggccagtcaggacattagctaattattaggctggtatcagcagaagccgagggaaacncccctaacgtcctagactctagtggtcgctatcctatttgactagtacggtcggggtacccatacgaaggttcaggcggacgaggtggactcgtaggactagtatttccacgttctccaacctatcagctagttctacgacctaaccgtagaagtcttcagtacttaactttattactcgtaacaagtagtacgtaaacctacgttacccctccgttacgttacgggaccggaacgggtaccgaaagggttggaacgtactaccgtaaaacgacgttcggtacggactcgccaacgttacg

SEQ ID NO: 204803 - DNA, 523 bp, Homo sapiens
  misc_feature: GYAE6OF01A1599.12.10.A10.1.454.CMB.1.raw
tcagatacgacgtacacgaccggtgctcgatttagcgtcgatctcagggggcaggagtcagtcccagtcaggacacagcatggacatgagggtccccgctcagctcctggggctcctgctgctctggctcccaggtgccagatgtgacatccagttgacccagtctccatccttcctgtctgcatctataggagacagagtcaccatcacttgccgggccagtcaggacattagcaattatttaggctggtatcagcagaagccagggaagcccctaacgtcctgatctatggtgcatccactttgctagtagtcggggtcccatcaaggttcagcggcagtggatcgtgggacagaattcactctcacaatcaccagcctgcacgcctagaagtattttgactaacttattactgtactaactaggtttatacttttacccttcgttacttttcggcccttgggacctacgtacgtagattaacgtcaaacgtaactaggtacggtctaggcaccgtattcg

SEQ ID NO: 204804 - DNA, 500 bp, Homo sapiens
  misc_feature: GYAE6OF01AEJ9L.12.10.A10.1.454.CMB.1.raw
  modified_base (398)..(398): a, c, t, g, unknown or other
  misc_feature (398)..(398): n is a, c, g, or t
  modified_base (408)..(408): a, c, t, g, unknown or other
  misc_feature (408)..(408): n is a, c, g, or t
tcagatacgacgtacacgaccggtgctcgatttagcgtcgatctcagggggcaggagtcagtcccagtcaggacacagcatggacatgagggtccccgctcagctcctggggctcctgctgctctggctcccaggtgccagatgtgacatccagttgacccagtctccatccttcctgtctgcatctataggagacagagtcaccatcacttgccgggccagtcaggacattagcaattatttaggctggtatcagcagaagccagggaaagcccctaacgtcctgatctatggtgcatccactttgcatagtggggtcccatcaaggttcagcggcagtggatcgtgggacagtactttcactctacaccatcagcagtctgcaactgaagtattcngactaacttnttactgtacaacagataactacgttaccctcctacgttcggacggaggaccgaggtggagactaccgaaacgacgtggtgactcgcacctag

SEQ ID NO: 204805 - DNA, 564 bp, Homo sapiens
  misc_feature: GYAE6OF01DRIE9.12.10.A10.1.454.CMB.1.raw
  modified_base (281)..(281): a, c, t, g, unknown or other
  misc_feature (281)..(281): n is a, c, g, or t
  modified_base (306)..(306): a, c, t, g, unknown or other
  misc_feature (306)..(306): n is a, c, g, or t
  modified_base (451)..(451): a, c, t, g, unknown or other
  misc_feature (451)..(451): n is a, c, g, or t
  modified_base (524)..(524): a, c, t, g, unknown or other
  misc_feature (524)..(524): n is a, c, g, or t
  modified_base (540)..(540): a, c, t, g, unknown or other
  misc_feature (540)..(540): n is a, c, g, or t
  modified_base (553)..(553): a, c, t, g, unknown or other
  misc_feature (553)..(553): n is a, c, g, or t
tcagatacgacgtacacgaccggtgctcgatttagcgtcgatctcagggggcaggagtcagtcccagtcaggacacagcatggacatgagggtccccgctcagcctcgtgggctcctggctgctcgtggctcccaggtgccagatgtgacatccagttgacccagtcctccatccttcctgtctgctatctataggagacagagtcaccatcacttgccgggcagtcaggacattagctaatttattaggcttaggtatcagcaagaagccgagggaaacncccctaagtcctgatctagtggtanctatcctatttgctataggtcggtcccatcgaaggttcagcggcagtggatcgtaggactagaacttcaacttctacaactaatccaaccacgtccaggacacggtcctaagaacgtttattttcgaacttaatttattaacgtntaacctaagttaacgttttattaccgttttccctagtttacgtttccggcccgtaggtaccctagtaacggtntataatacaaaccgtnttacgtggtctanacccagtctcg

SEQ ID NO: 204806 - DNA, 623 bp, Homo sapiens
  misc_feature: GYAE6OF01C10YG.12.10.A10.1.454.CMB.1.raw
  modified_base (420)..(420): a, c, t, g, unknown or other
  misc_feature (420)..(420): n is a, c, g, or t
tcagatacgacgtacacgaccggtgctcgatttagcgtcgatctcagggggcaggagtcagtcccagtcaggacacagcatggacatgagggtccccgctcagctcctggggctcctgctgctctggctcccaggtgccagatgtgacatccagttgacccagtctccatccttcctgtctgcatctataggagacagagtcaccatcacttcgccgggcagtcaggacattagcaattatttaggctggtatcagcaagagccgaagggaaacacccctaacgtcctgactcgtatggtgcatcctactttgctagtaggtcggggtacctagtacgtaaggttcagcggacgaggtggatcgtaggacagtaatcactctacaacaatccaacacgcctgacacgacctagaaacgtnttcggtacgacttaaactttacttaacgtagttaacaaaagttaacttaaacgtaccgttaccgtaccccccttaccgtaacccgtttccgggaaccccgtaaaggggtaacccgaaccgggtaaccgttacgggaacggttaaacgttaacgggaaacccggtaaccgttagggtaccgggtaccttaggcccgtaaacccg

SEQ ID NO: 204807 - DNA, 509 bp, Homo sapiens
  misc_feature: GYAE6OF01BLU35.12.10.A10.1.454.CMB.1.raw
  modified_base (385)..(385): a, c, t, g, unknown or other
  misc_feature (385)..(385): n is a, c, g, or t
  modified_base (506)..(506): a, c, t, g, unknown or other
  misc_feature (506)..(506): n is a, c, g, or t
tcagatacgacgtacacgaccggtgctcgatttagcgtcgatctcagggggcaggagtcagtcccagtcaggacacagcatggacatgagggtccccgctcagctcctggggctcctgctgctctggctcccaggtgccagatgtgacatccagttgacccagtctccatccttcctgtctgcatctataggagacagagtcaccatcacttgccgggccagtcaggacattagcaattatttaggctggtatcagcagaagccagggaacgcccctaacgtcctgatctatggtgcatcctactttgctagtaggtcggggtccctagtcaaggttcaggcggcaggtggatcgtagggacagaacttcactctcacatcacancctgcagcctagaagtatttagctaactttattactgtactaactaggtttaattactttacccttcgttactttccggccgttggacctagagtagatatacaaacgatgtgctgctacntcg

SEQ ID NO: 204808 - DNA, 530 bp, Homo sapiens
  misc_feature: GYAE6OF01EBVT3.12.10.A10.1.454.CMB.1.raw
  modified_base (272)..(272): a, c, t, g, unknown or other
  misc_feature (272)..(272): n is a, c, g, or t
  modified_base (293)..(293): a, c, t, g, unknown or other
  misc_feature (293)..(293): n is a, c, g, or t
  modified_base (304)..(304): a, c, t, g, unknown or other
  misc_feature (304)..(304): n is a, c, g, or t
  modified_base (409)..(409): a, c, t, g, unknown or other
  misc_feature (409)..(409): n is a, c, g, or t
tcagatacgacgtacacgaccggtgctcgatttagcgtcgatctcagggggcagggagtcagtcccagtcaggacacagcatggacatgagggtccccgctcagctcctggggctcctgctgctctggctcccaggtgccagatgtgacatccagttgacccagtctccatccttcctgtctgcatctataggagacagagtcaccatcacttgccgggccagtcaggacattagcaattatttaggctggtatcagcagaagccaaggaanccctaagtcctgatctatgtnctatcactttncatacgtgggtcccagtcgaagttcagcgcagtgatcgtggacaggaattcgactctacacatcacagcctgcagtctagaatatttcgactaactttattactntacctaacgtacgtttaattaacctttacctacgtttacgtttccggaccttaggaacctactagggtaactagtactacaaaacgtacttagtcggtacctagtaccgtacctagttccg

SEQ ID NO: 204809 - DNA, 258 bp, Homo sapiens
  misc_feature: GYAE6OF01BD4YH.12.10.A10.1.454.CMB.1.raw
  modified_base (254)..(258): a, c, t, g, unknown or other
  misc_feature (254)..(258): n is a, c, g, or t
tcagatacgacgtacacgaccggtgctcgatttagcgtcgatctcagggggttacatcggctactattatcactacatggacgtctgggacaaagggaccacggtcgccgtctcctcagcctccaccaagggcccatcggtcttccccctggcgccctgctccaggagcacctccgagagcacagcggccctgggctgcctggtcaaggactacttcctacgtcgtatctgagcgggctggcaaggcgcatagnnnnn

SEQ ID NO: 204810 - DNA, 699 bp, Homo sapiens
  misc_feature: GYAE6OF01AHG76.12.10.A10.1.454.CMB.1.raw
  modified_base (197)..(197): a, c, t, g, unknown or other
  misc_feature (197)..(197): n is a, c, g, or t
  modified_base (287)..(287): a, c, t, g, unknown or other
  misc_feature (287)..(287): n is a, c, g, or t
  modified_base (299)..(299): a, c, t, g, unknown or other
  misc_feature (299)..(299): n is a, c, g, or t
  modified_base (311)..(311): a, c, t, g, unknown or other
  misc_feature (311)..(311): n is a, c, g, or t
  modified_base (693)..(693): a, c, t, g, unknown or other
  misc_feature (693)..(693): n is a, c, g, or t
tcagatacgacgtacacgaccggtgctcgatttagcgtcgatctcagggggcaggagtcagtcccagtcaggacacagcatggacatgagggtccccgctcagctccgtggggctcctgctgctctggctcccaggtgccagatgtgacatccagttcgacccagtcctccatccttcctgtctgcatctatagganacagagtccaccatcacttcggccgggccagtcaggactattagactaattagtttaggcttaggtatcagacagaacgccgaaggaacncccctaacgtcngatctagtggtnctatcctacgtttgctagtacggtcgggtacccagtacgtaaggttcgaggcggtacgtaggtacgggtaacttcggtaaggggtaactaaacggttaacctttaccgtaacccttacctaacctaaacctaaaccgttcccaaaccccggtaacgttccccgacggtacccgtaaccggtaccgtttaaggtaaacgttttacgttttaccgaaaccttttaaaccgttttatttaaccgttacggttaacctaaacgtttaaggtttttaccttaaccgttttacccgttcgtttaaccggtttccggaccgtacgggtaacctaacgtaaggttacaacttactaaccgaaacgttcgtagtcggactagaccctagtnttaccg

SEQ ID NO: 204811 - DNA, 592 bp, Homo sapiens
  misc_feature: GYAE6OF01C40IM.12.10.A10.1.454.CMB.1.raw
  modified_base (272)..(272): a, c, t, g, unknown or other
  misc_feature (272)..(272): n is a, c, g, or t
tcagatacgacgtacacgaccggtgctcgatttagcgtcgatctcagggggcaggagtcagtcccagtcaggacacagcatggacatgagggtccccgctcagctcctggggctcctgctgctctggctcccaggtgccagatgtgacatccagttgacccagtctccatccttcctgtctgcatctataggagacagagtcaccatcacttgccgggcagtcaggacattagcaattattaggctggtatcagcagaagccgagggaaacncccctaacgtcctgatctatggtgcactcctactttgactataggtcgggtcccagtcaaggttcagcggcaggtggatcgtagggacaaggtaacttcacttctacaacaataccaccacgtcctgcacgcctagaagttattttacgacttaacgtttattactagtactaacgttaaggttttaacttaactttacccttacgtttacgttttccggacccgttagggaaccctaagtaacggtttaaacgaattaactaaccgaaaaccgtaacgttacggtacgggtactaggtaccctaaccgtacgtttaccg

SEQ ID NO: 204812 - DNA, 532 bp, Homo sapiens
  misc_feature: GYAE6OF01CT9P2.12.10.A10.1.454.CMB.1.raw
  modified_base (390)..(390): a, c, t, g, unknown or other
  misc_feature (390)..(390): n is a, c, g, or t
tcagatacgacgtacacgaccggtgctcgatttagcgtcgatctcagggggcaggagtcagtcccagtcaggacacagcatggacatgagggtccccgctcagctcctggggctcctgctgctctggctcccaggtgccagatgtgacatccagttgacccagtctccatccttcctgtctgcatctataggagacagagtcaccatcacttgccgggcagtcaggacattagctaattatttaggctggtatcagcagaagccaagggaacgcccctaacgtcctgatctatggtgcatccactttgcatagtgggtccatcaaggttcagcgcagtgatcgtggacagaattcactctcaccatcagcacgcctgcagcctagaacgnttgtgactaatttattactgtaacaaaagttataactacgtcgtacccccttacgacccgttaccgggaccaaacggggtaccaacggtacgtacgggagtaacgttaacggaaccggtaacttgggtacggcgtggtaccc

SEQ ID NO: 204813 - DNA, 620 bp, Homo sapiens
  misc_feature: GYAE6OF01B7Z9U.12.10.A10.1.454.CMB.1.raw
  modified_base (300)..(300): a, c, t, g, unknown or other
  misc_feature (300)..(300): n is a, c, g, or t
tcagatacgacgtacacgaccggtgctcgatttagcgtcgatctcagggggcaggagtcagtcccagtcaggacacagcatggacatgagggtccccgctcagctcctggggctcctgctgctctggctcccaggtgccagatgtgacatccagttgacccagtctccatccttctgtctgcatctataggagacagagtcaccatcacttgccgggcagtcaggacattagctaattattaggctggtatcagcagaacgccgaaggggaaacgcccctaacgtcctagatctatggtnactatccgtactttcgactagtaggtcggggtacccaagtacgtaaaggttcaacggcggcaggtggatcgtgggaacagatttcactctacacaactccacacgcctgcacgcctagaagttattttacgacttaactttacttacgtagtaacctaaacgtttaaggttttaacttacgttttacccttacgtttaccgttttaccggtaccccgtaggggtaaacccctaaggttaacggtagttaaacttaacgttaacccgtaaaacggttaacgttcgggttacggaccttaggacccctacgtaacgtttccg

SEQ ID NO: 204814 - DNA, 526 bp, Homo sapiens
  misc_feature: GYAE6OF01D7BUK.12.10.A10.1.454.CMB.1.raw
  modified_base (382)..(382): a, c, t, g, unknown or other
  misc_feature (382)..(382): n is a, c, g, or t
tcagatacgacgtacacgaccggtgctcgatttagcgtcgatctcagggggcaggagtcagtcccagtcaggacacagcatggacatgagggtccccgctcagctcctggggctcctgctgctctggctcccaggtgccagatgtgacatccagttgacccagtctccatccttcctgtctgcatctataggagacagagtcaccatcacttgccgggccagtcaggacattagcaattatttaggctggtatcagcagaagccagggaaagcccctaacgtcctgatctatggtgcatccactttgcatagtggggtcccagtcaaggttcagcggcagtggatcgtggacagtatttcactctcaccactcagcacgtcngacctaacgtagaagtattcagtactaacttattactatacaacgagtaacgtaactacgttaccctacctacgttcggacggacggacgtaagggtaggaagtacaacgaaacgtaacgtcggtacgtactcggacacgtacg

SEQ ID NO: 204815 - DNA, 562 bp, Homo sapiens
  misc_feature: GYAE6OF01CDM75.12.10.A10.1.454.CMB.1.raw
  modified_base (276)..(276): a, c, t, g, unknown or other
  misc_feature (276)..(276): n is a, c, g, or t
  modified_base (549)..(549): a, c, t, g, unknown or other
  misc_feature (549)..(549): n is a, c, g, or t
tcagatacgacgtacacgaccggtgctcgatttagcgtcgatctcaggggggcaggagtcagtcccagtcaggacacagcatggacatgagggtccccgctcagctcctggggctcctgctgctctggctcccaggtgccagatgtgacatccagttgacccagtcctccatccttcctgtctgcatctataggagacagacgtcaccatcacttcgccgggccagtcaggacattagctaattattaggctggtatcagcagaagccagggaacncccctaacgtcctgatctatggtgcatcctactttgctagtacggtcggggtacccatcgtaaggttcgaggcggcaggtggatcgtagggacagtaacttcactctacactaactaccaaccacgcctgaccagacctaggaacttacttttagacttaactttattactgttactaacgttagttttacttacttttacccttgtttacgtttccggtaccgtaggacctacgagttacgaatactacgaaacgtacttaggtcgtactanacctactattccg

SEQ ID NO: 204816 - DNA, 595 bp, Homo sapiens
  misc_feature: GYAE6OF01A9BQN.12.10.A10.1.454.CMB.1.raw
  modified_base (198)..(198): a, c, t, g, unknown or other
  misc_feature (198)..(198): n is a, c, g, or t
tcagatacgacgtacacgaccggtgctcgatttagcgtcgatctcagggggcaggagtcagtcccagtcaggacacagcatggacatgagggtccccgctcagcctccgtggggctcctgctgctctggctcccaggtgccagatgtgacatccagttcgacccagtctccatccttcctgtctgctatctatagganacagagtcaccatcacgttcgccggcagtcaggacattagctaattagtttaggctaggtatcagcgaagaacgaccgaagggaaacgtacccctaacgtcctagactctagtggtgactatcctacttgactagtaggtcgggtaccagtacgaaggttcgagcggactaggtggactcgtggaactaggtaacttcgactctacaacgtaactccaacacgtcctagaccagcctaaggaacgtttatttcgaacttaactttacgttactacgttaactaaacttagggttttaactacttttacccgttacgttactttccggtacccgtagtaacctactaggtactaattacgtaacaaacgtagtcgtacggactaggaccacgtgttac

SEQ ID NO: 204817 - DNA, 828 bp, Homo sapiens
  misc_feature: GYAE6OF01DCAIR.12.10.A10.1.454.CMB.1.raw
tcagatacgacgtacacgaccggtgctcgatttagcgtcgatctcagggggcaggagtcagtcccagtcaggacacagcatggacatgagggtccccgctcagctcctggggctcctgctgctctggctcccaggtgccagatgtgacatccagttgacccagtctccatccttcctgtctgcatctataggagacagagtcaccatcacttgccgggccagtcaggacattagctaattattaggctggtatcagcagaagccaagggaaacgcccctaacgtcctagactctagtggtgctatcctactttcgactaagttacggtcgggggtacccctaagttacgtaagggtttaccgaggtccgggacgtaagggttacgggtaacgttaccgttagggggaacctaaaggtaactttaccgaaccttacctacctaaacctaaacttccccgaaaccccgtaacggtacccctacgggaccctaaccggtacccgttaagggtaaacgtttaacgtttttttacgggaaccctttaaacgttttaaccgtttaaccgtttacgtttaaacccgtaaaccggttttaaagggttttttaaaccttttaaacccgttttttaacccccggttttaccgggttttaaccggttttttacccccggggtaccccccggtttaacgggggtaaacccccttaaacggttaaacgggtttaaaccggttaaagtttaaacccgttaaacccgtaaaaacccgggttaaaccgtttacgggttacggggtacccttaccgggaccctaaacccgtacgttttaccccgg

SEQ ID NO: 204818 - DNA, 625 bp, Homo sapiens
  misc_feature: GYAE6OF01D5TNW.12.10.A10.1.454.CMB.1.raw
  modified_base (274)..(274): a, c, t, g, unknown or other
  misc_feature (274)..(274): n is a, c, g, or t
tcagatacgacgtacacgaccggtgctcgatttagcgtcgatctcagggggcaggagtcagtcccagtcaggacacagcatggacatgagggtccccgctcagctcctggggctcctgctgctctggctcccaggtgccagatgtgacatccagttgacccagtctccatccttcctgtctgcatctataggagacagagtcaccatcacttgccgggccagtcaggacattagctaattattaggctggtatcagcagaagccgaagggaacncccctaacgtcctgatctagtggtgcatcctactttgctagtaggtcggggtacccagtacgaaggttcgagcggcaggtggatcgtagggactagtaattcactctacaactaatccaacctacgccgtacgacctacgtacctaggtaaagtttacttttacgaccttaactttaactttacgttagttaacctaacgttaaggttttaactttacttttaaccccgttacgtttacttttcccgggtacccgttacggggtaaccctaacggttaagtaacggtaattaacgttaaccgaaaaccgtacgttacgggtcggtaccttacggaccctaaccgtattccg

SEQ ID NO: 204819 - DNA, 671 bp, Homo sapiens
  misc_feature: GYAE6OF01CJRFH.12.10.A10.1.454.CMB.1.raw
  modified_base (311)..(311): a, c, t, g, unknown or other
  misc_feature (311)..(311): n is a, c, g, or t
  modified_base (650)..(650): a, c, t, g, unknown or other
  misc_feature (650)..(650): n is a, c, g, or t
  modified_base (660)..(660): a, c, t, g, unknown or other
  misc_feature (660)..(660): n is a, c, g, or t
tcagatacgacgtacacgaccggtgctcgatttagcgtcgatctcagggggcaggagtcagtcccagtcaggacacagcatggacatgagggtccccgctcagctcctggggctcctgctgctctggctcccaggtgccagatgtgacatccagttcgacccagtctccatccttctgtctgctatctagtaggagacagagtcacatcacttcggccgggcagtcaggactattagactaatttacgtttaggctggtatcgagacaagaacgcgaaggaacgtccccaagtcctgactcgtagtggtcnctatcctactttgactagtacggtcgggtacccagtaccgtaaggttcgacggcggagtacggtgggtaacgtcgggttacggggaacttaaggtaactttaccgtaaccttactaaccgtaactaacgttacccaacccgtaacggtcccttacgacgaaccgtccgtttaaaggtaaacgtttacttttacggaacctttaatttacgtttacttacgttaacgttaacgtttaaaggttttacttaccgttttacccgttacgtttacggtttacccggacccgttacgggtaacctacgtaacggtactagtaactacaaacgtacgttggtacnccgtataccncttagttcccg

SEQ ID NO: 204820 - DNA, 619 bp, Homo sapiens
  misc_feature: GYAE6OF01CC8GH.12.10.A10.1.454.CMB.1.raw
tcagatacgacgtacacgaccggtgctcgatttagcgtcgatctcagggggcaggagtcagtcccagtcaggacacagcatggacatgagggtccccgctcagctcctggggctcctgctgctctggctcccaggtgccagatgtgacatccagttgacccagtctccatccttcctgtctgcatctataggagacagagtcaccatcacttgccgggccagtcaggacattagctaattatttaggctggtatcagcagaagccgagggaacgcccctaacgtcctgatctatggtgcatcctactttgctagtacggtcggggtccctagtacgtaacggttcacggccggcgtaaggtgggacgtcgtagggaacaagtaacttcgacttctaccaactaactaccacccaacgcctagaccacgcctaggaaacgttattttacgactaactttattactacgttactaaacgttaggttttaacttaaccttttacccgttacgtttacgttttcccgggtcccgttacgggtaaccctaacgtacggttaacgtagttaactaaccgtaaaacgttaacgtcggttacggtctagaccctaccgtattacccg

SEQ ID NO: 204821 - DNA, 539 bp, Homo sapiens
  misc_feature: GYAE6OF01B39ZV.12.10.A10.1.454.CMB.1.raw
  modified_base (194)..(194): a, c, t, g, unknown or other
  misc_feature (194)..(194): n is a, c, g, or t
  modified_base (270)..(270): a, c, t, g, unknown or other
  misc_feature (270)..(270): n is a, c, g, or t
  modified_base (293)..(293): a, c, t, g, unknown or other
  misc_feature (293)..(293): n is a, c, g, or t
tcagatacgacgtacacgaccggtgctcgatttagcgtcgatctcagggggcaggagtcagtcccagtcaggacacagcatggacatgagggtccccgctcagctcctggggctcctgctgctctggctcccaggtgccagatgtgacatccagttgacccagtctccatccttcctgtctgcatctatagganacagagtcaccatcacttgcccgggcaagtcaggacattagcaattatttaggctggtatcagcagagcagggaancccctaagtcctgatctatggtncatccactttgactagtaggtgggtcccatcgaaggttcagcggcagtggatcgtggaccagaacttcactctacacatcaccagcctgaccagcctagaactattttgacttaacttattactgtactaacgtagttttaactactttaccccgttagttactttccgggacccttgggaccctacgtacgttagtattaacgtaccaaacgtaacgttggtacggtctagacctacctagttcg

SEQ ID NO: 204822 - DNA, 557 bp, Homo sapiens
  misc_feature: GYAE6OF01BA2B1.12.10.A10.1.454.CMB.1.raw
tcagatacgacgtacacgaccggtgctcgatttagcgtcgatctcagggggcaggagtcagtcccagtcaggacacagcatggacatgagggtccccgctcagctcctggggctcctgctgctctggctcccaggtgccagatgtgacatccagttgacccagtctccatccttcctgtctgcatctataggagacagagtcaccatcacttgccgggccagtcaggacattagcaattatttaggctggtatcagcagaagccagggaacgcccctaacgtcctgatctatggtgcatccactttgcagtaggtggggtcccagtcaaggttcaggcggcaggtggatcgtaggacagaacttcactctacacatcaccagcctgcacgccgtagaacgtatttacgacttaacttacttactacgtacaacgttaggtttaacttactttacccttacggttacttttccggcccgttacggggtaccctaacgtacgtaacgtattaactacgaaaccgtacttggtacggtactacggcctaccgtgttcccg

SEQ ID NO: 204823 - DNA, 670 bp, Homo sapiens
  misc_feature: GYAE6OF01B15F9.12.10.A10.1.454.CMB.1.raw
  modified_base (311)..(311): a, c, t, g, unknown or other
  misc_feature (311)..(311): n is a, c, g, or t
tcagatacgacgtacacgaccggtgctcgatttagcgtcgatctcagggggcaggagtcagtcccagtcaggacacagcatggacatgagggtccccgctcagctcctggggctcctgctgctctggctcccaggtgccagatgtgacatccagttgacccagtctccatccttctgtctgcatctgtagcagacagagtcaccatcacttgccgggctaacggagagtattgacctaacggttaattttaaagttggtaatacaaaacaaaaagcaaggacaaacgtcccaaagtcctaccttgatttangctcgccacagtctgacgtaagggttcggttccctagtaaggttcagtgggccgtggactacgaagggactagtaactttactctacacctatacgtagttacgtcctaacgagtacccgtagaagtattagtttcgtacttttaacgttaactttaccgtggtacctaagtacgtaacgtacggtttaccccgccgtacccttaccccgtaattcccgtacccggtttacccgggaacccgtaaaccggggtaccaacccgggacccggtacgtaacgggttaacggtttacggggtaaacccgtaacggttagggttccggaccgtttaccgaccgttaaccctggttcctttacgg

SEQ ID NO: 204824 - DNA, 589 bp, Homo sapiens
  misc_feature: GYAE6OF01A9G6R.12.10.A10.1.454.CMB.1.raw
  modified_base (299)..(299): a, c, t, g, unknown or other
  misc_feature (299)..(299): n is a, c, g, or t
tcagatacgacgtacacgaccggtgctcgatttagcgtcgatctcaggggggcaggagtcagtcccagtcaggacacagcatggacatgagggtcccccgctcagctcctggggctcctgctgctctggctcccaggtgccagatgtgacatccagttgacccagtctccatccttcctgtctgcatctataggagacagagtcaccatcacttgccgggccagtcaggacattagcaattatttaggctggtatcagcagaagccaagggaacgcccctaacgtctgactctatggtncactcctactttgactatagtcggggtacccatctaaggttcagacggctaggtgtagtcgtaggactagtaacttcactactaccaactaactacaacccagccctagccacgtctagtaacgtactttcgacttaacttattactagttactaacgtacggttttaacttacgttttacccttaggtttacctttaccggtcccgttagggtaaccctacgtaacgttagtaactacgtaccgaaaaccgtagttacggttcgaccgttagaccctaacgtcgttccg

SEQ ID NO: 204825 - DNA, 723 bp, Homo sapiens
  misc_feature: GYAE6OF01BMK6Y.12.10.A10.1.454.CMB.1.raw
tcagatacgacgtacacgaccggtgctcgatttagcgtcgatctcagggggcaggagtcagtcccagtcaggacacagcatggacatgagggtccccgctcagctcctggggctcctgctgctctggctcccaggtgccagatgtgacatccagttgacccagtctccatccttcctgtctgcatctagtaggagacagagtcaaccatcacttgcccgggtccagtcaggactagttagactaatttagtttaggcttaggtatacgagacaagaacggaccgaaggggaaaccgcccctaaacgtcctagactcgtagtggtgcacgttcctaactttcgactagtagggtcgggtaccctagtacgtaaacggttcgaaggtcggactaggtaggtacgtcgtaggggtaactaggtaacttacctacgttactacaacctaacttaccgaaccgaacgtcctacgacgtaacgtcccgttaaggtaacgtttaattttacgaaccttaaacgttttacgttaaccgttagttaacccttaaacgtttaaggtttttaaccttaaccgtttttaacccgttacggtttaccgttttaccccggtaccggttccgggtaaccctaaacggttaaccggttaagttaacttaacgtaacccgtaaaaccggtaacgttacgggttaccgtccgtacggtacctaacccgttacgtttacccg

SEQ ID NO: 204826 - DNA, 736 bp, Homo sapiens
  misc_feature: GYAE6OF01DOJGA.12.10.A10.1.454.CMB.1.raw
tcagatacgacgtacacgaccggtgctcgatttagcgtcgatctcagggggcaggagtcagtcccagtcaggacacagcatggacatgagggtccccgctcagctcctggggctcctgctgctctggctcccaggtgccagatgtgacatccagttgacccagtctccatccttcctgtctgcatctataggagacagagtcaccatcacttgccgggccagtcaggacatagcaattattaggctggtatcagcagaagccgagggaaacgcccctaacgtcctagactctatggtgctactcactttgcagtacgtcggggtcccagtctaaaggttcaggtcggctacggtaggacgttccgtaggggaacctaagggtaactttccgaaccgttaccttaccaaaccttaacgttaacccaaaccccgtaacggaccccgtttacggaccccgtaacggtaccccgtttaaggtaaacggtttaacgtttttacggtaaccctttaaaacccgtttttaacttttaaccgtttaacgttaaccgtaaaccggtttaagggtttttaacctttaaccgtttttaaccccttaccggttttacgtttttttacccggggacccgtttacggggaccccttaaacgtaacgggttaaacgtaagttaacttaaccgtaaaaccggtaacctttacgggtacgggttacctacgggtacccaacccgttcttaccg

SEQ ID NO: 204827 - DNA, 590 bp, Homo sapiens
  misc_feature: GYAE6OF01E4FBM.12.10.A10.1.454.CMB.1.raw
  modified_base (193)..(193): a, c, t, g, unknown or other
  misc_feature (193)..(193): n is a, c, g, or t
tcagatacgacgtacacgaccggtgctcgatttagcgtcgatctcagggggcaggagtcagtcccagtcaggacacagcatggacatgagggtccctgctcagctcctggggctcctgctgctctggctcccaggtgccagatgtgacatccagatgacccagtctccatcctcctgtctgcttctgtcgganacagagtcaccatcacttgccaggcgagtgaggacattacggtaaatttttaattggtatcagcagaaaccagggaaacgcccctaaggtcctgatctatgctgcattccagtttgacgaaaggtcgggtacccagtacgaaggttcaggtggcgtaggtgggtctgggacagtatttcactctcaccatcagctagtctagacaacctgaactattactacgtactaactttattacgtgtaaccaactaagtaacgtaaacctaccgtttaacccctacccgttaacgtttccgggaccgggtaagggaccctaaaggggtacggaacggtactaacgaaaaccggtacgttcgggtacggtacgtacgaccctaacctacttccgtggtttccc

SEQ ID NO: 204828 - DNA, 705 bp, Homo sapiens
  misc_feature: GYAE6OF01BTGF6.12.10.A10.1.454.CMB.1.raw
  modified_base (99)..(99): a, c, t, g, unknown or other
  misc_feature (99)..(99): n is a, c, g, or t
  modified_base (638)..(638): a, c, t, g, unknown or other
  misc_feature (638)..(638): n is a, c, g, or t
tcagatacgacgtacacgaccggtgctcgatttagcgtcgatctcagggggcaggagtcagtcccagtcaggacacagcatggacatgagggtccccgntcagctcctggggctcctgctgctctggctcccaggtgcctagagtgggtcgacgataccgacgttcgaccctagtctccatccttcctgtctgctatctataggagacagactcaccatcgacttcggccggccagtcaggactattagactaagtttacgtttaggcttggtatccgagccaagacgccgaaggggaaacctccccgtaacggtcctgaacttcgttaagtcgggtctacctaacgttccctacgttttcgacgtaacggttacggtccggggtacccaagttcgtaaacgggttcacggcggtctagggtacggtacttcgagggaacctaagttacttccgacttctactaacgtactccaaccgacgtcctagaccacgtaccgtagtaacggtttacttacgtacttaactttacgttacgtacggttaactaacgtttacggttttaacttaaccttttacccgttacgttttacccgtttaccgggtacccgttacgggtaacccttaacgtaacggttanaaccggtttaatacccggtaaaaccgtgttcggtaccgtacgttaacggcctaacgttacgtttccg

SEQ ID NO: 204829 - DNA, 714 bp, Homo sapiens
  misc_feature: GYAE6OF01A83UY.12.10.A10.1.454.CMB.1.raw
  modified_base (195)..(195): a, c, t, g, unknown or other
  misc_feature (195)..(195): n is a, c, g, or t
  modified_base (278)..(278): a, c, t, g, unknown or other
  misc_feature (278)..(278): n is a, c, g, or t
tcagatacgacgtacacgaccggtgctcgatttagcgtcgatctcagggggcaggagtcagtcccagtcaggacacagcatggacatgagggtccccgctcagctcctggggctcctgctgctctggctcccaggtgccagatgtgacatccagttgacccagtctccatcccttcctgtctgcatctatagganacagagtcaccatcacgttcgcccgggcagtcaggacattagctaattatttaggctggtatcagcagaacgcaagggaaacncccctaacgtcctgactctatggtgcagtcctatttgactataggtcggggtccatcaaggttcagcggcaggtggacttcgtaggggaacaggtaacttcacttactacaacgtaactaccaacccgtagtacctacgaccgtacgtacccgttaagaaacgtttacttttacggtaaccttaaactttttaacgtttaaccgttacggtttaaacccttaacggtttaaacgggttttttaacctttaacccgttttttaaacccccggtttacgtttttaaccggtttttcccccgggaaccccggttacggggttacccctaaaccggtttaacggtaaccgtttaaacgtaaacgttaaaccccgaaaaaccgggttaaccgtttacgggtacgggttacccgttagacccctaacccgtatttaccccgg

SEQ ID NO: 204830 - DNA, 677 bp, Homo sapiens
  misc_feature: GYAE6OF01EWHQ7.12.10.A10.1.454.CMB.1.raw
tcagatacgacgtacacgaccggtgctcgatttagcgtcgatctcagggggcaggagtcagtcccagtcaggacacagcatggacatgagggtccccgctcagctcctggggctcctgctactctggctccgaggtgccagatgtgacatccagatgacccagtcctccttcctcctgtctgcatctgtcggagacagcgtcacctatcacttgcggacaagtcagaactatttactaattattaaattggtatcagacaagaaaccgagggaaacacccctaatcctagatctatcatgtaactctagtttcgacgtaagtggactacctagtacgtaaggttcgagtcgcgtacgtggtactaggacgactagtacgttcacttcacctaccatccaagtcctacctactacctacgactagaaagtttctttagaaccttaactttatttacgttacgtaaccttaaagttaaaggttactacggtaaccccgttacccccttacggtaccccgtttacctttaccccggggaccccgttaacggggaaaccttacggttaggtacgggttaaaacttaaccgttaagggtaaaacccggtacggtttaagggttcccgggtaccttaaccggacccttaaacccgtacggttttcccgttaacgtttaccccc

SEQ ID NO: 204831 - DNA, 604 bp, Homo sapiens
  misc_feature: GYAE6OF01EGQPB.12.10.A10.1.454.CMB.1.raw
tcagatacgacgtacacgaccggtgctcgatttagcgtcgatctcagggggcaggagtcagtcccagtcaggacacagcatggacatgagggtccccgctcagctcctggggctcctgctgctctggctcccaggtgccagatgtgacatccagttgacccagtctccatccttcctgtctgcatctataggagacagagtcaccatcacttgccgggccagtcaggacattagcaattatttaggctggtatcagcagaagccaggaaacgcccctaacgtcctgatctatggtgcatccatttgctataggtcggggtcccatcgaagttcagcggcagtgatcgtggacaggtaattcgacttctacaacataccacagtcctagaccgacgtcctgtaaacgtattttacgaccttaacgtttatttaaccgtagtaccgtaaacgttacgggttttaactttaaccgttttaccccgttacgttttacgttttcccgggaccccttaggggtaaccctaccgtaaagttacgttaattaacgttacgtaaaaaccgtacgttacggttacgggacttacggacctaaccgtcgttaccg

SEQ ID NO: 204832 - DNA, 526 bp, Homo sapiens
  misc_feature: GYAE6OF01CNUJF.12.10.A10.1.454.CMB.1.raw
  modified_base (194)..(194): a, c, t, g, unknown or other
  misc_feature (194)..(194): n is a, c, g, or t
  modified_base (380)..(380): a, c, t, g, unknown or other
  misc_feature (380)..(380): n is a, c, g, or t
tcagatacgacgtacacgaccggtgctcgatttagcgtcgatctcagggggcaggagtcagtcccagtcaggacacagcatggacatgagggtccccgctcagctcctggggctcctgctgctctggctcccaggtgccagatgtgacatccagttgacccagtctccatccttcctgtctgcatctatagganacagatcaccatcacttgccgggccagtcaggacattagctaattatttaggctggtatcagcagaagccaagggaaacgcccctaaacgtcctagatctatggtgcatccattgcatagtcgggtccatcaaggttcagcgacagtggatcgtgggactagaacttcaactctacacaatcaacngcctgcagcctagagtatttgactaacttatactgtactaacgtagtttatactttaccgtcgtttacgtttccgcccgttagggaccctagtacgttacgtataactcaaaacgtacttaggtcggactgaccctacctattccg

SEQ ID NO: 204833 - DNA, 788 bp, Homo sapiens
  misc_feature: GYAE6OF01BZXJG.12.10.A10.1.454.CMB.1.raw
  modified_base (99)..(99): a, c, t, g, unknown or other
  misc_feature (99)..(99): n is a, c, g, or t
  modified_base (200)..(200): a, c, t, g, unknown or other
  misc_feature (200)..(200): n is a, c, g, or t
tcagatacgacgtacacgaccggtgctcgatttagcgtcgatctcagggggcaggagtcagtcccagtcaggacacagcatggacatgagggtccccgntcagctccgtggggctcctgctgctctggctcccaggtgccagatgtgacatccagttcgacccagtctccattcccttcctgtctgctatctagtagganacagacgtcaaccatcgacgttcggcccgggtaccagtcgaggactagttagactaattagttaggctaggtatcagacgagaacgaccgaaggtaaccgacccgtaacgtacctagtactacgtagtcggtactacgtactacctacgtttacgacgtagtacggtacggtacctacgtagtaacccccggttagacggtcgtacgtacggtacggtacgtacggtaggtaacgtaaggtaacttaccgtaccgttacctaccgtaacctaacctacccgaaccgtaccgtaccgtacgtaccgtaccgtaccgttaggttaaacgtttacgtttaaccggtaactttaactttaaccgtttacgttaacgttaaccgttaaacggttttaacggttttaacctttaacccgttttaacccggtttaccggttttaacccggtttacccgggttacccggttaacccgggttaccgttaaccgttaaacggttaacgttaaacgttaaaccgttaaacccgttaaaccggtaaacggttccggttaacggtaccgttaccgtaacccgtaccgttacgtttacccgg

SEQ ID NO: 204834 - DNA, 772 bp, Homo sapiens
  misc_feature: GYAE6OF01BGR99.12.10.A10.1.454.CMB.1.raw
tcagatacgacgtacacgaccggtgctcgatttagcgtcgatctcagggggcaggagtcagtcccagtcaggacacagcatggacatgagggtccccgctcagctccgtggggctcctgctgctctggctccaggtgccagatgtgacatccagttcgacccagtctccatccttctgtctgcatctagtaggagacagacgtcacatcacgttcggccggccagtcaggactattagactaagtttagttaggcttaggtactcgagacgaaggaacgccgaaagggaaaccgaccccgtaacgtccgtagactcgtagtggtcgactacgtcctatttgactaggttcggtccgggtacctagtacgtaagggttccgaggtcggacgtaggtacggacgtacggtaggaactaacggtaacttccgtaaccttcgtaacctaacgtaaccttacccgaaacccgtaccggtacccgtaccgtaacgtaaccggttacccggttaaagtaaccggtttaacgtttttaacccgaaaccttttaaaccgttttaacgtttaccgttaacggttaaccctttaaacggttttaaacggtttttaacctttaacccgtttttaacccgtttacgggttttaacccgttttacccgggaccccggtttacggtaacccgtaacgttaacggttaaacgttaacgttaaccgtaaaccgtaaacccggttagttacggttacggtactacgtaccctaaaccgttcgttaaccgg

SEQ ID NO: 204835 - DNA, 631 bp, Homo sapiens
  misc_feature: GYAE6OF01BRBGJ.12.10.A10.1.454.CMB.1.raw
  modified_base (418)..(418): a, c, t, g, unknown or other
  misc_feature (418)..(418): n is a, c, g, or t
  modified_base (621)..(621): a, c, t, g, unknown or other
  misc_feature (621)..(621): n is a, c, g, or t
tcagatacgacgtacacgaccggtgctcgatttagcgtcgatctcagggggcaggagtcagtcccagtcaggacacagcatggacatggacgggtccccgctcagctccgtggggctcctgctgctctggctcccaggtcgccaggatgtgacatccagttcgaccctagtcctcctacttcccttcctgtctgctattcgtagtaggagacagtacgtaccaccattcacgttcggcccggggactaggtcgaacgactattacgactaatttagttaggcttaggtatcgagtacgaaggaacgaccggaagggtaacccgtacccctaacggtcctagtacttacgtagtcggtcactactaccttagttcgatagtcggtcggtaccagtacgtagtcgaggcgacgtagtagntcggtaggactagtactcacttcaacacgaactcgactacgcctacgcgactcgtaagtacgtttattacgatttaacttctttacgtacgttaacgtaacgtttacgttttacttaaccgtttccgttacgtttacgtccccggacgtacggactaacgtacgtagtaacttacggtaaacacgttacgttcgcgtactacncctgtcttcg

SEQ ID NO: 204836 - DNA, 521 bp, Homo sapiens
  misc_feature: GYAE6OF01C5BS1.12.10.A10.1.454.CMB.1.raw
  modified_base (195)..(195): a, c, t, g, unknown or other
  misc_feature (195)..(195): n is a, c, g, or t
  modified_base (274)..(274): a, c, t, g, unknown or other
  misc_feature (274)..(274): n is a, c, g, or t
  modified_base (302)..(302): a, c, t, g, unknown or other
  misc_feature (302)..(302): n is a, c, g, or t
  modified_base (351)..(351): a, c, t, g, unknown or other
  misc_feature (351)..(351): n is a, c, g, or t
  modified_base (355)..(355): a, c, t, g, unknown or other
  misc_feature (355)..(355): n is a, c, g, or t
  modified_base (359)..(359): a, c, t, g, unknown or other
  misc_feature (359)..(359): n is a, c, g, or t
  modified_base (403)..(403): a, c, t, g, unknown or other
  misc_feature (403)..(403): n is a, c, g, or t
  modified_base (510)..(510): a, c, t, g, unknown or other
  misc_feature (510)..(510): n is a, c, g, or t
  modified_base (515)..(515): a, c, t, g, unknown or other
  misc_feature (515)..(515): n is a, c, g, or t
tcagatacgacgtacacgaccggtgctcgatttagcgtcgatctcaggggggcaggagtcagtcccagtcaggacacagcatggacatgagggtccccgctcagctcctggggctcctgctgctctggctcccaggtgccagatgtgacatccagttgacccagtctccatccttcctgtctgcatctatagganacagagtccaccatcactgccggcagtcaggacattagactaattattaggctggtatcagcagaagccgagggaaacnccccgtaagtcctagtactctagtggtnctatccatttgactagtaggtcggtaccagtcgaaggtcagcgcagtgntcgngganagtatcactcacaacactccacagctgcagtccgtagtaacgtntttacgactaactttattactgtactaacgttagtttatacctttaccgtcgtttacttccggccctagggacctagtagtacattacgtacaaacgtgtgcgtacncgacnctgtac

SEQ ID NO: 204837 - DNA, 798 bp, Homo sapiens
  misc_feature: GYAE6OF01CYFCZ.12.10.A10.1.454.CMB.1.raw
  modified_base (102)..(102): a, c, t, g, unknown or other
  misc_feature (102)..(102): n is a, c, g, or t
tcagatacgacgtacacgaccggtgctcgatttagcgtcgatctcgagggggcaggagtcagtcccagtcaggacacagcatggacatggacgggtccccgntcagctccgtggggctcctgctgctcgtggcctcccgaggtcgccagatgtgactactccgtagttcgacccagtcctcctacttcccttctgtcctgacctattacgtaagtacggacgtaacgaggtacgtaccacctactaccgtacgttccgggacccggggacctaggtacgacggtactagtagtaacttaagttttagttccggtagtaggttactacgacgacgaaggaaccgaccgggaacggtaaaccctaccccgtaacgtccttagacgttcgacggttggtcaccgtacctttcgtacgtttgacgtttaacggtcgggtaccgggttaccaaggttaccgtagggtaccgacgggacgttaggtagggtacgtacctacgggtaagggtaactaaggtaacctttacgtacccgttataacccgaactaacgttacccgaaccgtacgtacgtaccgtacgacccgttaggttaacgtaacggttttacttacgtaaccgtttaaacgtttcttaacggttaacgttaacgttaaaccggttttaccgttttaaccttacccggttttaccctttacggttccggtttacccgacggttaccggtaacctagttaaccgtaagtaaccacgtaaccggttaaacgtccgtcgtaacgtcctaagtccctaagttcgttaccg

SEQ ID NO: 204838 - DNA, 825 bp, Homo sapiens
  misc_feature: GYAE6OF01C5S5A.12.10.A10.1.454.CMB.1.raw
  modified_base (100)..(100): a, c, t, g, unknown or other
  misc_feature (100)..(100): n is a, c, g, or t
  modified_base (126)..(126): a, c, t, g, unknown or other
  misc_feature (126)..(126): n is a, c, g, or t
  modified_base (165)..(165): a, c, t, g, unknown or other
  misc_feature (165)..(165): n is a, c, g, or t
  modified_base (197)..(197): a, c, t, g, unknown or other
  misc_feature (197)..(197): n is a, c, g, or t
  modified_base (306)..(306): a, c, t, g, unknown or other
  misc_feature (306)..(306): n is a, c, g, or t
tcagatacgacgtacacgaccggtgctcgatttagcgtcgatctcgagggggcaggagtcagtcccagtcaggacacagcatggacatgagggtccccgntcagctccgtggggctcctgctgctntggctcccgaggtgccagatgtgacatccagttcgaccngtctccatccttctgtctgcatctaatagganacagtacgtcaccatcgacttggccgggacagtcaggactattagctaatttagttaggctaggtatcagcaagagccagggaacaccctaacgtcctgatctatggtnacatccgtatttgactagtaggtcggggtaccctaagtcgtaaaggttccgaagggtcccggacgtaaggttgggaactttccggtagggggaaacctaagggtaaaacttttcccgaacctttactaacctaaaccgaaactttacccggaaaccccaacgggttcccctaagggtacccgaaccgttacccggttaaggtaaagggtttacgttttttacgaaccgttttaaaccgttttaacttttaacgttacgggttaaacccttaaacccggttttaaaagggtttttttaaacgtttaaccctttttttaacccccggtttaacgggtttttaaaccggtttttttcccccgggggtaacccccgttttaacggggggaaacccccttaaaccgtttaaagggttaacggttaaacctttaacgtttaaaacccgtaaaaaaccggtaacccggttttagggttaacccggggtacctttacgggaccctaaacccggttaacttttcccgg

SEQ ID NO: 204839 - DNA, 672 bp, Homo sapiens
  misc_feature: GYAE6OF01B07WT.12.10.A10.1.454.CMB.1.raw
  modified_base (99)..(99): a, c, t, g, unknown or other
  misc_feature (99)..(99): n is a, c, g, or t
  modified_base (194)..(194): a, c, t, g, unknown or other
  misc_feature (194)..(194): n is a, c, g, or t
  modified_base (667)..(667): a, c, t, g, unknown or other
  misc_feature (667)..(667): n is a, c, g, or t
tcagatacgacgtacacgaccggtgctcgatttagcgtcgatctcagggggcaggagtcagtcccagtcaggacacagcatggacatgagggtccccgntcagctcctggggctcctgctgctctggctcccaggtgccagatgtgacatccagttcgacccagtctccatccttctgtctgcatctatagganacagagtcacatcacttggccggcagtcaggacagttagctaattagtttaggcttggtatcagcagaacgccgaagggaaacgcccccgtaacgtcctagtactctagtggtgacctacttccctagttttcgactagttacgggtcggggttacccctagttacgtaacgggttccgaggacccgggtagtaacggtagggtaacttcggtaggggaacctaagggtaaacctttcgtaaccttcctaactaacctaaacgttacccaacccgtaacggtcccttacggacctacggacccgttaggaaacgtttacttttacggacccttaaacgttttacttacgttagttaacctaaacgttaggttttaacttacgttttaaccctacgtttacgtttccggtacccgtacggacctacgtaagtacgtattaacgacgaaacgtagttggtacgctacgcaccgtnttccg

SEQ ID NO: 204840 - DNA, 655 bp, Homo sapiens
  misc_feature: GYAE6OF01D6RKQ.12.10.A10.1.454.CMB.1.raw
  modified_base (99)..(99): a, c, t, g, unknown or other
  misc_feature (99)..(99): n is a, c, g, or t
  modified_base (199)..(199): a, c, t, g, unknown or other
  misc_feature (199)..(199): n is a, c, g, or t
  modified_base (230)..(230): a, c, t, g, unknown or other
  misc_feature (230)..(230): n is a, c, g, or t
tcagatacgacgtacacgaccggtgctcgatttagcgtcgatctcagggggcaggagtcagtcccagtcaggacacagcatggacatgagggtccccgntcagctcctggggctcctgctgctctggctcccaggtgccagatgtgacatccagttgaccccagtcctccattcccttcctgtctgccatctatagganacagacgtcaccatcacgttggccggcagtnaggacattagactaattagttaggctggtatcagacaagaagccgaaggggtaaaccgtaccccctaacggttccctaggaacttcgtaacgtggtacgtctaacgtccctaacgtttcgacgtagttacggttaccgggggtaccctaagttacgtaaacggttcgacggcgggtacgtaggtacggtaagtcggtaaggggaacctaaaggtaacttactaacctcttacaactaacttacccacgacgtccgtagaccctaaggcctaagtacgttagttttacgaacttaacttaattaccgtattaacgtaaacgttagttttaacttacttttacccttagtttattcccggaccgtaggaccaatacgtataacgactaaacgaaaccgtatacggttcgactagacctcgtaattcg

SEQ ID NO: 204841 - DNA, 695 bp, Homo sapiens
  misc_feature: GYAE6OF01BE3NH.12.10.A10.1.454.CMB.1.raw
  modified_base (306)..(306): a, c, t, g, unknown or other
  misc_feature (306)..(306): n is a, c, g, or t
  modified_base (315)..(315): a, c, t, g, unknown or other
  misc_feature (315)..(315): n is a, c, g, or t
  modified_base (367)..(367): a, c, t, g, unknown or other
  misc_feature (367)..(367): n is a, c, g, or t
  modified_base (387)..(387): a, c, t, g, unknown or other
  misc_feature (387)..(387): n is a, c, g, or t
tcagatacgacgtacacgaccggtgctcgatttagcgtcgatctcagggggcaggagtcagtcccagtcaggacacagcatggacatgagggtccccgctcagctcctggggctcctgctgctctggctcccaggtgccagatgtgacatccagttcgacccagtcctccactccttcctgtctgctatctatacggagacagacgtcaccatccacgttcggcccgggccagtcgaggactatagctaattattaggctggtatcagcaagacgacgaaggaaccgtcccctaacgtcctagatntagtggtcnctactcctacgttgactagtcggtcgggtcctagtcgtaaggttcgagcggntaggtggtactcggtagganacggtacttcgtactccgtacaactacttacccaaccgtacgtccgtacgaccgtactaccgtagggtaaactttacgtttacgaacctttaacgtttaactttacgtacggttaaactaaacgtttaacgttttaacgtttaacccttttaccccggtttacccgttttacgggttttacccccgggtaccccgttaacgggggtaaccccttaacggtaacgttaacgtaacctttaacggtaaaacccgtaaacggtacctttaccgggtggtacccgtacgtaacccttacgttaccgttaccg

SEQ ID NO: 204842 - DNA, 843 bp, Homo sapiens
  misc_feature: GYAE6OF01C1IEY.12.10.A10.1.454.CMB.1.raw
  modified_base (175)..(175): a, c, t, g, unknown or other
  misc_feature (175)..(175): n is a, c, g, or t
  modified_base (231)..(231): a, c, t, g, unknown or other
  misc_feature (231)..(231): n is a, c, g, or t
tcagatacgacgtacacgaccggtgctcgatttagcgtcgatctcaggggggcaggagtcagtcccagtcaggacacagcatggacatggacgggtcccccgctcagctccgtggggcctcctgctgctctggcctccgaggtcgccagattgcgacatccgtagttccgacccngtcctcctacttcccttcctgtctgctatactagaggagacagtacgtccaacctntaccgtacgttccggacccgggacctacggtacgaaccggtactaagttaacgtaacgttaaagttttaaggtttaccggtacgttaaggtaacttacggaacggaaccgtaacggggaaaccgaaccccgggtaaaaccggggaaacccgtttaaccccccggtaaaccggtttaccgtaacgttaaaccgttccgttaaggttaccggggttacctaccgttaaccttacccgttaacggtttcgaaggttaaccgggttacgggttccccgggtaaccgtacggtaacgggtacggttccggacggtcggttaaggtcggaacgttcgggtaacggaacgtaagtttaaccgtaccgttaacaccgtaaccaactacgtacccgtaaccgtacgtacctacggtaacgtaccttaaccggtagttaacggttatttaccgtaactttaaacgttttactaacggtttaactcgtttaaacgtttacgtttaccttaccgttacgtttccgtttacgtaccgggaccttaccgggactagtaacgtaacgtactaagaacccgttagttcggtacggcgttacgaccgttaccaacggttcttcgttacc

SEQ ID NO: 204843 - DNA, 671 bp, Homo sapiens
  misc_feature: GYAE6OF01AXRZ3.12.10.A10.1.454.CMB.1.raw
  modified_base (99)..(99): a, c, t, g, unknown or other
  misc_feature (99)..(99): n is a, c, g, or t
  modified_base (198)..(198): a, c, t, g, unknown or other
  misc_feature (198)..(198): n is a, c, g, or t
tcagatacgacgtacacgaccggtgctcgatttagcgtcgatctcagggggcaggagtcagtcccagtcaggacacagcatggacatgagggtccccgntcagctcctggggctcctgctgctctggctcccaggtgccagatgtgacatccagttcgacccagtcctccatcccttcctgtcctgcatctatagganacagagtcaccatctacgttcggcccgggctagtcgacggtactagttacgacttaaagtttagttaggcgttaggtactacgagaccaaggaacggaccgaaagggaacccgtccccgtaacgtcctagactcgtagtggtcactactctactttcgacgtagtcggtcggtacctagtcgtaagttcgaggtcggactaggtcgacgtcggtaggactagtactcgactcaccactactaccaccacgcgtacgacgcgtaccgttagtaacgtttacttacgtactttaactttacgttacgtaacgttaaccgttaacgtttagttttaaccttaaccgttttacccttacggtttaccgttacccggtccggtaacgtaccgtaacgttaagttaccgtaagttaaccgtaaaccgtaacggttacgtacgggtaccgtaccgtacgtaccctccgttacgttacccg

SEQ ID NO: 204844 - DNA, 606 bp, Homo sapiens
  misc_feature: GYAE6OF01BDHH1.12.10.A10.1.454.CMB.1.raw
  modified_base (195)..(195): a, c, t, g, unknown or other
  misc_feature (195)..(195): n is a, c, g, or t
  modified_base (410)..(410): a, c, t, g, unknown or other
  misc_feature (410)..(410): n is a, c, g, or t
tcagatacgacgtacacgaccggtgctcgatttagcgtcgatctcagggggcaggagtcagtcccagtcaggacacagcatggacatgagggtccccgctcagctcctggggctcctgctgcgctggctcccaggtgccagatgtgacatccagttgacccagtctccatccctccctgtctgcatctgtagganaacaaagtcaccatcacgttcggaccgggactaacgagtagtattcgacctaacgttaatttaaagttggtaatacaaaacgaaaagcaaggacaaacgtacccaaagtcctacctagtatttagtcgctcgccctaccgtgtctagacggtacgggttcggttacccgtagtaacgttcacgtggccgtggacgtcgaaggactagtaacttcnctacactatctagtacgtactacacgtctagaatattattcgtactttaacttattacgtagtacagtacgtacgtacgttaccgcgtacctacctatccgtaccgttacggaccgtacggaccgtaccgaccgtataacggtacgtacggactacggttcgacgtctacgacctactacgttccgtgttccgtac

SEQ ID NO: 204845 - DNA, 713 bp, Homo sapiens
  misc_feature: GYAE6OF01DI276.12.10.A10.1.454.CMB.1.raw
  modified_base (102)..(102): a, c, t, g, unknown or other
  misc_feature (102)..(102): n is a, c, g, or t
  modified_base (127)..(127): a, c, t, g, unknown or other
  misc_feature (127)..(127): n is a, c, g, or t
  modified_base (207)..(207): a, c, t, g, unknown or other
  misc_feature (207)..(207): n is a, c, g, or t
  modified_base (705)..(705): a, c, t, g, unknown or other
  misc_feature (705)..(705): n is a, c, g, or t
tcagatacgacgtacacgaccggtgctcgatttagcgtcgatctcaggggggcaggagtcagtcccagtcaggacacagcatggacatggacgggtccccgntcagctccgtgggctcctgctgctntggcctcccgaggtcgccagatgtgacatcctagttcgaccctagtcctccacttcccttcctgtctgcatctagtaganacagacaccactatcgtacgttcggcccgggtaccaggtacgaaggtactacgttaagacttaagtttacgtttaggtccgttagggtactacgaagacgaacggtaaacggaccggaaacgggggtaaacccctacccccggttaacggttacctacggtaaccttacgttaggttcggtactacctacgtttcctacgtttcgacgttaaggttacgggtccgggtaccctaaggtaccggtaaggtcgaggtacgtgaggtggtacgtcgtaggactaagtacttccaaccttcctaacgacctaacgtccaaacctccgcgtacgccgtaaccgtctaaggtttaatcgtttactaaccttaactttctacttagtaaccgttaagtttactttaacttaccttttcccgttagtttaccgttaccggacgtaccggactagtaacggtataacgtactaaacgtaacgtgttacgggactacgtagtaccctnttgttccg

SEQ ID NO: 204846 - DNA, 765 bp, Homo sapiens
  misc_feature: GYAE6OF01ETMNA.12.10.A10.1.454.CMB.1.raw
  modified_base (195)..(195): a, c, t, g, unknown or other
  misc_feature (195)..(195): n is a, c, g, or t
  modified_base (279)..(279): a, c, t, g, unknown or other
  misc_feature (279)..(279): n is a, c, g, or t
tcagatacgacgtacacgaccggtgctcgatttagcgtcgatctcagggggcaggagtcagtcccagtcaggacacagcatggacatgagggtccccgctcagctcctggggcctcctgctgctctggctcccaggtgccagatgtgacatccagttgacccagtctccatccttcctgtctgcatctatagganacagacgtcaccatccacttcggccggccagtcaggacattagctaattatttaggctggtatcagcagaagccgaagggaacncccctaacgtcctagtactcgtacgtggtcgtactacttcccttacgttttagaccgtaaggttacgggtccggggttacccctaagttaccgtaaacgggtttaccgacgggtcccgggtacggtaacgggttacggggtacttacgggtaacggggaaccgtaaacggttaaactttcccggtaaccctttaacccgttaacccgtaaaacgttaaccgttacccgtaaacccctaccggtacccgttacgggaccctaccgggtacccgttaaggtaaacgttttacttttaccggaactttaaaccgtttacgtttaaccgttacgttaaccgtaaaccgtttaagggttttaacctttaaccgttttaccccgttacggtttaccggttttcccggtacccgtacgggtaaccctaagtaggtaacgtactaacgtaacgtaaacgtacgttcgtacggtacctagccctactcgttaccg

SEQ ID NO: 204847 - DNA, 683 bp, Homo sapiens
  misc_feature: GYAE6OF01DNDM3.12.10.A10.1.454.CMB.1.raw
  modified_base (101)..(101): a, c, t, g, unknown or other
  misc_feature (101)..(101): n is a, c, g, or t
  modified_base (356)..(356): a, c, t, g, unknown or other
  misc_feature (356)..(356): n is a, c, g, or t
  modified_base (412)..(412): a, c, t, g, unknown or other
  misc_feature (412)..(412): n is a, c, g, or t
  modified_base (421)..(421): a, c, t, g, unknown or other
  misc_feature (421)..(421): n is a, c, g, or t
  modified_base (671)..(671): a, c, t, g, unknown or other
  misc_feature (671)..(671): n is a, c, g, or t
tcagatacgacgtacacgaccggtgctcgatttagcgtcgatctcagggggcaggagtcagtcccagtcaggacacagcatggacatggacgggtccccgntcagctccgtgggctcctgctgctctggctcccgaggtcgccaggatgtcgaactactaccgagttcgaccctagttcctcctacttcccttctgttctgctactctaaggtaggacgaacagtacgtaccaactacgtccacgttccggccggcctagtcgaaggtactaagttagacttatttacgttgctaggtatcacgacgaagacgacgaacgggtaacctccccgtaacgtctacgtatctagtcganctactctagttcatacgtaggtccggtaccaggtaaccgtagtccgaggtaccggngtaacggtntaccgtggtaacggactaacggtactttaaccgactacctacgaactaaccgtacgaaccgtaccgccgtacgacgtacggtacccttagggtaaacttacgttttacgtaaccgttaaagtttacgttacttacgtaaacgtttacgttagttttaccttacgtttaccgttacgtttacgtcccgtcgttacggtaccctagtaaaggttcaagttacctagaaacgttacgtgtaccgttacggacnctaccttgtaac

SEQ ID NO: 204848 - DNA, 543 bp, Homo sapiens
  misc_feature: GYAE6OF01CVBRG.12.10.A10.1.454.CMB.1.raw
  modified_base (193)..(193): a, c, t, g, unknown or other
  misc_feature (193)..(193): n is a, c, g, or t
tcagatacgacgtacacgaccggtgctcgatttagcgtcgatctcagggggcaggagtcagtcccagtcaggacacagcatggacatgagggtccccgctcagctcctgggctcctgctgctctggctcccaggtgccagatgtgacatccagttgacccagtctccatccttcctgtctgcatctatagganacagagtcaccatcacttgccgggcagtcaggcattagctaattattaggctggtatcagcagaagcaggaaagcccctaacgtcctgatctatggtgcatccattgctatagtcgggtccagtacgaaggttcagcggacaggtgatctagggacagaattcactctacacaactccactagacctagcagccgtagtaacgtattttcgactaactttattacgttctactaacgttaggtttaacttactttacccgttacgttaccgttttccggaccgttacggaacctacgtacgtagtattaacgtacaaacgtacgtagttacgcttagactacctattacg

SEQ ID NO: 204849 - DNA, 711 bp, Homo sapiens
  misc_feature: GYAE6OF01EADRF.12.10.A10.1.454.CMB.1.raw
  modified_base (100)..(100): a, c, t, g, unknown or other
  misc_feature (100)..(100): n is a, c, g, or t
  modified_base (201)..(201): a, c, t, g, unknown or other
  misc_feature (201)..(201): n is a, c, g, or t
  modified_base (679)..(679): a, c, t, g, unknown or other
  misc_feature (679)..(679): n is a, c, g, or t
tcagatacgacgtacacgaccggtgctcgatttagcgtcgatctcagggggcaggagtcagtcccagtcaggacacagcatggacatgacgggtccccgntcagctccgtggggctcctgctgctctggctcccaggtgccagatgtgacatccagttcgacccagtcctccagtccttcctgtctgcatctaagtagganacagagtaccaccatcacgttcggacccgggtccaaggtcaaggtactattacggactaagttacgtttaggacgttggtaacttcgaacgtacaacggaaacgaccgaacggggtaaacctacccccgttaaaaccggtccgtaacgtacgtacgttaagtcgggtacgactacgtccttacgttagtacgtaggtacgggtcgggtacccaagttacgaaaggttccgaacgggccggtagtacggtaggtacgttacggtaggaaactaggtaacttcctaacctcgtaacctaacgtaaccttaccgaacccgtacgtcccgtacgacctacgtaccgtaacgtatttaactttccgtaaccttaatttaccgtacgttataaaccgttacgtttaacgtttaatttaccttacccgttagttccgttaccgccgttacgtaaccagtaagttactacgtaagtactaaacgtntaccggttgactacgtacccttagcgttaccg

SEQ ID NO: 204850 - DNA, 583 bp, Homo sapiens
  misc_feature: GYAE6OF01C3NWG.12.10.A10.1.454.CMB.1.raw
tcagatacgacgtacacgaccggtgctcgatttagcgtcgatctcagggggcaggagtcagtcccagtcaggacacagcatggacatgagggtccccgctcagctcctggggctcctgctgctctggctcccaggtgccagatgtgacatccagttgacccagtctccatccttcctgtctgcatctataggagacagagtcaccatcacttgccgggcagtcaggacatagctaattattaggctggtatcagcagaagccgaagggaaacgcccctaacgtcctgatctagtggtcgctaactcctaactttgactagtaggtcgggtccagtacgaaggttcaggcggacgaggtggagtcgtaggacagtaacttcaactcacaactaagtaccaaccacgtcctaggacctagaccttaggaagttattttcgaactaactttattacttaagtaactaaaagttactaactacgttcccgtacccccttcgaaccgttcccggaaccgaacgggaccacggtacgtagggaacgtaagttaaacgacgtaacgtcggtacggcttacgccacgttac

SEQ ID NO: 204851 - DNA, 529 bp, Homo sapiens
  misc_feature: GYAE6OF01BD4O6.12.10.A10.1.454.CMB.1.raw
  modified_base (198)..(198): a, c, t, g, unknown or other
  misc_feature (198)..(198): n is a, c, g, or t
  modified_base (311)..(311): a, c, t, g, unknown or other
  misc_feature (311)..(311): n is a, c, g, or t
  modified_base (360)..(360): a, c, t, g, unknown or other
  misc_feature (360)..(360): n is a, c, g, or t
  modified_base (388)..(388): a, c, t, g, unknown or other
  misc_feature (388)..(388): n is a, c, g, or t
  modified_base (402)..(402): a, c, t, g, unknown or other
  misc_feature (402)..(402): n is a, c, g, or t
  modified_base (406)..(406): a, c, t, g, unknown or other
  misc_feature (406)..(406): n is a, c, g, or t
  modified_base (413)..(413): a, c, t, g, unknown or other
  misc_feature (413)..(413): n is a, c, g, or t
  modified_base (431)..(431): a, c, t, g, unknown or other
  misc_feature (431)..(431): n is a, c, g, or t
  modified_base (525)..(525): a, c, t, g, unknown or other
  misc_feature (525)..(525): n is a, c, g, or t
tcagatacgacgtacacgaccggtgctcgatttagcgtcgatctcaggggggcaggagtcagtcccagtcaggacacagcatggacatgagggtccccgctcagctcctggggctcctgctgctctggctcccaggtgccagatgtgacatccagttgacccagtcctccatcccttcctgtctgcatctataggganacagactcaccatccacttcgcccgggccagtcgaggacattagctaattatttaggctggtatcagcagaagccgaaggaaacgcccctaacgtcctagactcgtagtggtnctactcctactttgctagtacggtcgggtcccagtctaaggtcagtcgnaggtgacgtcgtaggacagattcactcncacatcacagctcncacnctagatntttgacttacttattctntactacgttagttacttactttacctcgttactttccggccgtcggaccacgtagtatatactacaaacgtacgtcgtcgactcactacccgtntccg

SEQ ID NO: 204852 - DNA, 683 bp, Homo sapiens
  misc_feature: GYAE6OF01BUKMF.12.10.A10.1.454.CMB.1.raw
  modified_base (100)..(100): a, c, t, g, unknown or other
  misc_feature (100)..(100): n is a, c, g, or t
  modified_base (510)..(510): a, c, t, g, unknown or other
  misc_feature (510)..(510): n is a, c, g, or t
  modified_base (540)..(540): a, c, t, g, unknown or other
  misc_feature (540)..(540): n is a, c, g, or t
tcagatacgacgtacacgaccggtgctcgatttagcgtcgatctcagggggcaggagtcagtcccagtcaggacacagcatggacatgagggtcccccgntcagcctcctggggctcctgctgctcgtggcctcccgaggtcgccagatgtgacagtccagttcgacccagtcctcctacttccctttcctgttctgactatcgtaagtaggacacagtacgtacaccatcctacgttcggcccggctagtcaggactatagtactaagtttagttaggcttaggtatcgagacgaacggacgaccgaacggggaaaccctaccccgtaacgttcctagacttacgttagtcggttacaccgtacttaccgtacttttacgaccgtaacggttacgggttccgggtaccctaagtaccggtacggttaccgaggccggtagtacggtggtacgtacggtaggaacctaagtacgttacctacctacgtaccgaaacttacgaccaaccgngtcctacgacgacgtcaagttactttactnaaccgtttatacgttacagtaacttacgttaattccgttactttaaccgttcgttacgttcccggtacgtaccgtacgttaacgagttaactaagtaacttaacgaaccgttagttccgaacgtctaacgctaaacgtgtacc

SEQ ID NO: 204853 - DNA, 672 bp, Homo sapiens
  misc_feature: GYAE6OF01BXP6G.12.10.A10.1.454.CMB.1.raw
  modified_base (100)..(100): a, c, t, g, unknown or other
  misc_feature (100)..(100): n is a, c, g, or t
tcagatacgacgtacacgaccggtgctcgatttagcgtcgatctcagggggcaggagtcagtcccagtcaggacacagcatggacatggagggtccccgntcagctccgtggggctcctgctgctctggctcccaggtgccagatgtgacagtccagttcgacccagtcctccacttcccttcctgttcctagcctattcctaagtagggagactagacgtccaaccatcacgttcggccgggacagtccgaggactattagactaattagtttaggcttggtatcagacgaagtaacgacggaaacgggaaaccgtaccccgtaacgtcctagtactacgtagttggtactactaacttcctacgtttcgactagtacgggttaccggtacccagtacggtaaggttacgacggtcggacgtaaggtacgggtacgtacggtacggggaaactacggtaacttacctactactacctaacgtactacccaacgaccgtcgagactacgtacgtagtaacgtactttgaacttaattagtacttacgtataacgtttacgtttacttactttaccgttacgttatttccggacgttaggaacccgttagaacgttagtattaacgtaccgtaaacgtacgttacgtacgttacttacgactacctcgttacg

SEQ ID NO: 204854 - DNA, 751 bp, Homo sapiens
  misc_feature: GYAE6OF01EUK8M.12.10.A10.1.454.CMB.1.raw
  modified_base (99)..(99): a, c, t, g, unknown or other
  misc_feature (99)..(99): n is a, c, g, or t
  modified_base (202)..(202): a, c, t, g, unknown or other
  misc_feature (202)..(202): n is a, c, g, or t
tcagatacgacgtacacgaccggtgctcgatttagcgtcgatctcagggggcaggagtcagtcccagtcaggacacagcatggacatgagggtccccgntcagctccgtggggcctcctgctgctctggctcccaggtgccagatgtgacatccagttgacccagtctaccatcccttcctgtcctgcattctaataggganacgagtacgtccgaaccatcaacgttcggaccccggcctagtcgaaggtacctagttacgactaaatttagttacggcttaggttatactagtacaggaaacgccgaagggaaaccgacccccgttaaacggtccgtagtactccgtaagtgggtacgtcacttccgttagtttcgactaagttacggtccgggtacctagtaaccggtaaaggttacgaaggtcggtaacgtacggtaggtacgtcggtagggaacctaaaggttaaccttacgtacctcccttaaccgaacctaacgttacccaaccgaacggtcccgtaagaccgaacgtccgttaagtaacgtttaacgtttacaacgttaactttaacgtacgttactaacgtaaacggtttagtttaaccgttacgttttaccgtcggttttacggtttcccgtacccggtacgtaaccgtaacctacggttaacggtaattaacggtaaaccgttaaaaccggtcgttaacggtaccgtaccgtttagacccttaaccgtcgtttaacccgg

SEQ ID NO: 204855 - DNA, 742 bp, Homo sapiens
  misc_feature: GYAE6OF01BFE5Y.12.10.A10.1.454.CMB.1.raw
  modified_base (736)..(736): a, c, t, g, unknown or other
  misc_feature (736)..(736): n is a, c, g, or t
tcagatacgacgtacacgaccggtgctcgatttagcgtcgatctcagggggcaggagtcagtcccagtcaggacacagcagtggacatgagggtccccgctcagctccgtggggctcctgctgctctggctcccagataccagactgtcgacagtcggagactacgacccagtctaccacttccctccttgtcgtgcctatcgtggtagagactagacgtaccactatcacggttcggaccggtacaggtcgacggggactagttagtactttaagttttacgaccgttaggtactacgagacgaaacgaaccggtaagggtaaacccttaccgtaacctacccgttacggtacgtaacgttacttacgtcgtcttacggacctccgttaccgttactttacggaacctacgtaccggtaccggttccctagttccggttccggttacgcgggtccgacggtaggtccggtaacggtggtacgggactacggttaccgttacgaccttaccgtacgtaaccgtatacgacctaccggacgtacgtcggtaccaccggttaacgtacggtaacgttggttaataccgtaacctttacggttttaactaacggttacaaaacgttaaccgttaactacgttacccgtaccgttccccttacgacccgggttaaggacccggtacggtaccggtaacgtccggaagtcgtaaacgtcggaaacccgtggtaccgcggtntacccg

SEQ ID NO: 204856 - DNA, 838 bp, Homo sapiens
  misc_feature: GYAE6OF01B16D7.12.10.A10.1.454.CMB.1.raw
  modified_base (185)..(185): a, c, t, g, unknown or other
  misc_feature (185)..(185): n is a, c, g, or t
  modified_base (830)..(830): a, c, t, g, unknown or other
  misc_feature (830)..(830): n is a, c, g, or t
tcagatacgacgtacacgaccggtgctcgatttagcgtcgatctcagggggcaggagtcagtcccagtcaggacacagcatggacatgagggtccccgctcagctccgtggggctcctgctgctctggctcccaggtgccagatgtgacactccagttcgacccagtcctccattcccttccgtntcctgcattctagtaggagacgagacgtacaacctatacctacgttcgggaccccgggacctacgtaccgaggactagtttaacgtactaaaagttttacgtttacgggtaccgttaggttaaccgttaccgaacggaccgaagggaaccggtaaccccggtaaacgggggaaaacccgtaccccccgttaaccggttacccgttaggtaccttaccggttaggttcgggtacgtaccttaccgttacccgttacgtttacgacgttacggttcgggtaccggggttaccctaagttaccggtaacgggttaccgacgggtccgtaacggtaggtacgggtactacgggtaagggaaaccgttaaggtacctttaccgtaacttaccgtaacctaacgtacctaccgaacctacgtccgtagacctacgtaccgtaagtaacgtttcgttaacgtaacttaattaccgttacgttacgttaaccgtaggtttaacctttttacgttaaccgttttccccgtttaacggtttacccggtttacccggcccgggttacggtaaccctacgggttaacgtaacgttaacgttaaccgtaaccgtaaaccgttacgtcgggttacgccgttaaaccgccttaaccgttntttcccgg

SEQ ID NO: 204857 - DNA, 719 bp, Homo sapiens
  misc_feature: GYAE6OF01CKWCV.12.10.A10.1.454.CMB.1.raw
  modified_base (147)..(147): a, c, t, g, unknown or other
  misc_feature (147)..(147): n is a, c, g, or t
  modified_base (201)..(201): a, c, t, g, unknown or other
  misc_feature (201)..(201): n is a, c, g, or t
  modified_base (212)..(212): a, c, t, g, unknown or other
  misc_feature (212)..(212): n is a, c, g, or t
  modified_base (278)..(278): a, c, t, g, unknown or other
  misc_feature (278)..(278): n is a, c, g, or t
tcagatacgacgtacacgaccggtgctcgatttagcgtcgatctcgagggggcaggagtcagtcccagtcaggacacagcatggacatggagggtccccgctcagctccgtggggctcctgctgctctgggcctcccaggtgccagntgtgacatcagttcgacccagtcctccattccttcctgtctgcatcagtagganacagactcacntcacgttcggccggactagcgacggtactaagttacgactaagtttacgtttaggcttaggttaancgaagacgaggaacgaccggaacgggaaccgtacccccgttaaacggtcctacggtattaccgtaggtacggtacgacctaacttccgtaacgtttgacgttaacggtcgggttccggtacctaacgtacgtaaagggttccgaacgggtccggacgtagggtaggtacttacggggttaacggacgtaaagtacttacctaactcctaacaactaactacacccgaacgcctacgacgacgtaccgtaaggtaatttacgttagtacttaggttattactttaggttcgtacgtagtacgttaggtaggttaccgtacggtacccgtacgtaacccgttacgttaccggtttacgggtacccgggtacgggaacggtaacggtcgggtaaagaacggtaaacgggtaacgtaaaacgggtctacgggtcggttaacccgg

SEQ ID NO: 204858 - DNA, 670 bp, Homo sapiens
  misc_feature: GYAE6OF01ER46S.12.10.A10.1.454.CMB.1.raw
tcagatacgacgtacacgaccggtgctcgatttagcgtcgatctcagggggcaggagtcagtcccagtcaggacacagcatggacatgagggtccccgctcagctcctggggctcctgctgctctggctcccaggtcgccagatgtgacatccagttgacccagtcctcctactcccttcctgtctgcctattctaagtaggacgacagagtccaaccatcctacgttcggcccgggaccacggtacgacggaactaattagactaatttagttaggtctaggtactacgagacgaagaacgcgaaggggaaacccgcccctaacggtctagtactcgtagtcggtatactactccttagttcacgtaaggtacggttccgggtacctaacgtacgtaacggttccgacgggtccggaggtaggtcgggtactacgggtacggaactaagtaactttaccacttaccctaacaaccttaacgtcccgaaaccgtcggtaccgtagacccaccggtactaagtacgtttaacttcgaacttacttacttacgtagtaactaacgtttatttacttacctttaccggtcttttaccgtcccggtaacgtccggtactaagtagtaatactaactaacgaacgtgttcggtcgatacccggactacctgttcc

SEQ ID NO: 204859 - DNA, 856 bp, Homo sapiens
  misc_feature: GYAE6OF01B9C0D.12.10.A10.1.454.CMB.1.raw
tcagatacgacgtacacgaccggtgctcgatttagcgtcgatctcagggggcaggagtcagtcccagtcaggacacagcatggacatgagggtccccgctcagctcctgggctcctgctgctctggctcccaggtgccagatgtgacatccagttcgacccagtcctccattcccttcctgtcctgctatctagtaggagacagagtccacatcacgtcggccggccagtcgaggactattagactaatttagtttacggtcgttaggtactacgacgtacgaacggaacggacccggaaacggggaaaccgtacccccgttaaccgtccgtacgtacttaccgttagtcgggtacgccgtactccgtactttcggactaacgttacggtccggggttacctagtaccgtaaggttccgaggaccgggtacgaggttacgggactaccgggtaggtaacgtaaggtaactttacccgtaacttaccttaaccaaactaaccgtacccgtaacccggtaccgtacccgttacgtacccgtacggtacccgttaagggttaaccgtttaacgtttttaacgaaccgttttaaaccgttttacttttaaccggtacttaaaacccggtttaaacgttttaacgggtttttttaaacgtttaaccccgtttttaccccgttttaaccgggtttttaacccggttttaccccggggttacccggtttacccggtaaacccgttaacgggtttaaaccgttaaccgggttaaactttaaaccggttaaaccccgttaaaaccggttaacgttccgggtttaaggtccccgtaacgtttaccccaaccgttttaccgttcccg

SEQ ID NO: 204860 - DNA, 719 bp, Homo sapiens
  misc_feature: GYAE6OF01EBS5J.12.10.A10.1.454.CMB.1.raw
tcagatacgacgtacacgaccggtgctcgatttagcgtcgatctcaggggggcaggagtcagtcccagtcaggacacagcatggacatgagggtcccccgctcagctccgtggggcctcctgctgctctggctcccgaggtcgccagatgtagacactccgagttcgacccctagtcctccctacttccctttcctgtcctcgcctattctaagtagggacgaacagtacgtaccacctattccgtaccgttcggcccgggaccagtaccgaggtacctagttagacttaatttagtttacggtcttaggtatcgtagacaaggacgaccgaacgggaacctaccccgtaacgtcctacgtacttcgtagtaggtctactactcctagttacgacgtagttacgggtccggggtaccctagtaccgtaaggttcgacggcgagtaggtggtagtcggtaggactagtacttccaacttctaaccaactaactacctaaccgacgtccgtacgaccgtacgtaccgtaagtaacgttacgtttctaaccttaactttaacttacgtacgtacgtaacgtttacgtttaactttacccgtttacccgttacgtttaccggtttacccggaccgttacggtacctaagttacgtacggttaactaacggtacgaaaaccggtagttacggtacgtaccttacggaacccttcgtacgttccg

SEQ ID NO: 204861 - DNA, 148 bp, Homo sapiens
  misc_feature: GYAE6OF01BV5YB.12.10.A10.1.454.CMB.1.raw
  modified_base (137)..(137): a, c, t, g, unknown or other
  misc_feature (137)..(137): n is a, c, g, or t
  modified_base (141)..(148): a, c, t, g, unknown or other
  misc_feature (141)..(148): n is a, c, g, or t
tcagatacgacgtacacgaccggtgctcgatttagcgtcgatctcagggggcaggagtcagtcccagtcaggacacagcatggacatggagggtccccgctcagctccgtgggctctgctgctcgtggctcccaggngcannnnnnnn

SEQ ID NO: 204862 - DNA, 603 bp, Homo sapiens
  misc_feature: GYAE6OF01CMLZG.12.10.A10.1.454.CMB.1.raw
  modified_base (201)..(201): a, c, t, g, unknown or other
  misc_feature (201)..(201): n is a, c, g, or t
  modified_base (323)..(323): a, c, t, g, unknown or other
  misc_feature (323)..(323): n is a, c, g, or t
  modified_base (386)..(386): a, c, t, g, unknown or other
  misc_feature (386)..(386): n is a, c, g, or t
  modified_base (434)..(434): a, c, t, g, unknown or other
  misc_feature (434)..(434): n is a, c, g, or t
  modified_base (598)..(598): a, c, t, g, unknown or other
  misc_feature (598)..(598): n is a, c, g, or t
tcagatacgacgtacacgaccggtgctcgatttagcgtcgatctcagggggcaggagtcagtcccagtcaggacacagcatggacatgagggtccccgctcagctcctggggctcctgctgctcgtggcctcccaggtgccagatgtgacatccagttcgacccagtcctccacttcccttcctgtctgcatctatagganacgagacgtccacatcctacgtcggcccgggccaggtcaggactagttagctaattatttacggcttggtatcagcaagacgacgaaggaaacgtccccgtaacgtctagctctagtggtcnctactaccgtacgttcgactagtacggtcggggtacccagtacgtaacggttcgacggtcggngacggtggacgtggaggacagtactctacctctacataactcaaccgngtcctcgacacgccgtaagttaagtactttagcttaacttaacttctcgtaacgtaacgtttaggttactttacctttcccttagggtttccttccggcggtacggacctacggttaatacgtaatacgtaacgaacgcgttaggtctacgtcgaaccttacgnttccg

SEQ ID NO: 204863 - DNA, 824 bp, Homo sapiens
  misc_feature: GYAE6OF01BOOZZ.12.10.A10.1.454.CMB.1.raw
  modified_base (212)..(212): a, c, t, g, unknown or other
  misc_feature (212)..(212): n is a, c, g, or t
tcagatacgacgtacacgaccggtgctcgatttagcgtcgatctcagggggcaggagtcagtcccagtcaggacacagcatggacatgagggtccctgctcagctccgtgggactcctgctgctctggcctccagataccagatcgtagacatcgagatcgaccctagtcctaccacttcccttcctgtctcgctacttcgtaggtacgganacgagtacgtaccacctataccgtacggttccgggccgggtacgacggttaccggagggtactaagtttacgtaacgttttagttttacggccgttaggtactacgacgaacgaaacggtaaaccgaacggggtaaccttacccgaacctacccttcgtacgtactacttcgtcgaccttgaccttacgttcccttacgtttacgaccgttaacggtccggtaccggttacccacggtttccgtaaccgggtacgacgggttaccgtacggtacgggttaggtaccggtacgggtaacggtacgtacggtttacgtacccgttacctacccggtactaacgttaccgacgtacgtacccggtacctccggtacgacgtacccggttagtaacggtacgtttctacgttaacgtaaccgtttaacgttacgttaacccttaaggtaaaccttaaacggtttaccgtaaccgtttaccccgttacccccggttacccctttacccggtaaacccgggtaccgtaacccgggttaagacccccgggtttaagaaaccgggttcgtaaaacggttacccggtaaagtacccgggttatccccgggttcgtaacccg

SEQ ID NO: 204864 - DNA, 668 bp, Homo sapiens
  misc_feature: GYAE6OF01EK7B8.12.10.A10.1.454.CMB.1.raw
  modified_base (99)..(99): a, c, t, g, unknown or other
  misc_feature (99)..(99): n is a, c, g, or t
tcagatacgacgtacacgaccggtgctcgatttagcgtcgatctcagggggcaggagtcagtcccagtcaggacacagcatggacatgagggtccccgntcagctcctggggctcctgctgctctggctcccaggtgccagatgtgacatccagttgacccagtctccatccttcctgtctgcatctataggagacagagtcaccatccacttggccgggccagtcaggacattagcaattatttaggctggtatcagcagaacgaccgagggaaacgcccctaaacggtcctgactcgttaatggtcgcactccctactttcgactagttacggtcgggggtaccctagtaccgtaaggtttccgaggcggtacgaggtggacgtcgtaggggacaggtaattcctacgtccttacaacgtaactacaccacgccctgaaccacggtccctaggtaacgttcgttttacgaccttaactttaacttacgtagtttaccgtaaacgttacggttttaacttaccgtttttacccctttaggtttaccgtttttacccgggtccccggttacggggtaaccccaaggttaaccggttacgtaaattacgtaaacccgtaaacgtaaacgttaggtaccggttactacgggaaccctaccgtacttaccg

SEQ ID NO: 204865 - DNA, 700 bp, Homo sapiens
  misc_feature: GYAE6OF01DYZIV.12.10.A10.1.454.CMB.1.raw
tcagatacgacgtacacgaccggtgctcgatttagcgtcgatctcagggggcaggagtcagtcccagtcaggacacagcatggacatggacgggtccccgctcagctccgtggggcctcctgctgctcgtggcctcccgaggtgccagatgtgacactaccgagttcgacccagtcctcctacttccttctgtctgacatctaacgtaggacgacagacgtccacctatcacgttggccggctagtcaggtactattagactaattagttacggacttggtactacgagcgaagacgtccggaaggaaccctaccccttaacgtccgtaatacgttccgtaaggtcggtactaccgtacttacccttaagtttcgacgttacgtacgggtccggtacctagtacggtaggtcgacgggtcgtacggtaggtacgtacgttcgggtacggtaacgtattaaccgtttccaccttccgaactacgtatcccgaagtcctaaggttctaaccgaccgtaacgttagaacttacttccgattaacttaaccgttattccgtaagtaccaaagtcgtaaactaacccgttaccgttaccccgacgttccgggtacgggaaccggtaacgggacgtaacgggtacggaatacccgtaaaggaacccgttacggttcggtaaacggtccaccgtaacctcgttacgg

SEQ ID NO: 204866 - DNA, 496 bp, Homo sapiens
  misc_feature: GYAE6OF02GVO5I.12.10.A10.1.454.CMB.1.raw
tcagatacgacgtacacgaccggtgctcgatttagcgtcgatctcaggggcaggagtcagtcccagtcaggacacagcatggacatgagggtcccgctcagctcctggggctcctgctgctctggctcccaggtgccagatgtgacatccagttgacccagtctccatccttcctgtctgcatctataggagacagagtcaccatcacttgccgggccagtcaggacattagcaattatttaggctggtatcagcagaagccagggaaagcccctaaagtcctgatctatggtgcatccactttgcatagtggggtcccatcaaggttcagcggcagtggatctgggacagaattcactctcacaatcacagcctgcagcctgaagattttgctaacttattactgtactaactaggtttaatatttacccttcgtattttccggcccgttcggacctactagtagattatactaaacgactagtgctgctacatc

SEQ ID NO: 204867 - DNA, 498 bp, Homo sapiens
  misc_feature: GYAE6OF02F0G64.12.10.A10.1.454.CMB.1.raw
tcagatacgacgtacacgaccggtgctcgatttagcgtcgatctcagggggcaggagtcagtcccagtcaggacacagcatggacatgagggtccccgctcagctcctggggctcctgctgctctggctcccaggtgccagatgtgacatccagttgacccagtctccatccttcctgtctgcatctataggagacagagtcaccatcacttgccgggccagtcaggacattagcaattatttaggctggtatcagcagaagccagggaaagcccctaacgtcctgatctatggtgcatccactttgcatagtggggtcccatcaaggttcagcggcagtggatctgggacagaattcactctcacaatcaccagcctgccagcctagaagtattttgactaactttattactgtactaactaggtttatatttaccctgttacttttcggcccttgggaccacgtagtagatatacaaacgactgtgctgctacatc

SEQ ID NO: 204868 - DNA, 513 bp, Homo sapiens
  misc_feature: GYAE6OF02G2PXK.12.10.A10.1.454.CMB.1.raw
tcagatacgacgtacacgaccggtgctcgatttagcgtcgatctcagggggcaggagtcagtcccagtcaggacacagcatggacatgagggtccccgctcagctcctggggctcctgctgctctggctcccaggtgccagatgtgacatccagttgacccagtctccatccttcctgtctgcatctataggagacagagtcaccatcacttgccgggccagtcaggacattagcaattattaggctggtatcagcagaagccagggaagcccctaacgtcctgatctatggtgcatccactttgcatagtgggtccatcaaggttcagcgcagtgatctgggacagaattcactctacacaatcaaccagcctgcagcctagaagtattttgctaacttattactgtacacgtaagtttattactttaccctgttacttttccggccttacgggacctacgtagtacgtacttataccgaaacgtaattggtacggctagacctacctatcg

SEQ ID NO: 204869 - DNA, 172 bp, Homo sapiens
  misc_feature: GYAE6OF02IR49Q.12.10.A10.1.454.CMB.1.raw
  modified_base (170)..(172): a, c, t, g, unknown or other
  misc_feature (170)..(172): n is a, c, g, or t
tcagatacgacgtacacgaccggtgctcgatttagcgtcgatctcagggcccatcggtcttcccctggcgccctgctccaggagcacctccgagagcacagcggccctgggctgcctggtcaaggactacttcctacgtcgtatctgagcgggctggcaaggcgcatagnnn

SEQ ID NO: 204870 - DNA, 257 bp, Homo sapiens
  misc_feature: GYAE6OF02GGWC0.12.10.A10.1.454.CMB.1.raw
  modified_base (254)..(257): a, c, t, g, unknown or other
  misc_feature (254)..(257): n is a, c, g, or t
tcagatacgacgtacacgaccggtgctcgatttagcgtcgatctcagggggttacatcggctactattatcactacatggacgtctgggacaaagggaccacggtcgccgtctcctcagcctccaccaagggcccatcggtcttccccctggcgccctgctccaggagcacctccgagagcacagcggccctgggctgcctggtcaaggactacttcctacgtcgtatctgagcgggctggcaaggcgcatagnnnn

SEQ ID NO: 204871 - DNA, 488 bp, Homo sapiens
  misc_feature: GYAE6OF02HSZ8L.12.10.A10.1.454.CMB.1.raw
  modified_base (461)..(461): a, c, t, g, unknown or other
  misc_feature (461)..(461): n is a, c, g, or t
  modified_base (474)..(474): a, c, t, g, unknown or other
  misc_feature (474)..(474): n is a, c, g, or t
tcagatacgacgtacacgaccggtgctcgatttagcgtcgatctcaggggcaggagtcagtcccagtcaggacacagcatggacatgagggtccccgctcagctcctgggctcctgctgctctggctcccaggtgccagatgtgacatccagttgacccagtctccatccttcctgtctgcatctataggagacagagtcaccatcacttgccgggccagtcaggacattagcaattatttaggctggtatcagcagaagccagggaaagcccctaaagtcctgatctatggtgcatccactttgcatagtgggtcccatcaaggttcagtgcagtggtctgggacagatttcactctcaccatcagcagtctgcaacctgaagattctgcaactttattactgtcaaacagataacagttaaccctccaactttcgggcggtagggaccaaagggtgganatcaaacgactgnggcctggcaccatc

SEQ ID NO: 204872 - DNA, 506 bp, Homo sapiens
  misc_feature: GYAE6OF02JED7N.12.10.A10.1.454.CMB.1.raw
tcagatacgacgtacacgaccggtgctcgatttagcgtcgatctcagggggcaggagtcagtcccagtcaggacacagcatggacatgagggtccccgctcagctcctggggctcctgctgctctggctcccaggtgccagatgtgacatccagttgacccagtctccatccttcctgtctgcatctataggagacagagtcaccatcacttgccgggccagtcaggacattagcaattatttaggctggtatcagcagaagccaagggaaacgcccctaaacgtcctgatctatggtgcatccactttgcatagtgggtcccatctaaggttcagcggcagtggatcgtgggacagaattcactctacacaatccaccagcctgccagcctagaacgtattttcgactaactttattactgtactaactagtttatacttttcctcgttactttcggacctcgggaccactagtagatatacaaacgtactgtggctgctacatc

SEQ ID NO: 204873 - DNA, 519 bp, Homo sapiens
  misc_feature: GYAE6OF02H09X7.12.10.A10.1.454.CMB.1.raw
tcagatacgacgtacacgaccggtgctcgatttagcgtcgatctcaggggcaggagtcagtcccagtcaggacacagcatggacatgagggtccccgctcagctcctggggctcctgctgctctggctcccaggtgccagatgtgacatccagttgacccagtctccatccttcctgtctgcatctataggagacagagtcaccatcacttgccgggccagtcaggacattagcaattatttaggctggtatcagcagaagccagggaaagcccctaaagtcctgatctatggtgcatccacttttgcatagtggggtcccatcaaggttcagcggcagtggatctgggacagaattcactctcacaatcaccagccctgcagcctagaagtattttgcaactttattactgtaccaactagttttatattttaacccttgttattttcggacccttgggacctacgagtaagtattaatactaaacgaacttggtacggacttgactacccgattccg

SEQ ID NO: 204874 - DNA, 567 bp, Homo sapiens
  misc_feature: GYAE6OF02GXPNQ.12.10.A10.1.454.CMB.1.raw
tcagatacgacgtacacgaccggtgctcgatttagcgtcgatctcagggggcaggagtcagtcccagtcaggacacagcatggacatgagggtccccgctcagctcctggggctcctgctgctctggctcccaggtgccagatgtgacatccagttgacccagtctccatccttcctgtctgcatctataggagacagagtaaccatcacttgccgggccagtcaggacattagcaattattaggctggtatcagcagaagccagggaaacgcccctaagtcctgatctatggtgcatccactttgctatagtgggtcccatcaaggttcagcggcagtggatcgtgggacagattcactctcacaatcaccagcctgcagcctagaacgtattttgactaactttattactgtactaacttaggttttaacttacgttttacccttacgtttacgttttcccggacccgttacgggaaccctacgtacgttaacgtaacttaacttaccgtaaaaccgtaaccgttggtacggtccttacggaccctaacccgtacttccgttacg

SEQ ID NO: 204875 - DNA, 508 bp, Homo sapiens
  misc_feature: GYAE6OF02F1ZIV.12.10.A10.1.454.CMB.1.raw
tcagatacgacgtacacgaccggtgctcgatttagcgtcgatctcagggggcaggagtcagtcccagtcaggacacagcatggacatgagggtccccgctcagctcctggggctcctgctgctctggctcccaggtgccagatgtgacatccagttgacccagtctccatccttcctgtctgcatctataggagacagagtcaccatcacttgccgggccagtcaggacattagcaattatttaggctggtatcagcagaagccagggaaagcccctaaacgtcctgatctatggtgcatccactttgcatagtggggtcccatcaaggttcagcggcagtggatcgtgggacagaattcactctcacaatcaccagccctgcagcctagaagtattttgactaactttattactgtacaactaggttttaactattttaccctcgttacttttcggcccttgggaccactagtaagatatacaaacgactgtacgctgcaccgatcg

SEQ ID NO: 204876 - DNA, 517 bp, Homo sapiens
  misc_feature: GYAE6OF02GESIU.12.10.A10.1.454.CMB.1.raw
  modified_base (364)..(364): a, c, t, g, unknown or other
  misc_feature (364)..(364): n is a, c, g, or t
tcagatacgacgtacacgaccggtgctcgatttagcgtcgatctcagggggcaggagtcagtcccagtcaggacacagcatggacatgagggtccccgctcagctcctggggctcctgctgctctggctcccaggtgccagatgtgacatccagttgacccagttctccatccttcctgtctgcatctataggagacagagtcaccatcacttgccgggccagtcaggacattagcaattatttaggctggtatcagcagaagccagggaacgcccctaacgtcctgatctatggtgcatccactttgcatagtcgggtcccatcaaggttcagcggcagtgatcgtgggacagattcactctnacaatcaccagcctgcagccttagaatatttgactaattattactgactaagtagtttatacttttacctcgttactttccgcctagggtaccagtacgtaagacttactaacgtaaacgtacttggtacggtacctgacctaccgtattccg

SEQ ID NO: 204877 - DNA, 592 bp, Homo sapiens
  misc_feature: GYAE6OF02FEXEO.12.10.A10.1.454.CMB.1.raw
  modified_base (364)..(364): a, c, t, g, unknown or other
  misc_feature (364)..(364): n is a, c, g, or t
tcagatacgacgtacacgaccggtgctcgatttagcgtcgatctcagggggcaggagtcagtcccagtcaggacacagcatggacatgagggtccccgctcagctcctggggctcctgctgctctggctcccaggtgccagatgtgacatccagttgacccagtctccatccttcctgtctgcatctataggagacagagtcaccatcacttgccgggcagtcaggacattagcaattatttaggctggtatcagcagaagccgagggaacgcccctaacgtcctgatctatggtgcatccactttgctataggtcggggtccatcgaaggttcagcggcagtgatcgtgggacagatcactcncacaatcaccagcctgccagcctagaacgttattttacgacttaactttattaacttgtactaacgttaggtttttaacttactttttacccgtcgttttaacgtttttcccgggacccgttacggggtaccctaacggtacggttaacgtaacttaaacgttaacccgtaaaaccggttaaccgttcgggttacggtaccgttaggaccctaccgttagtttacccg

SEQ ID NO: 204878 - DNA, 504 bp, Homo sapiens
  misc_feature: GYAE6OF02HAH54.12.10.A10.1.454.CMB.1.raw
  modified_base (471)..(471): a, c, t, g, unknown or other
  misc_feature (471)..(471): n is a, c, g, or t
tcagatacgacgtacacgaccggtgctcgatttagcgtcgatctcagggggcaggagtcagtcccagtcaggacacagcatggacatgagggtccccgctcagctcctggggctcctgctgctctggctcccaggtgccagatgtgacatccagttgacccagtctccatccttcctgtctgcatctataggagacagagtcaccatcacttgccgggccagtcaggacattagcaattatttaggctggtatcagcagaagccagggaaagcccctaacgtcctgatctatggtgcatccactttgcatagtggggtcccatcaaggttcagcggcagtggatcgtgggacagaattcactctcacaatcaccagcctgcagcctagaagtatttgctaactttattactgtacaactaggtttatactttacccttcgttattttccggcccttgggaccacgtagtanaattatacaaacgactgtaggtctagcaccatc

SEQ ID NO: 204879 - DNA, 548 bp, Homo sapiens
  misc_feature: GYAE6OF02F6P3N.12.10.A10.1.454.CMB.1.raw
  modified_base (270)..(270): a, c, t, g, unknown or other
  misc_feature (270)..(270): n is a, c, g, or t
tcagatacgacgtacacgaccggtgctcgatttagcgtcgatctcagggggcaggagtcagtcccagtcaggacacagcatggacatgagggtccccgctcagctcctggggctcctgctgctctggctcccaggtgccagatgtgacatccagttgacccagtctccatccttcctgtctgcatctgtgggagacagagtcaccatcacttgccgggcaagtcagaggattagcagttatttaaattggtgtcagcagaagccaggganagcccctaaggtcctgatctatgcttcatccagtttgacaaagtgggtcccatcaaggttcagtggcagtggatcgtgggacagatttcactctcacatcagcgtctgcaacctgaagtatttgactaacttacttctgtacaacagtacgttacaacttacccctccgtccaacctgaccggtaccgaacggggtaccaccgggtcctagggaacgtaacgtttaaaaccggaacgttcgggttacggaccgttacggacctaacccgtattacccg

SEQ ID NO: 204880 - DNA, 499 bp, Homo sapiens
  misc_feature: GYAE6OF02GGX45.12.10.A10.1.454.CMB.1.raw
  modified_base (299)..(299): a, c, t, g, unknown or other
  misc_feature (299)..(299): n is a, c, g, or t
tcagatacgacgtacacgaccggtgctcgatttagcgtcgatctcaggggggcaggagtcagtcccagtcaggacacagcatggacatgagggtccccgctcagctcctggggctcctgctgctctggctcccaggtgccagatgtgacatccagttgacccagtctccatccttcctgtctgcatctataggagacagagtcaccatcacttgccgggccagtcaggacattagcaattatttaggctggtatcagcagaagccaagggaaacgcccctaacgtcctgatctatggtncatccactttgcatagtggggtcccatcaaggttcagcggcagtggatcgtagggacagaattcactctcacaatcacagcctgcagcctagaagtattttgactaactttattactgtactaatagtttattactttacccttgttactttcggcctgggaccatagtagatatactaaacgtactgtgctgctacatc

SEQ ID NO: 204881 - DNA, 756 bp, Homo sapiens
  misc_feature: GYAE6OF02J2ONN.12.10.A10.1.454.CMB.1.raw
  modified_base (704)..(704): a, c, t, g, unknown or other
  misc_feature (704)..(704): n is a, c, g, or t
tcagatacgacgtacacgaccggtgctcgatttagcgtcgatctcagggggcagggagtcagtcccagtcaggacacagcatggacatgagggtccccgctcagctcctgggctcctgctgctctggctcccaggtgccagatgtgacatccagttgacccagtctccatccttcctgtctgcatctatacggagacagagtcaccgatcacttgccggctagtcaggacattagctaattattaggctaggtactcagcgacgaagccgaagggaaacgtcccctaaagtcctagactcgtaagtggtcgacgtacttccgtaacgtttcgacgttaacgttacgggttaccggggtacccctaagttaccggtaaacgggtttccgaacgggtcccgggtaccgtaacgggttacgggtaaacgtttccggtaacgggggaacccttaaacgggttaaaccgtttacctaaccgttaccgtttaaccaaaccggtaaacctttaccccgaaacccggtaacggtacccgttaacggtaccgtaacggttacccgttaagtaaacggttttatttttaccggaacctttaaacgtttacgttaaccgttacgtaccgttaaacgtttacggttttaacctttaaccgttttacccgtagtttttaccgttccgggtaccgttacgggacctaggtacgttaanacgttaactaacgtaacgtacgtcggtacgacctagaccctacgtagttccg

SEQ ID NO: 204882 - DNA, 495 bp, Homo sapiens
  misc_feature: GYAE6OF02F7N1A.12.10.A10.1.454.CMB.1.raw
  modified_base (466)..(466): a, c, t, g, unknown or other
  misc_feature (466)..(466): n is a, c, g, or t
  modified_base (492)..(492): a, c, t, g, unknown or other
  misc_feature (492)..(492): n is a, c, g, or t
tcagatacgacgtacacgaccggtgctcgatttagcgtcgatctcagggggcaggagtcagtcccagtcaggacacagcatggacatgagggtccccgctcagctcctggggctcctgctgctctggctcccaggtgccagatgtgacatccagttgacccagtctccatccttcctgtctgcatctataggagacagagtcaccatcacttgccgggccagtcaggacattagcaattattaggctggtatcagcagaagccagggaaacgcccctaacgtcctgatctatggtgcatccatttgcatagtggggtcccatcaaggttcagcggcagtggatcgtgggacagaatcactctacacaatcaccagcctgacacgcctagaagtatttgactaactttattactgtacaacgtagtttatactttaccctgttactttcgccctggtaccatagtanatactacaacgtatgtcgctgcactntcg

SEQ ID NO: 204883 - DNA, 557 bp, Homo sapiens
  misc_feature: GYAE6OF02HE68Z.12.10.A10.1.454.CMB.1.raw
tcagatacgacgtacacgaccggtgctcgatttagcgtcgatctcagggggcaggagtcagtcccagtcaggacacagcatggacatgagggtccccgctcagctcctggggctcctgctgctctggctcccaggtgccagatgtgacatccagttgacccagtctccatccttcctgtctgcatctataggagacagagtcaccatcacttgccgggccagtcaggacattagcaattatttaggctggtatcagcagaagccagggaaagcccctaacgtcctgatctatggtgcatccactttgcatagtggggtcccagtcaaggttcagcggcaggtgatctgggacagattcactctacacaatcaccagcctgccagcctagaacgtattttcgactaacttattactgtactaacgtagtttaacttaacttttacccttacgtttacgttttccggacccgttacggggacctacgtaagttaacgtaattaacgtaacctaaaacgtaacgttacggttacgggtaccttagacctacctacttccg

SEQ ID NO: 204884 - DNA, 516 bp, Homo sapiens
  misc_feature: GYAE6OF02GJKP7.12.10.A10.1.454.CMB.1.raw
tcagatacgacgtacacgaccggtgctcgatttagcgtcgatctcagggggcaggagtcagtcccagtcaggacacagcatggacatgagggtccccgctcagctcctggggctcctgctgctctggctcccaggtgccagatgtgacatccagttgacccagtctccatccttcctgtctgcatctataggagacagagtcaccatcacttgccgggccagtcaggacattagcaattattaggctggtatcagcagaagccagggaaacgcccctaacgtcctgatctatggtgcatccactttgcatagtggggtcccagtcaaggttcagcggcagtggatcgtgggacagaattcactctcacaatcaccagcctgccacgcctagaagtatttagactaactttattactgtactaactaggtttattactttaccgtacgttacgtttcgtacccgtaggtaccacgtagtactacttatactaaacgactgtacggctgctacattcg

SEQ ID NO: 204885 - DNA, 599 bp, Homo sapiens
  misc_feature: GYAE6OF02JBN9H.12.10.A10.1.454.CMB.1.raw
  modified_base (275)..(275): a, c, t, g, unknown or other
  misc_feature (275)..(275): n is a, c, g, or t
tcagatacgacgtacacgaccggtgctcgatttagcgtcgatctcagggggcaggagtcagtcccagtcaggacacagcatggacatgagggtccccgctcagctcctggggctcctgctgctctggctcccaggtgccagatgtgacatccagttgacccagtctccatccttcctgtctgcatctataggagacagagtcaccatcacttgccgggccagtcaggacattagctaattattaggcttggtatcagcagaagccaagggaaacncccctaacgtcctagatctatggtgcatcctactttgactagtaggtcggggtcccagtcgaagggttcggcggcaggtggatcgtgggacagtaacttcactctacacaatccaccagcctgcacgcctagtaacgtattttacgaccttaactttatacctagtacctaacgttaggttttaattaaccgttttacccttacgtttaaccgttttcccggtacccgttacggggtaaccctacgttaaggtaacgtaacttaacttaaccgtaaaaccgtaacgttggtacggtccgtacgtacccacccgtattcttaccg

SEQ ID NO: 204886 - DNA, 553 bp, Homo sapiens
  misc_feature: GYAE6OF02H5Q8Q.12.10.A10.1.454.CMB.1.raw
  modified_base (270)..(270): a, c, t, g, unknown or other
  misc_feature (270)..(270): n is a, c, g, or t
  modified_base (334)..(334): a, c, t, g, unknown or other
  misc_feature (334)..(334): n is a, c, g, or t
  modified_base (373)..(373): a, c, t, g, unknown or other
  misc_feature (373)..(373): n is a, c, g, or t
tcagatacgacgtacacgaccggtgctcgatttagcgtcgatctcagggggcaggagtcagtcccagtcaggacacagcatggacatgagggtccccgctcagctcctggggctcctgctgctctggctcccaggtgccagatgtgacatccagttgacccagtctccatccttcctgtctgcatctataggagacagagtcaccatcacttgccgggccagtcaggacattagcaattatttaggctggtatcagcagagccgaggaancccctaacgtcctgatctatggtgcatccactttgctatagtgggtcccatcaaggtcagcggnagtgatcgtgggacagtatcactctacacatcacagccngcagcctgaagtatttgactattacttactcgtacaacgttaggtttaattacttttaaccctttaggttacgtttttaccggacccgttagggtaccctacgtaacggttaagtaacttaacgttaacccgtaaacgtaaccgttcggttacggtcccttagacccgtacctattcccg

SEQ ID NO: 204887 - DNA, 609 bp, Homo sapiens
  misc_feature: GYAE6OF02G2PCD.12.10.A10.1.454.CMB.1.raw
  modified_base (193)..(193): a, c, t, g, unknown or other
  misc_feature (193)..(193): n is a, c, g, or t
  modified_base (350)..(350): a, c, t, g, unknown or other
  misc_feature (350)..(350): n is a, c, g, or t
  modified_base (469)..(469): a, c, t, g, unknown or other
  misc_feature (469)..(469): n is a, c, g, or t
tcagatacgacgtacacgaccggtgctcgatttagcgtcgatctcagggggcgaggagtcagtcccagtcaggacacagcatggacatgagggtccccgctcagctcctgggctcctgctgctctggctcccagataccagatgtgacatcgagatgacccagtctccatcctccctgtctgcatctgtaganacagagtcaccatcacgttgccggcagtcagggcattagctaatttttagctggtatcagcaagaaaccgaggaaacgttccactacctctgatctatgactgcactccgtctttgacaagtcacgggtcccatctcgttcagcgcagtggattcgngggactagacgtttacactcgtcacctatacagcacgccctgacgacgtccgagtaaactgttcgtttacgactaaacttttagttactacggtaactaaaaacggttacttaaaccgngttacccgttcccccttacccgttaccggtttcccggaaccccggaaaaggggtaaccctaaccccggtaagtttacggggaaacttaacggtttaacggaacccgtaaaccggtttaggtccgggtaccttaacccggg

SEQ ID NO: 204888 - DNA, 567 bp, Homo sapiens
  misc_feature: GYAE6OF02F1EEM.12.10.A10.1.454.CMB.1.raw
  modified_base (298)..(298): a, c, t, g, unknown or other
  misc_feature (298)..(298): n is a, c, g, or t
tcagatacgacgtacacgaccggtgctcgatttagcgtcgatctcagggggcaggagtcagtcccagtcaggacacagcatggacatgagggtccccgctcagctcctggggctcctgctgctctggctcccaggtgccagatgtgacatccagttgacccagtctccatccttcctgtctgcatctataggagacagagtcaccatcacttgccgggccagtcaggacattagcaattatttaggctggtatcagcagaagccaagggaacgccccgtaacgtcctgatctatggtncatcctactttgctatagtcggggtcccagtctaaggttcaggcggcgaggtggatcgtagggacagaattcactctcacaactcaccacgcctgccacgtccgtagaagtattttcgactaactttacttacttgtactaacgttaggttttataccttttaccgttacgtttaccgttttccggtcccgttacgggacctacgtaacgttacgtaattaacgtaaccgtaaacgtacgttacgtcgggtactgacctacctcttccg

SEQ ID NO: 204889 - DNA, 519 bp, Homo sapiens
  misc_feature: GYAE6OF02FYIM6.12.10.A10.1.454.CMB.1.raw
  modified_base (193)..(193): a, c, t, g, unknown or other
  misc_feature (193)..(193): n is a, c, g, or t
  modified_base (395)..(395): a, c, t, g, unknown or other
  misc_feature (395)..(395): n is a, c, g, or t
  modified_base (513)..(513): a, c, t, g, unknown or other
  misc_feature (513)..(513): n is a, c, g, or t
tcagatacgacgtacacgaccggtgctcgatttagcgtcgatctcagggggcaggagtcagtcccagtcaggacacagcatggacatgagggtccccgctcagctcctgggctcctgctgctctggctcccaggtgccagatgtgacatccagttgacccaatctccatccttcctgtctgcatctatagganacagagtcaccatcacttgccgggccagtcaggacattagcaattatttaggctggtatcagcagaagccagggaaacgcccctaacgtcctgatctatggtgcatccactttgcatagtcggggtccatcaaggttcagcggcagtgatcgtgggacagtaattcactctcacaactcaccagcctgcacgcctagaagtnttttagctaactttattactcgtacaacgtagtttatacttttacctacgttatttccggccttggacctacgtagttaacattactacgaaacgtacgtgtcggtctacgctacctnttaccg

SEQ ID NO: 204890 - DNA, 579 bp, Homo sapiens
  misc_feature: GYAE6OF02IE3AL.12.10.A10.1.454.CMB.1.raw
  modified_base (279)..(279): a, c, t, g, unknown or other
  misc_feature (279)..(279): n is a, c, g, or t
tcagatacgacgtacacgaccggtgctcgatttagcgtcgatctcagggggcaggagtcagtcccagtcaggacacagcatggacatgagggtccccgctcagctcctggggctcctgctgctctggctcccaggtgccagatgtgacatccagttgacccagtctccatccttcctgtctgcatctataggagacagagtcaccatcacttgccggcagtcaggacattagctaattagtttaggctggtatcagacaagaacgccgaagggaaaccncccctaacgtcctagatcgtatggtgactactcctacgtttgctagttacggtcgggtcccatacgaaggtcagcggcagtggatcgtgggaacagtacttcactcgtactacaataccactacgctacgcgacgccttagaagttatttacgactaacttattactgtacctaaacgtagttttaacttactttacccttcgtttaacgtttcccggtccgtacggtaccctaagtacgtaagtaattacgtaacgtaaacgtaccgttaggtcgtacgtacgacctacctagttaccg

SEQ ID NO: 204891 - DNA, 668 bp, Homo sapiens
  misc_feature: GYAE6OF02IT7LH.12.10.A10.1.454.CMB.1.raw
  modified_base (300)..(300): a, c, t, g, unknown or other
  misc_feature (300)..(300): n is a, c, g, or t
tcagatacgacgtacacgaccggtgctcgatttagcgtcgatctcaggggggcaggagtcagtcccagtcaggacacagcatggacatgagggtccccgctcagctcctggggctcctgctgctctggctcccaggtgccagatgtgacatccagttgacccagtctccatccttcctgtctgcatctataggagacagagtcaccatcacttgccgggccagtcaggacattagctaattattaggctggtatcagcagaagccgaagggaacgcccctaacgtcctgatctagtggtnctatcctatttgactagttacggtcggggtaccctaagtaccgtaacgggttcgacggtccggtacgtaggttacggtacgttcggtaggggaactagtaacttaccgtacgtctacaactaactcaaccacgcctagccgacgtccgtagtaacgttacgtttactaacgttaactttacttacttacgttaaccgtaacgtttaaggttttaaccttaaccgttttacccgtttacggtttaccgttttacccgggtacccgttaacggggtaccctaacggttaacggttaacgttaaacttaacgttaaccgtaaacggttaacgttcgggtacggtacctacggtacctaccgtacgttaccg

SEQ ID NO: 204892 - DNA, 557 bp, Homo sapiens
  misc_feature: GYAE6OF02GSS06.12.10.A10.1.454.CMB.1.raw
  modified_base (339)..(339): a, c, t, g, unknown or other
  misc_feature (339)..(339): n is a, c, g, or t
tcagatacgacgtacacgaccggtgctcgatttagcgtcgatctcagggggcaggagtcagtcccagtcaggacacagcatggacatgagggtccccgctcagctcctggggctcctgctgctctggctcccaggtgccagatgtgacatccagttgacccagtctccatcccttcctgtctgcatctataggagacagagtcaccatccacttgccgggccagtcaggacattagctaattatttaggctggtatcagcagaagccagggaaacgcccctaacgtcctgatctagtggtgcatcctacttgcatgtcgggtccatcaaggttcagcgnagtggatcgtaggacaagtaagttccactctaccaacaactaccaaccgacgccctagaccacgccttagaagttcttttagacgtaactttacttacttaggtacctaacgtaggttttaacttactttaaccttcgtttacttttccggacccttgggtacctacgtagtagtaactataaccgaaacgtacgtacgtaggtactgactacctatc

SEQ ID NO: 204893 - DNA, 686 bp, Homo sapiens
  misc_feature: GYAE6OF02FEHCD.12.10.A10.1.454.CMB.1.raw
tcagatacgacgtacacgaccggtgctcgatttagcgtcgatctcagggggcaggagtcagtcccagtcaggacacagcatggacatgagggtccccgctcagctcctgggctcctgctgctctggctcccaggtgccagatgtgacatccagttcgaccctagtcctcctatccttcctgtctgcatctagtaggagacagacgtaccacctactccgtacgtccggccgggactagtcgaacgtactatagtactaagttagttcggcttaggactcgaagaccgaaggaaccgaccggtaacggtaaccctaccccgtaatccagtacttgtagtcggtacacctacttaccgtagttcgacgtaggttcgggtaccggtaccctagtacgtaggttcgaaggtcggtacggtggtcgggtactaggtaacctgtttacctcgtacctaccgtacacctagtccgagtcctagactaccgacctaagtacgtacgttaccttacgtaacctactttaactttacctacggtacaaccgtaacgtaaccgtttaaccggttaacccttcccggttaccccttaccggtacgggttacgggaacgggttacgaacggtaggtaccggagtaaaccgtaaccggaacgtgtccgtaaccgtacgtaccacccttaggtatttcccg

SEQ ID NO: 204894 - DNA, 563 bp, Homo sapiens
  misc_feature: GYAE6OF02GWU1A.12.10.A10.1.454.CMB.1.raw
  modified_base (194)..(194): a, c, t, g, unknown or other
  misc_feature (194)..(194): n is a, c, g, or t
tcagatacgacgtacacgaccggtgctcgatttagcgtcgatctcagggggcaggagtcagtcccagtcaggacacagcatggacatgagggtccccgctcagctcctggggctcctgctgctctggctcccaggtgccagatgtgacatccagttgacccagtctccatccttcctgtctgcatctatagganacagagtcaccatcacttgccgggccagtcaggacattagcaattatttaggctggtatcagcagaagccgaagggaaacgcccctaacgtcctgatctatggtcgctatccactttgctagtaggtcggggtccatcgaaggttcagcggacaggtgatcgtgggacagaacttcactctacaactaactaccaaccacgtcctgccacgccgtagaaacgttatttagactaactttattactgttacctaactagttttacttactttacccttgttacgttttccggacccgttacgggacctacgtacgttaagactttaacgaacctaaacgttactcggtacggctagtcctaccgtattcg

SEQ ID NO: 204895 - DNA, 666 bp, Homo sapiens
  misc_feature: GYAE6OF02H2LLW.12.10.A10.1.454.CMB.1.raw
  modified_base (192)..(192): a, c, t, g, unknown or other
  misc_feature (192)..(192): n is a, c, g, or t
  modified_base (298)..(298): a, c, t, g, unknown or other
  misc_feature (298)..(298): n is a, c, g, or t
tcagatacgacgtacacgaccggtgctcgatttagcgtcgatctcagggggcaggagtcagtcccagtcaggacacagcatggacatgagggtccccgctcagctcctggggctcctgctgctctggctcccaggtgccagatgtgacatccagttgacccagtctcatccttctgtctgcatctatagganacagagtcaccatcacttgccggcagtcagacattagctaattattaggctaggtatcagcagaagccgaagggaaacgccccgtaacgtcctgtatctagtggtncactcctactttcgctattacggtcggggtcccatacgtaaggttcaggtcggacgtaggtacggtagtacgtcgggactaaggtacttccacttcctacaactaaactccaccgtacgacctagaccgtacgaccgttaggaacgttagttttacgaaccttaacttttaacgttacttacgttacctaaacgtttaaggtttttaacctttacgtttttaaccccgtttacggttttaccgttttaccgggtacccgttacgggtaccctaacggttaacggttaacgtaacgttaacgttaaacccgtaaaaccgttaaccgttgggttaaccggacttaccggtacctacccttagttacccgg

SEQ ID NO: 204896 - DNA, 538 bp, Homo sapiens
  misc_feature: GYAE6OF02GB8QI.12.10.A10.1.454.CMB.1.raw
  modified_base (374)..(374): a, c, t, g, unknown or other
  misc_feature (374)..(374): n is a, c, g, or t
tcagatacgacgtacacgaccggtgctcgatttagcgtcgatctcagggggcaggagtcagtcccagtcaggacacagcatggacatgagggtccccgctcagctcctggggctcctgctgctctggctcccaggtgccagatgtgacatccagttgacccagtctccatccttcctgtctgcatctataggagacagagtcaccatcacttgccgggccagtcaggacattagcaattatttaggctggtatcagcagaagccagggaaacgcccctaacgtcctgatctatggtgcatccactttgctagtaggtggggtcccagtcaaggttcaggcggcaggtggatcgtgggacagaattcactctcanaatcacagcctgcagcctagaatatttgactaacttattactgtactaacgtagtttatacttttaccctgtttacttttccggacccttcgggacctacgtaagtacgtaattacgtaaccaaacgtaacgttacggtggccttaggacctaccctattaccg

SEQ ID NO: 204897 - DNA, 554 bp, Homo sapiens
  misc_feature: GYAE6OF02JW8Y8.12.10.A10.1.454.CMB.1.raw
  modified_base (210)..(210): a, c, t, g, unknown or other
  misc_feature (210)..(210): n is a, c, g, or t
  modified_base (232)..(232): a, c, t, g, unknown or other
  misc_feature (232)..(232): n is a, c, g, or t
  modified_base (422)..(422): a, c, t, g, unknown or other
  misc_feature (422)..(422): n is a, c, g, or t
  modified_base (479)..(479): a, c, t, g, unknown or other
  misc_feature (479)..(479): n is a, c, g, or t
tcagatacgacgtacacgaccggtgctcgatttagcgtcgatctcagggggcaggagtcagtcccagtcaggacacagcatggacatgagggtccccgctcagctcctggggctcctgctgctctggctcccaggtgccagatgtgacatccagttgacccagtctccatccttctgtctgcatctataggagacagagtcaccattccncttcgccgggcaggtcaggacnttagcaattatttaggctggtatcagcagaagccaaggaacgcccctaagtcctgatcgtatggtagcactccacgtttcgctataggtcggggtacccagtaccgtaaggttcaggtcggacgagtggatcgtgggacagtaactcgactctacactaactcaccgagcctgacacgcctagaacgttntttacgactaacttacttacgagttaccaaagttgttaacttctttaccttacgttntttaccggcttacgactacgtagtcgtaatacgttaacgaacgtaagttccgtggtcctagccctaacgtgttac

SEQ ID NO: 204898 - DNA, 655 bp, Homo sapiens
  misc_feature: GYAE6OF02I3NW2.12.10.A10.1.454.CMB.1.raw
  modified_base (99)..(99): a, c, t, g, unknown or other
  misc_feature (99)..(99): n is a, c, g, or t
  modified_base (135)..(135): a, c, t, g, unknown or other
  misc_feature (135)..(135): n is a, c, g, or t
  modified_base (648)..(648): a, c, t, g, unknown or other
  misc_feature (648)..(648): n is a, c, g, or t
tcagatacgacgtacacgaccggtgctcgatttagcgtcgatctcagggggcaggagtcagtcccagtcaggacacagcatggacatgagggtccccgntcagctctgggctcctgctgctctggctcccaggtnccagatgtgacatccagttcgacccagtcctccatccttcctgtctgctatcgtagtacgactagacagtactccaacctatcaacgttcggaccgggtactaaggtccaacgaccctatcagactagtcttaaatttaacgttggtactacgagacgaacgaaaaccgaacggaaacctcccgtaaaggtccgtagtacttctaagtcgtctagacctacttacgtagttacgacgtaaacggtcggtacccagttacgtaaggttacacggtggacgtaggtcgggtactagggtacaggttacttacgtaccgtctacgaacctagtcgaagtctcgtccgtaaggccgttaagtcgtaacgttagttacgtttctaagtttactttaacgcgttacgtacgagttactaaagttactaaacgttacctcggttactacgtcttaacggcggtttaacggggacgtaaccgtagggtacgtacgaacgtacgaaaggttcgcggtacgtntaaccgg

SEQ ID NO: 204899 - DNA, 600 bp, Homo sapiens
  misc_feature: GYAE6OF02IXD3V.12.10.A10.1.454.CMB.1.raw
  modified_base (332)..(332): a, c, t, g, unknown or other
  misc_feature (332)..(332): n is a, c, g, or t
  modified_base (580)..(580): a, c, t, g, unknown or other
  misc_feature (580)..(580): n is a, c, g, or t
  modified_base (586)..(586): a, c, t, g, unknown or other
  misc_feature (586)..(586): n is a, c, g, or t
  modified_base (596)..(596): a, c, t, g, unknown or other
  misc_feature (596)..(596): n is a, c, g, or t
tcagatacgacgtacacgaccggtgctcgatttagcgtcgatctcaggggggcaggagtcagtcccagtcaggacacagcatggacatgagggtccccgctcagctcctggggctcctgctgctctggctcccaggtgccagatgtgacatccagttcgacccagtcctccattcccttcctgttctcgcatctagtaggagacagagtcaccatctacgttgcccgggcagtcaggacattacgactaagtttagttacggcgttaggtatacgagtacgagaacgaccgaagggaaaccaccccgtaacgtcctaggactctagtcggtnctactccgtacttgactagttacgggtcgggtacctagtacgtaggtacgacgggtcgagtaggtgacgttcggagggactaacgtaagttcaactcctacaacaactcactcgctacgccgagtaccgtagtaacttcgtttagacttaactttatacttagtactacgttagtttactttacttacgttcgtttacgttccgacttcggactagtaggtataactagtaaccgaaagtcgtacggngtccgngtaccacgtntacg

SEQ ID NO: 204900 - DNA, 767 bp, Homo sapiens
  misc_feature: GYAE6OF02IR0DJ.12.10.A10.1.454.CMB.1.raw
  modified_base (196)..(196): a, c, t, g, unknown or other
  misc_feature (196)..(196): n is a, c, g, or t
  modified_base (269)..(269): a, c, t, g, unknown or other
  misc_feature (269)..(269): n is a, c, g, or t
tcagatacgacgtacacgaccggtgctcgatttagcgtcgatctcagggggcaggagtcagtcccagtcaggacacagcatggacatgagggtccccgctcagctcctggggctcctgctgctctggctcccaggtgccagatgtgacatccagttgacccagtcctccatccttcctgtctgcatctagtagganacagagtccaccatccacttggcccgggccaagtcgaaggactattacgactaatttagttagctgtatcagnagaacgaccgaagggaaaccgcccctaacgtcctagactctagtggtgactactcctactttgactagttacggtcggggtacccaaggttaccgtaaagggtttccgaacgggtccggtacgtagggtacgggtaacgtcggttacggggtaacctaaaggttaacttacgtaacccgttctaaacccgtaaactaaaccgtacccgaaaccctacgtacccgtacgtaccgaacgtacccgttaaggtaaacgtttaacggttttacctaaaccgtttaaacctttacgtttaacgttaacgtaaaacgttaaaaagttaaacgttaaaccgtaccggttaacccgttaccccccgtttaaccgtaaccccggtttacccgggaacccggaaaacgggaccgtaaccggtaacggtaacggggtaaacgtaagtttaaaccggaaaccgttacgttacgggtaccgtaacggttccgtaacccgtacccgttaacg

SEQ ID NO: 204901 - DNA, 799 bp, Homo sapiens
  misc_feature: GYAE6OF02F8ZTZ.12.10.A10.1.454.CMB.1.raw
tcagatacgacgtacacgaccggtgctcgatttagcgtcgatctcagggggcaggagtcagtcccagtcaggacacagcatggacatgagggtccccgctcagctcctggggctcctgctgctctggctcccaggtgccagatgtgacatccagttgacccagtctccatccttcctgtctgcatctataggagacagagtcaccatcacttgccgggccagtcaggacattagctaattagttaggctggtatcagcagaagccgaagggaaacgtccccgtaacgtcctgactctagtggttgactacgtccctactttcgactagttacgggtcgggggttacccctaagttaccgtaaacgggtttccgaacgggtccgggacgtaagggttgggtaacgttaccggttacgggggaacctaaagggttaacttacctaaccgtttaccctaaccgaaacctaactacccgaaccctacggtacccgtacggacctaccggtacccgttaaggtaaacgttacgtttttacggaaccgtttaaacttttaacgtttaaccgttacggttaaccttaaaccgtttaacggtttttaactttaaccgtttttaaccccgtttaccgttttaacggtttttaccccgggtaccccggtttaaccgggtaacccgttaaccggttaacggtttaaacggttaaaccgttaaaccgttaaaccccggtaaaaacggtttaacccgttacgggttacgggttaacccgttaccggacccttaacccgttacgtttacccgg

SEQ ID NO: 204902 - DNA, 784 bp, Homo sapiens
  misc_feature: GYAE6OF02I2IPN.12.10.A10.1.454.CMB.1.raw
  modified_base (149)..(149): a, c, t, g, unknown or other
  misc_feature (149)..(149): n is a, c, g, or t
tcagatacgacgtacacgaccggtgctcgatttagcgtcgatctcagggggcaggagtcagtcccagtcaggacacagcatggacatgacgggtccccgctcagctccgtggggctcctgctgctctggctcccaggtgccagattggngacatccagttcgacccagtcctccacttccctttcctgttctcgctacttctagtagggacgacacgagtaccacctatccacgttcggaccgggaccagtccgaaggactagttacgactaatttagttacggcgtaggtctacgacgtaccgaaggaacggaccgaagggggtaaaaccctacccccgttaaaccggtccgttaaggtacttaccgttaaggttcgggtacaccctaacttcccgttacgtttacggacttaacggttcgggtaccggggtacctacgttaaccggttaagggttccgaaggtcccgggtacggttaggtacggggtacgttcgggaacggggtaacaacggttaacgtttccacgttaccgtaccaaagtacctacccacgtaaccgtctacgacctaccgggttaccaggtttaaacggttctttaaccgacgtttaaaccttaacgttccggttaacgtaacccgttaagtttaacggttttaaccttaaccgttttaacccggttcttttaccggtttcccgaaccggttccggtacctaagttcggtaactaactacgttaaaccgaccgttaagttcggtcgtaccgtatccctaccttagttccg

SEQ ID NO: 204903 - DNA, 785 bp, Homo sapiens
  misc_feature: GYAE6OF02JZ7IN.12.10.A10.1.454.CMB.1.raw
tcagatacgacgtacacgaccggtgctcgatttagcgtcgatctcagggggcaggagtcagtcccagtcaggacacagcatggacatgagggtccccgctcagctcctggggctcctgctgctctggctcccaggtgccagtatgtagacatccagttgacccagtctccatcccttctgtctgacattctataggactacgagtacgtccacctattaccgacgttcggacccgggtcaggttccgaagggtacctaagtttacgacctaaattttacgtttagggaccgttagggtactacgtaacggtacaacgggtaaacggacccggaaacggggtaaaacccgtcccccccgttaaacgggttccccgtaataacgttacccggttacggttagggttccggacccttacgtttaaccccacgtttttacgaccgtaacgttaaccggggttcccggggtaaccccttagttaaccgtaaacgggtttcccgtaaccgggccggtttaaaccggaaggttcggggtaaacttcccggggtaggggtaaacctaaggtttacgtacccgtacgtaccttacgacgtaaacctacgtaaccgtacgcgtaccgtacgtaccgacgttacgtacgttagttaccgtactaacgttacgttactcggtacctaattacgttacttccgttaacttcgttcgttcggtacctcgtacctacgtagttaacctagtctaaccgtaacgtaacgttcgacggtacctaggtacctacctagtaccg

SEQ ID NO: 204904 - DNA, 648 bp, Homo sapiens
  misc_feature: GYAE6OF02GXRZS.12.10.A10.1.454.CMB.1.raw
  modified_base (281)..(281): a, c, t, g, unknown or other
  misc_feature (281)..(281): n is a, c, g, or t
tcagatacgacgtacacgaccggtgctcgatttagcgtcgatctcagggggcaggagtcagtcccagtcaggacacagcatggacatgagggtccccgctcagctcctggggctcctgctgctctggctcccaggtgccagatgtgacatccagttcgacccagtctccatccttcctgtctgcatctataggagacagacgtcaccatcacgttcgccgggcagtcaggactattagctaaattatttaggctggtatcagcagaagccgaaggaaaccnccccgtaacgtcctagtactcgtagtggtcgctacttccgtactttgactagtacgggttcgggtaccctagtacgtaaggttcacggtcggacgtaggtaggtacttcggtagggacagtaacttcaccttcactaacactaccacctacgtcctagaccacgtccgttaagtaagtttatttacgaaccttaactttacttacgtactaacgtaacgtttacgttttaacttaccgttttaacccgttgttttaaccgtttccgggacccttacgggtaccctaaggttagtaacgtaacttaactaacccgtaaaacgttagttaccggtacgggtaccttacggaccttaccgtactttaccg

SEQ ID NO: 204905 - DNA, 692 bp, Homo sapiens
  misc_feature: GYAE6OF02FZAEH.12.10.A10.1.454.CMB.1.raw
  modified_base (200)..(200): a, c, t, g, unknown or other
  misc_feature (200)..(200): n is a, c, g, or t
tcagatacgacgtacacgaccggtgctcgatttagcgtcgatctcagggggcaggagtcagtcccagtcaggacacagcatggacatgagggtccccgctcagctcctggggctcctgctgctctggctcccaggtcgccagatgtagacatccagttcgacccagtctccattcccttctgtctgctatctagtagganacagagtcaaccatctacgttcggccggctagtcaaggactagttagactaattagttaggcttaggtatacagacgtaaggaacgaccgaacgggtaaacctcccccgtaaacgtcctaggtactacgtaagtcggtactcctacttcctagtttgactagtacgggtccggtaccaagtacgtaagttcgacggtcggtacgtacggtagtacgttccggtaacgggaacttaagtaacttaccgacttacacaactactacccgtacacgtacctacgacgtacgtaccttaaggtaacgttacgttacgaaaccttaactttactaacgtagtaacgttaacgttaacgtttacgtttaccgtttaaccttacggtttacctttacccggaccgtttaacggaccctaaggttaacgtaaacgtacgttaacgtaaaccgtaaaccgtacggttagtacggtaccgtaccgtactaacgtcttaacgg

SEQ ID NO: 204906 - DNA, 831 bp, Homo sapiens
  misc_feature: GYAE6OF02GSY41.12.10.A10.1.454.CMB.1.raw
  modified_base (792)..(792): a, c, t, g, unknown or other
  misc_feature (792)..(792): n is a, c, g, or t
tcagatacgacgtacacgaccggtgctcgatttagcgtcgatctcagggggcaggagtcagtcccagtcaggacacagcatggacatgagggtccccgctcagctcctggggctcctgctgctctggctcccaggtgccagatgtgacatccagttgacccagtcctccatcccttctgtctgctatctagtaggacgacagacgtacaaccgattaccgacttccggacccggggtacctaaggtccgaagggtaacctaagtttacggaccttaaagtttacgttttacgggccgttagggttaactccggaaggaccgaaggaaacggtacccgaaacgggggtaaaaccctaccccccgttaaaggttacccgtacggtaacttcgtaaggttcgggtacgtacctaaccgttacccgtacgtttttggaccttacggttacgggggtacccggggttaccctaacgttaccggttaacgggtttacacggggttaccggaccgtaaggggtcggtaacgtttacggaaggggaaaccttacgttaaaccgtttacgtaccgttacccgtaactaaccgtaaacttacccgaccgtaaccgtccgttagacccgtacgtaccgttagtaacgttagtttaccgacgttaaaccttagttaccgttaagtacctaacggtttacgttttaaattacccgtttaacctttacgggttacccttttccggtaaccgttaccggtacccttagtacggtaacttaaccgtaacggttaaccgtaaaccggtnttacggtaccgtacgtaccgtaacctacgtacggttacc

SEQ ID NO: 204907 - DNA, 772 bp, Homo sapiens
  misc_feature: GYAE6OF02G1QMN.12.10.A10.1.454.CMB.1.raw
  modified_base (99)..(99): a, c, t, g, unknown or other
  misc_feature (99)..(99): n is a, c, g, or t
  modified_base (137)..(137): a, c, t, g, unknown or other
  misc_feature (137)..(137): n is a, c, g, or t
  modified_base (199)..(199): a, c, t, g, unknown or other
  misc_feature (199)..(199): n is a, c, g, or t
tcagatacgacgtacacgaccggtgctcgatttagcgtcgatctcagggggcaggagtcagtcccagtcaggacacagcatggacatgagggtccccgntcagctcctggggctcctgctgctctggctcccaggtnccagatgtgacatccagttcgacccagtctccattccgttcctgtctgctattctatagganacagagtacacctagtctacttcggcccgggaccagtcgaggactagttacgactaatttagttaggcttggtatccgagcaagaacgccgtaagggaaacctaccccgtaacgtcctacgtacttcgtatggtcactacttaccttacgtttacgctaagttacggtccggggttacccaagttacgtaacggttcgaacggcggacgtaggtacggtacttcggtagggtactaaggtaacgtttccgaacgttacctaaccgaacttaaaccgtcctaaacccgtacgtacccgttacgaccgacggttaccgttaacggtaacgtttacgttttacgtaaaccgtttaacttttacgttaaccgtaccgttaaccgttaacggtttaaccgttttaaccttaacccgtttttacccgtaccggtttttaaccggtttcccggtaaccccgggttaccggtaaccttaccgggttaagttaaaccggttaaccttaaacgttaaaccggaaaccggtttaggttcggtaaccggttaccgtaaccggtaaccttaccgtacggtttaccg

SEQ ID NO: 204908 - DNA, 687 bp, Homo sapiens
  misc_feature: GYAE6OF02JID3B.12.10.A10.1.454.CMB.1.raw
tcagatacgacgtacacgaccggtgctcgatttagcgtcgatctcagggggcaggagtcagtcccagtcaggacacagcatggacatgagggtccccgctcagctcctggggctcctgctgctctggctcccaggtgccagatgtgacatccagttgacccagtctccatccttcctgtctgctatctgtagcagacagactcacctatcacgttgccgggcaagtcacgaccatcacgcacgtacttaatttaaacttggtatacacgactaacggaaaacccgtaaggggaaaccgccccgttaaggtccgtagaacttacgtagtcgccgttagcctattaccgtgtttacgacgtaaacggttcgggtacccctagtacgtacggttacgcgtaggcgtaggtcgggtacgtagggacctagtactttcgactttccacgacctaagtcgaacgtcgtaacgttccgactacctaaccggttagtaaacgtactttacggccttaaacctaacttttacgttaacttaccgtaacgtaaaccgaaggttaacttaaccgtaaccgtttaccccttaccgttaccggttacgggacccggaacgggtaccgtaagggtacgtaacgtaacggttaaccgaaacggttaccggtaggttaccgacctaacggtccaaccgttacg

SEQ ID NO: 204909 - DNA, 669 bp, Homo sapiens
  misc_feature: GYAE6OF02GWHVW.12.10.A10.1.454.CMB.1.raw
  modified_base (481)..(481): a, c, t, g, unknown or other
  misc_feature (481)..(481): n is a, c, g, or t
tcagatacgacgtacacgaccggtgctcgatttagcgtcgatctcaggggggcaggagtcagtcccagtcaggacacagcatggacatgagggtccccgctcagctccgtggggctcctgctgctctcggctcccaggtcgccagatggtagacatccagttacgacccagtcctccattccttccgtgtctgcatctagtaggagacaggactaccacctagtacctacgttcggacccgggcaggtcgaaggactattacgactaaatttacgtttaggcttaggtatacgagacaaggaagccgaaaggggaaaccgtaccccgtaaacggttacccgtagaacgttcgtaagtggtcgactactccgtacttcgctagtagggtcggggtacctagtacctaagggttcaggtcggataggtgtaagtcggtaggacgaggtacttacgactcacgaacaactaccgacacgtctcnccagccttaagagttcgttaacgacttaaacgttacttaacgtctaaacgtaacgtttagttactttaactttacctacggtttagtttacccggtcgtacggtacctacgtaacggttaacgtaacttaaacgtaacgtaaaccgtaggttacggtacgggtacctaggaccctactaacggttccg

SEQ ID NO: 204910 - DNA, 649 bp, Homo sapiens
  misc_feature: GYAE6OF02IFMF4.12.10.A10.1.454.CMB.1.raw
  modified_base (265)..(265): a, c, t, g, unknown or other
  misc_feature (265)..(265): n is a, c, g, or t
  modified_base (286)..(286): a, c, t, g, unknown or other
  misc_feature (286)..(286): n is a, c, g, or t
  modified_base (314)..(314): a, c, t, g, unknown or other
  misc_feature (314)..(314): n is a, c, g, or t
  modified_base (465)..(465): a, c, t, g, unknown or other
  misc_feature (465)..(465): n is a, c, g, or t
tcagatacgacgtacacgaccggtgctcgatttagcgtcgatctcagggggcaggagtcagtcccagtcaggacacagcatggacatgagggtccccgctcagctcctggggctcctgctgctctggctcccaggtgccagatgtgacatccagttcgaccagtctccattcccttcctgttctgctatctagtaggagacagagtcacctatcacgttggcccggccagtcaggactattagacttaattattagctggtactnagcagaacgcgaagggaaacnccccgtaacgtcctgactacgtcgtggngactatcctctttgactagtacggtccggtacctagtacgtaacggttacgtaggcggtacgtaggtaggacttacggtagggactaggtacttctaccgtctcgaacctaacgtaccactaccgcttaggccgtactccgtagtaacttntttacgacgttaactttacttacgtacgtactaaacgagtaacgttaaccttacccgtttacccttacccttaaccgggttcgtacccgttaacggggtacgggtaacccgttaaggggtaggtaacggtaacttaaaccggaaaccgttacgtacggtacgtcgtaacggacctaccttaccg

SEQ ID NO: 204911 - DNA, 806 bp, Homo sapiens
  misc_feature: GYAE6OF02IU9SH.12.10.A10.1.454.CMB.1.raw
  modified_base (137)..(137): a, c, t, g, unknown or other
  misc_feature (137)..(137): n is a, c, g, or t
  modified_base (199)..(199): a, c, t, g, unknown or other
  misc_feature (199)..(199): n is a, c, g, or t
tcagatacgacgtacacgaccggtgctcgattttagcgtcgatctcagggggcaggagtcagtcccagtcaggacacagcatggacatgagggtccccgctcagctcctgggctcctgctgctctggctcccaggtnccagatgtgacatccagttgacccagtcctcctatcccttccgtgtctgctatctatagganacagagtcacatcacttggaccgggccagtcacggacattagcaattagttaggctaggtatcagcgagaacgaccgaggaaacgtaccccgtaacggtccctaggactaccttagtcggtcgtcctacgtccctacgttttacgacgttaacgtaacggttccgggggtacccctagtaccgttaaagggttcaacgggtcggacgtaggttacgggattacggtagggtaaccgagtaacttccgtaccgttacacctaactactacccgtacaccggtcttacggaccccgtacgtcctaaagggtaacgtttactttttacgtaaccgtttaaccttttaacgtttaaccgttacggtttaacgtaaaccggtttttaacgtttaacccggtttttaaccttttaacccgttttaaccggtttttaacccgtttttacccggggttaccccgtttaacccgggggtaaccctttaacccgggttaacggttaccggttaaaaccgttaaccggtaaacccgtttaaaaacccgggtaacgtttaacccggggttaacggttaccgtttaccggaaacccgttcccgttaacggtttaaccccg

SEQ ID NO: 204912 - DNA, 670 bp, Homo sapiens
  misc_feature: GYAE6OF02IZ3AK.12.10.A10.1.454.CMB.1.raw
  modified_base (173)..(173): a, c, t, g, unknown or other
  misc_feature (173)..(173): n is a, c, g, or t
  modified_base (295)..(295): a, c, t, g, unknown or other
  misc_feature (295)..(295): n is a, c, g, or t
  modified_base (349)..(349): a, c, t, g, unknown or other
  misc_feature (349)..(349): n is a, c, g, or t
  modified_base (406)..(406): a, c, t, g, unknown or other
  misc_feature (406)..(406): n is a, c, g, or t
  modified_base (418)..(418): a, c, t, g, unknown or other
  misc_feature (418)..(418): n is a, c, g, or t
tcagatacgacgtacacgaccggtgctcgatttagcgtcgatctcagggggcaggagtcacgtcccagtcaggacacagcatggacatgagggtccccgctcagctccgtggggcctccgtgctgctcgtcggctcccgaggtgccagtatgtgacagtacctagttcgaccngtcctccatccttctgtctgcctattactagtacggagaggtacgtcaccctatctacgtcggcccggtcacgtcggaaggtactacgtagactaatttaacggttggccgtagactcgtanacggtaagtaccggacgtaggaaccctaccgtacttccacgttaatcaaggttncgtactactcgtaactcgtatacggtggtaccggtctatacgggtcggtacgtcggngtaaccgtggtntacggtcgaaaggtctaaagtccttacgtcctactaccgtaacgtacctacaccgtactcctaccggctacgtcgaacgttatccgttaacgacgttacttgtacccttaaggtacctaagtttcgttaacttaccgtttacgtcgtttaaccgtcccgttaccgaaccgttcgaaccttggtaaactccgggtaactaacgtccgttaacgtagtcggtacggtaacgccgttaccgtattacccttaccg

SEQ ID NO: 204913 - DNA, 729 bp, Homo sapiens
  misc_feature: GYAE6OF02H369F.12.10.A10.1.454.CMB.1.raw
  modified_base (194)..(194): a, c, t, g, unknown or other
  misc_feature (194)..(194): n is a, c, g, or t
tcagatacgacgtacacgaccggtgctcgatttagcgtcgatctcagggggcaggagtcagtcccagtcaggacacagcatggacatgagggtccccgctcagctcctgggctcctgctgctctggctcccaggtgccagatgtgacatccagttgacccagtcctccatccttcctgtctgcatctatagganacagacgtcaccatcacgttcggccggccagtcgaggactattagctaattagttaggctggtatcagtacagaacgaccgaagggtaaacgcccctaagtcctaggtactcgttagtacgggtgacctacttcccgtaacttttcgacttagtacgggttcggggtaccctagttacgtaaggttcacgggtcggacgtaaggtcggtaacttcggtgggaactaggtaacttcctaaccgtacttaccaaacgttaacctcccgtaaaccgtacggcccttaacgactaccgtacccgttagtaaacgttagttttaccgaacttaaactttaactttacgtacggttaacctaacggttaaccggtttttaactaacccgtttttaacccgttacggttaaccttttacccggggacccgttacgggtaacccctaacggtttaacggtagttaaaccgttacgtaaacccgtaaaacccgttacggttcgtaacgggttaccctaccggtaaccgtacccttagttacccg

SEQ ID NO: 204914 - DNA, 566 bp, Homo sapiens
  misc_feature: GYAE6OF02GDZK1.12.10.A10.1.454.CMB.1.raw
tcagatacgacgtacacgaccggtgctcgatttagcgtcgatctcagggggcaggagtcagtcccagtcaggacacagcatggacatgagggtccccgctcagctcctggggctcctgctgctctggctcccaggtgccagatgtgacatccagttgacccagtctccatcccttcctgtctgcatctataggagacagagtcaccatcacttgccgggccagtcaggacattagctaattatttaggcttaggtatcagcagaagccgagggaaacgcccctaacgtcctagatctagtggtgctatcctactttgctatacggtggggtcccagtcgaaggttcaggcggcgaggtggatcgtgggacaagtattcactctacactaatcaccacgcctcgacacgtcctagtaagttactttacgactaactttattactcgtactacgtagtttacttactttaccgttacgttacgtttccggtaccgtacggtacctacgtaggtaacgtaacttacgtaaccgtaaacgtagtacgtggtactacggactaccgtatcg

SEQ ID NO: 204915 - DNA, 778 bp, Homo sapiens
  misc_feature: GYAE6OF02IOZXP.12.10.A10.1.454.CMB.1.raw
  modified_base (372)..(372): a, c, t, g, unknown or other
  misc_feature (372)..(372): n is a, c, g, or t
  modified_base (762)..(762): a, c, t, g, unknown or other
  misc_feature (762)..(762): n is a, c, g, or t
tcagatacgacgtacacgaccggtgctcgatttagcgtcgatctcgagggggcaggagtcagtcccagtcaggacacagcatggacatggacgggtcccccgctacaggcctccgtggggcctcctggcctgccttcgtcggccctaccccgtagggtccgccgaagtattcggtcgaacctaacttcccgtaacggttccgaacccctcgttccctacctaacctttccctttccgttgtccgttcgactacgttacgtaaggtaacgggaacacgacgtacgtaccacctactcgtccgttcgggacccggaccgtagaccgaaggtactacgttaacgtacttaagtttaacgtcggtcgtaggttacncgagtacgacgtacgaccggtaacggaaccgtaccccgtaagtcgtatacttcgtagtaggtcacgttccttaaccgtcgttagacgtaggtaccggtccggaccctggtaaccgttaggaccgtacgggcgacgttagggtaccgtaggttaacggtaacggaacttgttaaccgttactaccgtacgtaacaactaccgtaccacgttccgacgtaccaccgtaccgtaccgttaaggttaacttcgttaactaacttatacgttacttaacgttacgttaaccgttagtttaaccttacgtttaccgttcgttaccgttcgtaccgttacgtacgtacgtcgttaacgtagtaaaccgtaccgtaacgtggtacgtacgcgtaaccnccttaacgtcttaccg

SEQ ID NO: 204916 - DNA, 688 bp, Homo sapiens
  misc_feature: GYAE6OF02HIRN5.12.10.A10.1.454.CMB.1.raw
  modified_base (189)..(189): a, c, t, g, unknown or other
  misc_feature (189)..(189): n is a, c, g, or t
  modified_base (666)..(666): a, c, t, g, unknown or other
  misc_feature (666)..(666): n is a, c, g, or t
tcagatacgacgtacacgaccggtgctcgatttagcgtcgatctcagggggcgaggagtcagtcccagtcaggacacagcatggacatgagggtccccgctcagctctggggctcctggctgctcgtggcctcccagggtcgccagatcgtgacagtccaggttcacccagtcctccattccttccgtntacgtgcctattcctaagtagggagaacctaaggtatactaacccatccgtaattcccgggccggggtcaacgtccgagggtactaagttacggacttaaatttacgttaggacgttaggtactacgaacgtacgaagaaacgcggaaacgggaaaccggtaacccccgttaaaggtacccgtaaggtactaaccttaggtcggtacgtactaacgtaccttacctttgaaccgtaggttaccgggttcgggaccctagtaacgtaacggttacgacggtacggacgtaggtacggtagtacgtgggactataacggttactagtcctactacgaactacgactacgcgtacgctagctagtaactgttaccgaatacttaacttactacgtactacgtaagtttactaacgttttacctacgtttacgttccggtactccgtacgtacgtaatctaatactacgaacgtatacggngtactacggactacgattaccg

SEQ ID NO: 204917 - DNA, 965 bp, Homo sapiens
  misc_feature: GYAE6OF02HGFA7.12.10.A10.1.454.CMB.1.raw
  modified_base (136)..(136): a, c, t, g, unknown or other
  misc_feature (136)..(136): n is a, c, g, or t
  modified_base (741)..(741): a, c, t, g, unknown or other
  misc_feature (741)..(741): n is a, c, g, or t
  modified_base (957)..(957): a, c, t, g, unknown or other
  misc_feature (957)..(957): n is a, c, g, or t
tcagatacgacgtacacgaccggtgctcgatttagcgtcgatctcagggggcaggagtcagtcccagtcaggacacagcatggacatgagggtccccgctcagctcctgggctcctgctgctctggctcccaggtnccagatgtgacatccagttcgacccctaggttcctacctacgttcccctttcccgttacggttctcggtcctaattcctaagttacgggacgtaaccgaggtacgtaccaacccgtaattaccgtaaccgtttcgggaccccgggtaccctaaggtaccgtaacgggtaacctaagttttaaccggaacgtttaaaactttttacggtttaacggggtaccgttacgggttaacttaccggaacgaaccggtaaggtaaaaccgggtacccgggaaaacggggggtaaaaccccttccccccgttaaaaccggttacccggtttaacgaaccgtttaaccggttaggtttacgggggtacctaccgtaaccgttcccggttaactttttcggaaccgttacgggttaacggggttcccggggttaaccccttaaagttaccggttaaaagggttcccgaagggtacccgggaacgttaaggtcgggtaaccgttcggaacggggtaaactaacggttacttttacccgacttaccggtaacctaaaccgttaacacccgtaaaccgcgttacccaggtccaacggtacctttaggtaaacctttntttccgaacccgtttaaacttttattaaccgttaccgttaacgtttaaaccgttagggtttttaaaccttaccccgtttttaaaccgttccggttttaccggtttacccgggacccgtttagggaaccccttagttaaacgggtagtaaccctttaagtaaaccggttaacgtttaggtcccggtttcggtaacccgtaccgtacccttaccggtntttaaccg

SEQ ID NO: 204918 - DNA, 683 bp, Homo sapiens
  misc_feature: GYAE6OF02HPJL9.12.10.A10.1.454.CMB.1.raw
  modified_base (195)..(195): a, c, t, g, unknown or other
  misc_feature (195)..(195): n is a, c, g, or t
tcagatacgacgtacacgaccggtgctcgatttagcgtcgatctcagggggcaggagtcagtcccagtcaggacacagcatggacatgagggtccccgctcagctcctggggctcctgctgctctggctcccaggtgccagatgtgacatccagttgacccagtctccatccttcctgtctgctatctatagganacagagtcaccatcacttgccgggccagtacaggactattagactaatttagtttaggtcttggtatcagacagaacgacgaagggaacgtaccccgtaacgtctagactactagtggtgtctactacctactttcgactagttacggtcggggtaccctagtacgtaaggttacgagcggtacgtaggtagtagtcgtaggtacgtagtaacttctacgtctactaacaactaccacgacgtcctagacctagtaccttaagtaacgttagttttacaaccgtttaaactttaacgtttacgttacgttaaccttaaacgtttacgtttttaacctttaaccgttttaacccgttttaccgttttaacggttttacccggtcccgttacgggtacccttaacgtaacgttaacgtaaatttaccgtaaaccgttaaaccgttaacgttacgtaccggtaccgtacgtaacccttaccgtattacccg

SEQ ID NO: 204919 - DNA, 1009 bp, Homo sapiens
  misc_feature: GYAE6OF02IBN7E.12.10.A10.1.454.CMB.1.raw
  modified_base (103)..(103): a, c, t, g, unknown or other
  misc_feature (103)..(103): n is a, c, g, or t
tcagatacgacgtacacgaccggtgctcgatttagcgtcgatctcaggggggcagggagtcagtcccagtcaggacacagcatggacatggacgggtccccgntcagcctccgtgggcctccgtgctgtcctcgtcggcctcccgagggtcgaccagtacgtgtacgacctacttccgtaaggttcccgaacccgtacggttcccctcccttaaccgtttcccccgttttcccgtacgggttccctacgtaacctaactttaccggtaaaggttacgggggaaccaacccggtaggtaaccgtaccctaacccttaccgtaaccttaccgggttacccgggaccccggtaccggttaacggtacgtaaccgggtacttaaacgttacggtaactttaaacgttttacgtacggggtacttacgggttaactaccggaacgttaaacggaaaccggaaccggtaacggtaaacccggtacccgttaacggttacccgttagtaacgtaccgttagttccggtacttacgtacctaccggttacgttacggtaacggtacgtaccgggtccggtacctaacggttccgtaacggtacgcgggtctacgggttacggtcggtacggagtaaccggttacttacggtcctaccgttccacggtacctacgtagtcgtcgacgtttccgaccgtaaccgtaacgtaacgttacgttcgtttaaccgagtttaaacccgttagtttaacgtacccgttaaggtaaccccgttaaaacggttacgtaaaccccgttacccgtttaaccccggttacccggttttaaccgggttaacccggggtaaaccgggggttaacccgggttaaccgggtaaccggggttaaggtaacccggggttaaacgtaaacccggttaaaccccggggttaaacccgtttagggttccgggtaacccgttaaccccgggtaccctaaaccccggttttacccgggttactcccggtttttaaccccgg

SEQ ID NO: 204920 - DNA, 262 bp, Homo sapiens
  misc_feature: GYAE6OF01B4PLE.1.69.G03.1.454.CMB.1.raw
  modified_base (261)..(262): a, c, t, g, unknown or other
  misc_feature (261)..(262): n is a, c, g, or t
tcagacgagtgcgtcacgaccggtgctcgatttagtcgctgcgtaaaggagaaaggggatcaggcacagattttacactgaaaatcagcagagtggaggctgaggatgttggggtttattactgcatgcaagttctacaaactcctcccacttttggccaggggaccaagctggagatcaaacgaactgtggctgcaccatctgtcttcatcttcccgcatctgaacgcactcgtctgagcgggctggcaaggcgcatagnn

SEQ ID NO: 204921 - DNA, 264 bp, Homo sapiens
  misc_feature: GYAE6OF02FSP0I.1.69.G03.1.454.CMB.1.raw
  modified_base (262)..(264): a, c, t, g, unknown or other
  misc_feature (262)..(264): n is a, c, g, or t
tcagacgagtgcgtcacgaccggtgctcgatttagtcgctgcgtaaaggagaaaggggatcaggcacagattttacactgaaaatcagcagagtggaggctgaggatgttggggtttattactgcatgcaagttctacaaactcctcccacttttggccaggggaccaagctggagatcaaacgaactgtggctgcaccatctgtcttcatcttcccgccatctgaacgcactcgtctgagcgggctggcaaggcgcatagnnn

SEQ ID NO: 204922 - DNA, 222 bp, Homo sapiens
  misc_feature: GYAE6OF01BKE0C.21.10.A10.1.454.CMB.1.raw
  modified_base (199)..(222): a, c, t, g, unknown or other
  misc_feature (199)..(222): n is a, c, g, or t
tcagtcgtcgctcgcacgaccggtgctcgatttagcgtcgatctcagggtccgggagatcatgagggtgtccttgggtttggggaagaggaagactgacggtcccccaggagttcaggtgctggcacagcggccctgggctgcctggtcaaggactacgttccctgtctctactgagcgggctggcaaggcgcatacgnnnnnnnnnnnnnnnnnnnnnnnn

SEQ ID NO: 204923 - DNA, 200 bp, Homo sapiens
  misc_feature: GYAE6OF01CP1W3.21.10.A10.1.454.CMB.1.raw
  modified_base (199)..(200): a, c, t, g, unknown or other
  misc_feature (199)..(200): n is a, c, g, or t
tcagtcgtcgctcgcacgaccggtgctcgatttagcgtcgatctcagggtccgggagatcatgagggtgtccttgggtttggggaagaggaagactgacggtcccccaggagttcaggtgctgggcacagcggccctgggctgcctggtcaaggactacttccctcgtctctactgagcgggctggcaaggcgcatagnn

SEQ ID NO: 204924 - DNA, 202 bp, Homo sapiens
  misc_feature: GYAE6OF01D2X80.21.10.A10.1.454.CMB.1.raw
  modified_base (201)..(202): a, c, t, g, unknown or other
  misc_feature (201)..(202): n is a, c, g, or t
tcagtcgtcgctcgcacgaccggtgctcgatttagcgtcgatctcagggtccgggagatcatgagggtgtccttgggttttgggggaagaggaagactgacggtcccccaggagttcaggtgctgggcacagcggccctgggctgcctggtcaaggactacttccctcgtctctactgagcgggctggcaaggcgcatagnn

SEQ ID NO: 204925 - DNA, 200 bp, Homo sapiens
  misc_feature: GYAE6OF01CE7OP.21.10.A10.1.454.CMB.1.raw
  modified_base (197)..(200): a, c, t, g, unknown or other
  misc_feature (197)..(200): n is a, c, g, or t
tcagtcgtcgctcgcacgaccggtgctcgatttagcgtcgatctcagggtccgggagatcatgaggtgtccttgggtttggggaagaggaagactgacggtccccaggagttcaggtgctgagcacagcggccctgggctgcctggtcaaggactacttccctcgtctctactgagcgggctggcaaggcgcatagnnnn

SEQ ID NO: 204926 - DNA, 215 bp, Homo sapiens
  misc_feature: GYAE6OF01ATQIE.21.10.A10.1.454.CMB.1.raw
  modified_base (198)..(215): a, c, t, g, unknown or other
  misc_feature (198)..(215): n is a, c, g, or t
tcagtcgtcgctcgcacgaccggtgctcgatttagcgtcgatctcagggtccgggagatcatgagggtgtccttgggtttggggaagaggaagactgacggtcccccaggagttcaggtgctgggcacagcggccctgggctgcctggtcaaggactacttccctcgtctctactgagcggctggcaaggcgcatagnnnnnnnnnnnnnnnnnn

SEQ ID NO: 204927 - DNA, 246 bp, Homo sapiens
  misc_feature: GYAE6OF01ADKUY.21.10.A10.1.454.CMB.1.raw
  modified_base (243)..(246): a, c, t, g, unknown or other
  misc_feature (243)..(246): n is a, c, g, or t
tcagtcgtcgctcgcacgaccggtgctcgatttagcgtcgatctcagggtcttcgtggctcacgtccaccaccacgcatgtgacctcaggggtccgggagatcatgagggtgtccttgggtttgggggaagaggaagactgacggtcccccaggagttcaggtgctgggcacagcggccctgggctgcctggtcaaggactacttccctcgtctctactgagcgggctggcaaggcgcatagnnnn

SEQ ID NO: 204928 - DNA, 198 bp, Homo sapiens
  misc_feature: GYAE6OF01CHVJ3.21.10.A10.1.454.CMB.1.raw
  modified_base (198)..(198): a, c, t, g, unknown or other
  misc_feature (198)..(198): n is a, c, g, or t
tcagtcgtcgctcgcacgaccggtgctcgatttagcgtcgatctcagggtccgggagatcatgagggtgtccttgggtttggggaagaggaagactgacggtccccaggagttcaggtgctgggcacagcggccctgggctgcctggtcaaggactacttccctcgtctctactgagcgggctggcaaggcgcatagn

SEQ ID NO: 204929 - DNA, 211 bp, Homo sapiens
  misc_feature: GYAE6OF01CN2M6.21.10.A10.1.454.CMB.1.raw
  modified_base (198)..(211): a, c, t, g, unknown or other
  misc_feature (198)..(211): n is a, c, g, or t
tcagtcgtcgctcgcacgaccggtgctcgatttagcgtcgatctcagggtccgggagatcatgaggtgtccttgggtttggggaagaggaagactgacggtcccccaggagttcaggtgctgggcacagcggccctgggctgcctggtcaaggactacttccctcgtctctactgagcgggctggcaaggcgcatagnnnnnnnnnnnnnn

SEQ ID NO: 204930 - DNA, 269 bp, Homo sapiens
  misc_feature: GYAE6OF01CXUQ3.21.10.A10.1.454.CMB.1.raw
  modified_base (244)..(269): a, c, t, g, unknown or other
  misc_feature (244)..(269): n is a, c, g, or t
tcagtcgtcgctcgcacgaccggtgctcgatttagcgtcgatctcagggtcttcgtggctcacgtccaccaccacgcatgtgacctcaggggtccggagatcatgagggtgtccttgggttttgggggaagaggaagactgacggtcccccaggagttcaggtgctgggcacagcggcctgggctgcctggtcaaggactacgttccctcgtctctactgagcgggctgggcaaggcgcatagnnnnnnnnnnnnnnnnnnnnnnnnnn

SEQ ID NO: 204931 - DNA, 204 bp, Homo sapiens
  misc_feature: GYAE6OF01ELHEN.21.10.A10.1.454.CMB.1.raw
  modified_base (198)..(204): a, c, t, g, unknown or other
  misc_feature (198)..(204): n is a, c, g, or t
tcagtcgtcgctcgcacgaccggtgctcgatttagcgtcgatctcagggtccgggagatcatgaggtgtccttgggtttggggaagaggaagactgacggtcccccaggagttcaggtgctgggcacagcggccctgggctgcctggtcaaggactacttccctcgtctctactgagcgggctggcaaggcgcatagnnnnnnn

SEQ ID NO: 204932 - DNA, 247 bp, Homo sapiens
  misc_feature: GYAE6OF01D0QUH.21.10.A10.1.454.CMB.1.raw
  modified_base (245)..(247): a, c, t, g, unknown or other
  misc_feature (245)..(247): n is a, c, g, or t
tcagtcgtcgctcgcacgaccggtgctcgatttagcgtcgatctcagggtcttcgtggctcacgtccaccaccacgcatgtgacctcaggggtccgggagatcatgagggtgtccttgggttttgggggaagaggaagactgacggtccccccaggagttcaggtgctgggcacagcggccctgggctgcctggtcaaggactacttccctcgtctctactgagcgggctggcaaggcgcatagnnn

SEQ ID NO: 204933 - DNA, 246 bp, Homo sapiens; identical to SEQ ID NO: 204927
  misc_feature: GYAE6OF01AM5DE.21.10.A10.1.454.CMB.1.raw
  modified_base (243)..(246): a, c, t, g, unknown or other
  misc_feature (243)..(246): n is a, c, g, or t

SEQ ID NO: 204934 - DNA, 247 bp, Homo sapiens
  misc_feature: GYAE6OF01AL4FM.21.10.A10.1.454.CMB.1.raw
  modified_base (243)..(247): a, c, t, g, unknown or other
  misc_feature (243)..(247): n is a, c, g, or t
tcagtcgtcgctcgcacgaccggtgctcgatttagcgtcgatctcagggtcttcgtggctcacgtccaccaccacgcatgtgacctcaggggtccgggagatcatgagggtgtccttgggtttgggggaagaggaagactgacggtcccccaggagttcaggtgctgggcacagcggccctgggctgcctggtcaaggactacttccctcgtctctactgagcgggctggcaaggcgcatagnnnnn

SEQ ID NO: 204935 - DNA, 206 bp, Homo sapiens
  misc_feature: GYAE6OF01BXBG5.21.10.A10.1.454.CMB.1.raw
  modified_base (202)..(206): a, c, t, g, unknown or other
  misc_feature (202)..(206): n is a, c, g, or t
tcagtcgtcgctcgcacgaccggtgctcgatttagcgtcgatctcaggggtccgggagatcatgagggtgtccttgggttttgggggaagaggaagactgacggtcccccaggagttcaggtgctgggcacagcggccctgggctgcctggtcaaggactacttccctcgtctctactgagcgggctggcaaggcgcatagnnnnn

SEQ ID NO: 204936 - DNA, 245 bp, Homo sapiens
  misc_feature: GYAE6OF01C96MJ.21.10.A10.1.454.CMB.1.raw
  modified_base (244)..(245): a, c, t, g, unknown or other
  misc_feature (244)..(245): n is a, c, g, or t
tcagtcgtcgctcgcacgaccggtgctcgatttagcgtcgatctcagggtcttcgtggctcacgtccaccaccacgcatgtgacctcaggggtccgggagatcatgagggtgtccttgggttttgggggaagaggaagactgacggtcccccaggagttcaggtgctgggcacagcggccctgggctgcctggtcaaggactacttccctcgtctctactgagcgggctggcaaggcgcatagnn

SEQ ID NO: 204937 - DNA, 257 bp, Homo sapiens
  misc_feature: GYAE6OF01EZ7QS.21.10.A10.1.454.CMB.1.raw
  modified_base (241)..(257): a, c, t, g, unknown or other
  misc_feature (241)..(257): n is a, c, g, or t
tcagtcgtcgctcgcacgaccggtgctcgatttagcgtcgatctcagggtcgttcgtggctcacgtccacctaccacgcatgtgacctcaggggtccggagatcatgagggtgtccttgggtttgggggaagaggaagactgaacggtcccccaggagttcacggtgctgggcacagcgcctgggctgcctggtcaaggactacttcctcgtctctactgagcggctggcaggcgcatagnnnnnnnnnnnnnnnnn

SEQ ID NO: 204938 - DNA, 202 bp, Homo sapiens
  misc_feature: GYAE6OF01ETY0L.21.10.A10.1.454.CMB.1.raw
  modified_base (202)..(202): a, c, t, g, unknown or other
  misc_feature (202)..(202): n is a, c, g, or t
tcagtcgtcgctcgcacgaccggtgctcgatttagcgtcgatctcaggggtccgggagatcatgagggtgtccttgggttttgggggaagaggaagactgacggtcccccaggagttcaggtgctgggcacagcggccctgggctgcctggtcaaggactacttccctcgtctctactgagcgggctggcaaggcgcatagn

SEQ ID NO: 204939 - DNA, 203 bp, Homo sapiens
  misc_feature: GYAE6OF01DA50K.21.10.A10.1.454.CMB.1.raw
  modified_base (200)..(203): a, c, t, g, unknown or other
  misc_feature (200)..(203): n is a, c, g, or t
tcagtcgtcgctcgcacgaccggtgctcgatttagcgtcgatctcagggtccgggagatcatgaggtgtccttgggtttgggggaagaggaagactgaccggtcccccaggagttcaggtgctgggcacagcggccctgggctgcctggtcaaggactacttccctcgtctctactgagcgggctggcaaggcgcatagnnnn

SEQ ID NO: 204940 - DNA, 208 bp, Homo sapiens
  misc_feature: GYAE6OF01A3GWQ.21.10.A10.1.454.CMB.1.raw
  modified_base (203)..(208): a, c, t, g, unknown or other
  misc_feature (203)..(208): n is a, c, g, or t
tcagtcgtcgctcgcacgaccggtgctcgatttagcgtcgatctcaggggtccgggagatcatgagggtgtccttgggttttgggggaagaggaagactgacggtccccccaggagttaaggtgctgggcacagcggccctgggctgcctggtcaaggactacttccctcgtctctactgagcgggctggcaaggcgcatagnnnnnn

SEQ ID NO: 204941 - DNA, 205 bp, Homo sapiens
  misc_feature: GYAE6OF01D3LOB.21.10.A10.1.454.CMB.1.raw
  modified_base (202)..(205): a, c, t, g, unknown or other
  misc_feature (202)..(205): n is a, c, g, or t
tcagtcgtcgctcgcacgaccggtgctcgatttagcgtcgatctcaggggtccgggagatcatgagggtgtccttgggttttgggggaagaggaagactgacggtcccccaggagttcaggtgctgggcacagcggccctgggctgcctggtcaaggactacttccctcgtctctactgagcgggctggcaaggcgcatagnnnn

SEQ ID NO: 204942 - DNA, 247 bp, Homo sapiens
  misc_feature: GYAE6OF01CIZYI.21.10.A10.1.454.CMB.1.raw
  modified_base (244)..(247): a, c, t, g, unknown or other
  misc_feature (244)..(247): n is a, c, g, or t
tcagtcgtcgctcgcacgaccggtgctcgatttagcgtcgatctcagggtcttcgtggctcacgtccaccaccacgcatgtgacctcaggggtccgggagatcatgagggtgtccttgggttttgggggaagaggaagactgacggtcccccaggagttcaggtgctgggcacagcggccctgggctgcctggtcaaggactacttccctcgtctctactgagcgggctggcaaggcgcatagnnnn

SEQ ID NO: 204943 - DNA, 205 bp, Homo sapiens
  misc_feature: GYAE6OF01C7MMG.21.10.A10.1.454.CMB.1.raw
  modified_base (203)..(205): a, c, t, g, unknown or other
  misc_feature (203)..(205): n is a, c, g, or t
tcagtcgtcgctcgcacgaccggtgctcgatttagcgtcgatctcaggggtccgggagatcatgagggtgtccttgggttttgggggaagaggaagactgacggtccccccaggagttcaggtgctgggcacagcggccctgggctgcctggtcaaggactacttccctcgtctctactgagcgggctggcaaggcgcatagnnn

SEQ ID NO: 204944 - DNA, 203 bp, Homo sapiens
  misc_feature: GYAE6OF01C263N.21.10.A10.1.454.CMB.1.raw
  modified_base (201)..(203): a, c, t, g, unknown or other
  misc_feature (201)..(203): n is a, c, g, or t
tcagtcgtcgctcgcacgaccggtgctcgatttagcgtcgatctcaggggtccgggagatcatgagggtgtccttgggtttgggggaagaggaagactgacggtcccccaggagttcaggtgctgggcacagcggccctgggctgcctggtcaaggactacttccctcgtctctactgagcgggctggcaaggcgcatagnnn

SEQ ID NO: 204945 - DNA, 208 bp, Homo sapiens
  misc_feature: GYAE6OF01BY8ED.21.10.A10.1.454.CMB.1.raw
  modified_base (203)..(208): a, c, t, g, unknown or other
  misc_feature (203)..(208): n is a, c, g, or t
tcagtcgtcgctcgcacgaccggtgctcgatttagcgtcgatctcaggggtccgggagatcatgagggtgtccttgggttttgggggaagaggaagactgacggtccccccaggagttcaggtgctgggcacagcggccctgggctgcctggtcaaggactacttccctcgtctctactgagcgggctggcaaggcgcatagnnnnnn

SEQ ID NO: 204946 - DNA, 203 bp, Homo sapiens
  misc_feature: GYAE6OF01CPLRB.21.10.A10.1.454.CMB.1.raw
  modified_base (202)..(203): a, c, t, g, unknown or other
  misc_feature (202)..(203): n is a, c, g, or t
tcagtcgtcgctcgcacgaccggtgctcgatttagcgtcgatctcaggggtccgggagatcatgagggtgtccttgggttttgggggaagaggaagactgacggtccccccaggagttcaggtgctggcacagcggccctgggctgcctggtcaaggactacttccctcgtctctactgagcgggctggcaaggcgcatagnn

SEQ ID NO: 204947 - DNA, 203 bp, Homo sapiens
  misc_feature: GYAE6OF01A8QVB.21.10.A10.1.454.CMB.1.raw
  modified_base (203)..(203): a, c, t, g, unknown or other
  misc_feature (203)..(203): n is a, c, g, or t
tcagtcgtcgctcgcacgaccggtgctcgatttagcgtcgatctcaggggtccgggagatcatgagggtgtccttgggttttgggggaagaggaagactgacggtccccccaggagttcaggtgctgggcacagcggccctgggctgcctggtcaaggactacttccctcgtctctactgagcgggctggcaaggcgcatagn

SEQ ID NO: 204948 - DNA, 204 bp, Homo sapiens
  misc_feature: GYAE6OF01DJGCQ.21.10.A10.1.454.CMB.1.raw
  modified_base (203)..(204): a, c, t, g, unknown or other
  misc_feature (203)..(204): n is a, c, g, or t
tcagtcgtcgctcgcacgaccggtgctcgatttagcgtcgatctcaggggtccgggagatcatgagggtgtccttgggttttgggggaagaggaagactgacggtccccccaggagttcaggtgctgggcacagcggccctgggctgcctggtcaaggactacttccctcgtctctactgagcgggctggcaaggcgcatagnn

SEQ ID NO: 204949 - DNA, 207 bp, Homo sapiens
  misc_feature: GYAE6OF01AK06F.21.10.A10.1.454.CMB.1.raw
  modified_base (202)..(207): a, c, t, g, unknown or other
  misc_feature (202)..(207): n is a, c, g, or t
tcagtcgtcgctcgcacgaccggtgctcgatttagcgtcgatctcaggggtccgggagatcatgagggtgtccttgggttttgggggaagaggaagactgacggtcccccaggagttcaggtgctggtcacagcggccctgggctgcctggtcaaggactacttccctcgtctctactgagcgggctggcaaggcgcatagnnnnnn

SEQ ID NO: 204950 - DNA, 248 bp, Homo sapiens
  misc_feature: GYAE6OF01B5YJJ.21.10.A10.1.454.CMB.1.raw
  modified_base (243)..(248): a, c, t, g, unknown or other
  misc_feature (243)..(248): n is a, c, g, or t
tcagtcgtcgctcgcacgaccggtgctcgatttagcgtcgatctcagggtcttcgtggctcacgtccaccaccacgcatgtgacctcagggtccgggagatcatgagggtgtccttgggttttgggggaagaggaagactgacggtcccccaggagttcaggtgctgggcacagcggccctgggctgcctggtcaaggactacttccctcgtctctactgagcgggctggcaaggcgcatagnnnnnn

SEQ ID NO: 204951 - DNA, 198 bp, Homo sapiens
  misc_feature: GYAE6OF01DI6UA.21.10.A10.1.454.CMB.1.raw
  modified_base (197)..(198): a, c, t, g, unknown or other
  misc_feature (197)..(198): n is a, c, g, or t
tcagtcgtcgctcgcacgaccggtgctcgatttagcgtcgatctcagggtccggagatcatgaggtgtccttgggtttgggggaagaggaagactgacggtcccccaggagttcaggtgctggcacagcggccctgggctgcctggtcaaggactacttccctcgtctctactgagcgggctggcaaggcgcatagnn

SEQ ID NO: 204952 - DNA, 205 bp, Homo sapiens; identical to SEQ ID NO: 204943
  misc_feature: GYAE6OF01DSUW2.21.10.A10.1.454.CMB.1.raw
  modified_base (203)..(205): a, c, t, g, unknown or other
  misc_feature (203)..(205): n is a, c, g, or t

SEQ ID NO: 204953 - DNA, 201 bp, Homo sapiens
  misc_feature: GYAE6OF01A2SYL.21.10.A10.1.454.CMB.1.raw
  modified_base (201)..(201): a, c, t, g, unknown or other
  misc_feature (201)..(201): n is a, c, g, or t
tcagtcgtcgctcgcacgaccggtgctcgatttagcgtcgatctcagggtccgggagatcatgagggtgtccttgggttttgggggaagaggaagactgacggtcccccaggagttcaggtgctgggcacagcggccctgggctgcctggtcaaggactacttccctcgtctctactgagcgggctggcaaggcgcatagn

SEQ ID NO: 204954 - DNA, 206 bp, Homo sapiens
  misc_feature: GYAE6OF01BW204.21.10.A10.1.454.CMB.1.raw
  modified_base (203)..(206): a, c, t, g, unknown or other
  misc_feature (203)..(206): n is a, c, g, or t
tcagtcgtcgctcgcacgaccggtgctcgatttagcgtcgatctcaggggtccgggagatcatgagggtgtccttgggttttgggggaagaggaagactgacggtccccccaggagttcaggtgctgggcacagcggccctgggctgcctggtcaaggactacttccctcgtctctactgagcgggctggcaaggcgcatagnnnn

SEQ ID NO: 204955 - DNA, 203 bp, Homo sapiens
  misc_feature: GYAE6OF01B8E30.21.10.A10.1.454.CMB.1.raw
  modified_base (201)..(203): a, c, t, g, unknown or other
  misc_feature (201)..(203): n is a, c, g, or t
tcagtcgtcgctcgcacgaccggtgctcgatttagcgtcgatctcagggtccgggagatcatgagggtgtccttgggttttgggggaagaggaagactgacggtcccccaggagttcaggtgctgggcacagcggccctgggctgcctggtcaaggactacttccctcgtctctactgagcgggctggcaaggcgcatagnnn

SEQ ID NO: 204956 - DNA, 204 bp, Homo sapiens
  misc_feature: GYAE6OF01DRJI9.21.10.A10.1.454.CMB.1.raw
  modified_base (202)..(204): a, c, t, g, unknown or other
  misc_feature (202)..(204): n is a, c, g, or t
tcagtcgtcgctcgcacgaccggtgctcgatttagcgtcgatctcagggtccgggagatcatgagggtgtccttgggttttgggggaagaggaagactgacggtccccccaggagttcaggtgctgggcacagcggccctgggctgcctggtcaaggactacttccctcgtctctactgagcgggctggcaaggcgcatagnnn

SEQ ID NO: 204957 - DNA, 211 bp, Homo sapiens
  misc_feature: GYAE6OF01CONXE.21.10.A10.1.454.CMB.1.raw
  modified_base (203)..(211): a, c, t, g, unknown or other
  misc_feature (203)..(211): n is a, c, g, or t
tcagtcgtcgctcgcacgaccggtgctcgatttagcgtcgatctcaggggtccgggagatcatgagggtgtccttgggttttgggggaagaggaagactgaccggtccccccaggagttcaggtgctggcacagcggccctgggctgcctggtcaaggactacttccctcgtctctactgagcgggctggcaaggcgcatagnnnnnnnnn

SEQ ID NO: 204958 - DNA, 207 bp, Homo sapiens
  misc_feature: GYAE6OF01DYBPJ.21.10.A10.1.454.CMB.1.raw
  modified_base (203)..(207): a, c, t, g, unknown or other
  misc_feature (203)..(207): n is a, c, g, or t
tcagtcgtcgctcgcacgaccggtgctcgatttagcgtcgatctcaggggtccgggagatcatgagggtgtccttgggttttgggggaagaggaagactgacggtccccccaggagttcaggtgctgggcacagcggccctgggctgcctggtcaaggactacttccctcgtctctactgagcgggctggcaaggcgcatagnnnnn

SEQ ID NO: 204959 - DNA, 208 bp, Homo sapiens
  misc_feature: GYAE6OF01ECAGB.21.10.A10.1.454.CMB.1.raw
  modified_base (202)..(208): a, c, t, g, unknown or other
  misc_feature (202)..(208): n is a, c, g, or t
tcagtcgtcgctcgcacgaccggtgctcgatttagcgtcgatctcaggggtccgggagatcatgagggtgtccttgggttttgggggaagaggaagactgacggtcccccaggagttcaggtgctgggcacagcggccctgggctgcctggtcaaggactacttccctcgtctctactgagcgggctggcaaggcgcatagnnnnnnn

SEQ ID NO: 204960 - DNA, 245 bp, Homo sapiens
  misc_feature: GYAE6OF01BBKJH.21.10.A10.1.454.CMB.1.raw
  modified_base (243)..(245): a, c, t, g, unknown or other
  misc_feature (243)..(245): n is a, c, g, or t
tcagtcgtcgctcgcacgaccggtgctcgatttagcgtcgatctcagggtcttcgtggctcacgtccaccaccacgcatgtgacctcaggggtccgggagatcatgagggtgtccttgggtttgggggaagaggaagactgacggtcccccaggagttcaggtgctgggcacagcggccctgggctgcctggtcaaggactacttccctcgtctctactgagcgggctggcaaggcgcatagnnn

SEQ ID NO: 204961 - DNA, 204 bp, Homo sapiens; identical to SEQ ID NO: 204948
  misc_feature: GYAE6OF01AWFQS.21.10.A10.1.454.CMB.1.raw
  modified_base (203)..(204): a, c, t, g, unknown or other
  misc_feature (203)..(204): n is a, c, g, or t

SEQ ID NO: 204962 - DNA, 247 bp, Homo sapiens; identical to SEQ ID NO: 204934
  misc_feature: GYAE6OF01EL6O7.21.10.A10.1.454.CMB.1.raw
  modified_base (243)..(247): a, c, t, g, unknown or other
  misc_feature (243)..(247): n is a, c, g, or t

SEQ ID NO: 204963 - DNA, 262 bp, Homo sapiens
  misc_feature: GYAE6OF01E55D8.21.10.A10.1.454.CMB.1.raw
  modified_base (205)..(206): a, c, t, g, unknown or other
  misc_feature (205)..(206): n is a, c, g, or t
  modified_base (208)..(211): a, c, t, g, unknown or other
  misc_feature (208)..(211): n is a, c, g, or t
  modified_base (213)..(262): a, c, t, g, unknown or other
  misc_feature (213)..(262): n is a, c, g, or t
tcagtcgtcgctcgcacgaccggtgctcgatttagcgtcgatctcaggggtccggggagatcatgagggtgtccttgggttttggggggaagaggtaagactgacggtccccccaggagttcaggtgctgggcacagcggccctgggctgcctggtcaaggctacgttccctgtctctactgagcgggctggcaaggcgcatagnngnnnngnnnnnnnnnnnnnnnnnnnnnnnnnnnnnnnnnnnnnnnnnnnnnnnnnn

SEQ ID NO: 204964 - DNA, 214 bp, Homo sapiens
  misc_feature: GYAE6OF01BLPO2.21.10.A10.1.454.CMB.1.raw
  modified_base (203)..(214): a, c, t, g, unknown or other
  misc_feature (203)..(214): n is a, c, g, or t
tcagtcgtcgctcgcacgaccggtgctcgatttagcgtcgatctcaggggtccgggagatcatcgagggtgtccttgggttttggggggaagaggaagactgacggtccccccaggagttcaggtgctgggcacagcggccctgggctgcctggtcaaggactacttccctgtctctactgagcggctggcaaggcgcatagnnnnnnnnnnnn

SEQ ID NO: 204965 - DNA, 249 bp, Homo sapiens
  misc_feature: GYAE6OF01A91MK.21.10.A10.1.454.CMB.1.raw
  modified_base (245)..(249): a, c, t, g, unknown or other
  misc_feature (245)..(249): n is a, c, g, or t
tcagtcgtcgctcgcacgaccggtgctcgatttagcgtcgatctcagggtcttcgtggctcacgtccaccaccacgcatgtgacctcaggggtccgggagatcatgagggtgtccttgggttttgggggaagaggaagactgacggtccccccaggagttcaggtgctgggcacagcggccctgggctgcctggtcaaggactacttccctcgtctctactgagcgggctggcaaggcgcatagnnnnn

SEQ ID NO: 204966 - DNA, 210 bp, Homo sapiens
  misc_feature: GYAE6OF01DKW9X.21.10.A10.1.454.CMB.1.raw
  modified_base (205)..(210): a, c, t, g, unknown or other
  misc_feature (205)..(210): n is a, c, g, or t
tcagtcgtcgctcgcacgaccggtgctcgatttagcgtcgatctcaggggtccgggagatcatgagggtgtccttgggtttgggggaagaggaagactgaccggtccccccaggagttcaggtgcgtgggcacagccggccctgggctgcctggtcaaggactacttccctcgtctctactgagcgggctggcaaggcgcatagnnnnnn

SEQ ID NO: 204967 - DNA, 276 bp, Homo sapiens
  misc_feature: GYAE6OF01AI4A0.21.10.A10.1.454.CMB.1.raw
  modified_base (251)..(276): a, c, t, g, unknown or other
  misc_feature (251)..(276): n is a, c, g, or t
tcagtcgtcgctcgcacgaccggtgctcgatttagcgtcgatctcagggttcttcgtggctcacgtccaccaccacgcatgtgacctcaggggtccgggagatcatgagggtgtccttgggttttggggggaagaggaagactgacgggtccccccaggagttccaggtgctgggcacagcggccctgggctgcctggtcaaggactacttccctcggtctcgtactgagcgggctggcaaggcgcatagnnnnnnnnnnnnnnnnnnnnnnnnnn

SEQ ID NO: 204968 - DNA, 209 bp, Homo sapiens
  misc_feature: GYAE6OF01EIEH8.21.10.A10.1.454.CMB.1.raw
  modified_base (204)..(209): a, c, t, g, unknown or other
  misc_feature (204)..(209): n is a, c, g, or t
tcagtcgtcgctcgcacgaccggtgctcgatttagcgtcgatctcaggggtccggaagatcatgagggtgtccttgggttttggggggaagaggaagactgacggtccccccaggagttcaggtgctgggcacagcggccctgggctgcctggtcaaggactacttccctcgtctctactgagcgggctggcaaggcgcatagnnnnnn

SEQ ID NO: 204969 - DNA, 247 bp, Homo sapiens
  misc_feature: GYAE6OF01EGG30.21.10.A10.1.454.CMB.1.raw
  modified_base (244)..(247): a, c, t, g, unknown or other
  misc_feature (244)..(247): n is a, c, g, or t
tcagtcgtcgctcgcacgaccggtgctcgatttagcgtcgatctcagggtcttcgtggctcacgtccaccaccacgcatgtgacctcagggtccgggagatcatgagggtgtccttgggttttgggggaagaggaagactgacggtccccccaggagttcaggtgctgggcacagcggccctgggctgcctggtcaaggactacttccctcgtctctactgagcgggctggcaaggcgcatagnnnn

SEQ ID NO: 204970 - DNA, 206 bp, Homo sapiens
  misc_feature: GYAE6OF01CSUUE.21.10.A10.1.454.CMB.1.raw
  modified_base (204)..(206): a, c, t, g, unknown or other
  misc_feature (204)..(206): n is a, c, g, or t
tcagtcgtcgctcgcacgaccggtgctcgatttagcgtcgatctcaggggtccgggagatcatgagggtgtccttgggttttggggggaagaggaagactgacggtccccccaggagttcaggtgctgggcacagcggccctgggctgcctggtcaaggactacttccctcgtctctactgagcgggctggcaaggcgcatagnnn

SEQ ID NO: 204971 - DNA, 246 bp, Homo sapiens
  misc_feature: GYAE6OF01BD39N.21.10.A10.1.454.CMB.1.raw
  modified_base (208)..(246): a, c, t, g, unknown or other
  misc_feature (208)..(246): n is a, c, g, or t
tcagtcgtcgctcgcacgaccggtgctcgatttagcgtcgatctcgaggggtccgggagatcatgagggtgtccttgggttttgggggaagaggaagactgacgggtccccccaggagttcaggtgctggggcacagcggccctgggctgcctggtcaaggactacttccctcgtctctactgagcgggctggccaaggccgcatagnnnnnnnnnnnnnnnnnnnnnnnnnnnnnnnnnnnnnnn

SEQ ID NO: 204972 - DNA, 207 bp, Homo sapiens
  misc_feature: GYAE6OF01CKLWZ.21.10.A10.1.454.CMB.1.raw
  modified_base (204)..(207): a, c, t, g, unknown or other
  misc_feature (204)..(207): n is a, c, g, or t
tcagtcgtcgctcgcacgaccggtgctcgatttagcgtcgatctcaggggtccgggagatcatgagggtgtccttgggttttggggggaagaggaagactgacggtccccccaggagttcaggtgctgggcacagcggccctgggctgcctggtcaaggactacttccctcgtctctactgagcgggctggcaaggcgcatagnnnn

SEQ ID NO: 204973 - DNA, 203 bp, Homo sapiens
  misc_feature: GYAE6OF01CDPD3.21.10.A10.1.454.CMB.1.raw
  modified_base (199)..(203): a, c, t, g, unknown or other
  misc_feature (199)..(203): n is a, c, g, or t
tcagtcgtcgctcgcacgaccggtgctcgatttagcgtcgatctcaggggtccgggagatcatgagggtgtccttgggtttgggggaagaggaagactgacggtccccccaggagttcaggtgctgggcacagcggccctgggctgctggtcaaggactactccctgtctctactgagcgggctggcaaggcgcatagnnnnn

SEQ ID NO: 204974 - DNA, 219 bp, Homo sapiens
  misc_feature: GYAE6OF01D1OFU.21.10.A10.1.454.CMB.1.raw
  modified_base (188)..(188): a, c, t, g, unknown or other
  misc_feature (188)..(188): n is a, c, g, or t
  modified_base (212)..(219): a, c, t, g, unknown or other
  misc_feature (212)..(219): n is a, c, g, or t
tcagtcgtcgctcgcacgaccggtgctcgatttagcgtcgatctcaggggtccgggagatcatggagggtgtccttggggttttggggggaagaggaagactgaccggtccccccaggagttcgaggtgcgtgggcacagccggcccgtgggctgcctggtacaaggtctacttccctcgtctctacngagcgggctggcaaggcgcatagnnnnnnnn

SEQ ID NO: 204975 - DNA, 255 bp, Homo sapiens
  misc_feature: GYAE6OF01ETU85.21.10.A10.1.454.CMB.1.raw
  modified_base (245)..(255): a, c, t, g, unknown or other
  misc_feature (245)..(255): n is a, c, g, or t
tcagtcgtcgctcgcacgaccggtgctcgatttagcgtcgatctcaggggtcttcgtggctcacgtccaccaccacgcatgtgacctcaggggtccgggagatcatgagggtgtccttgggtttggggggaagaggaagactgacggtccccccaggagttcaggtgctgggcacagcggccctgggctgcctggtcaaggactacttcctcgtctctactgagcgggctggcaaggcgcatagnnnnnnnnnnn

SEQ ID NO: 204976 - DNA, 222 bp, Homo sapiens
  misc_feature: GYAE6OF01APVYD.21.10.A10.1.454.CMB.1.raw
  modified_base (203)..(222): a, c, t, g, unknown or other
  misc_feature (203)..(222): n is a, c, g, or t
tcagtcgtcgctcgcacgaccggtgctcgatttagcgtcgatctcaggggtccgggagataatgagggtgtccttgggttttgggggaagaggaagactgacggtccccccaggagttcaggtgctgggcacagcggccctgggctgcctggtcaaggactacttccctcgtctctactgagcgggctggcaaggcgcatagnnnnnnnnnnnnnnnnnnnn

SEQ ID NO: 204977 - DNA, 248 bp, Homo sapiens
  misc_feature: GYAE6OF01BWEGC.21.10.A10.1.454.CMB.1.raw
  modified_base (210)..(210): a, c, t, g, unknown or other
  misc_feature (210)..(210): n is a, c, g, or t
  modified_base (244)..(248): a, c, t, g, unknown or other
  misc_feature (244)..(248): n is a, c, g, or t
tcagtcgtcgctcgcacgaccggtgctcgatttagcgtcgatctcagggtcttcgtggctcacgtccaccaccacgcatgtgacctcaggggtccgggagatcatgagggtgtccttgggttttgggggaagaggaagactgacggtcccccaggagttcaggtgctgggcacagcggccctgggctgcctggtcaaggactacttcccncgtctctactgagcgggctggcaaggcgcatagnnnnn

SEQ ID NO: 204978 - DNA, 209 bp, Homo sapiens
  misc_feature: GYAE6OF01BRGX5.21.10.A10.1.454.CMB.1.raw
  modified_base (203)..(209): a, c, t, g, unknown or other
  misc_feature (203)..(209): n is a, c, g, or t
tcagtcgtcgctcgcacgaccggtgctcgatttagcgtcgatctcaggggtccgggagatcatgagggtgtccttgggttttggggggaagaggaagactgacggtccccccaggagttcaggtgctgggcacagcggccctgggctgcctggtcaaggactacttccctcgtctctactgagcgggctggcaaggcgcatgnnnnnnn

SEQ ID NO: 204979 - DNA, 210 bp, Homo sapiens
  misc_feature: GYAE6OF01EQMTJ.21.10.A10.1.454.CMB.1.raw
  modified_base (206)..(210): a, c, t, g, unknown or other
  misc_feature (206)..(210): n is a, c, g, or t
tcagtcgtcgctcgcacgaccggtgctcgatttagcgtcgatctcaggggtccgggagatcatgagggtgtccttgggttttggggggaagaggaagactgaccggtccccccaggagttcaggtgctgggcacagcggccctgggctgcctggtcaaggactacttccctcgtctctactgagcgggctggacaaggcgcatagnnnnn

SEQ ID NO: 204980 - DNA, 275 bp, Homo sapiens
  misc_feature: GYAE6OF01EFDE1.21.10.A10.1.454.CMB.1.raw
  modified_base (256)..(275): a, c, t, g, unknown or other
  misc_feature (256)..(275): n is a, c, g, or t
tcagtcgtcgctcgcacgaccggtgctcgatttagcgtcgatctcagggtcttcgtggctcacgtccaccaccacgcatgtgacctcaggggtccgggagatcatgagggtgtccttggggttttggggggaagaggaagactgacggtccccccaggagttcgaggtgcgtgggcacagcggccctgggctgcctggtcaaggtactaccttcctcgtctctacgtggaggcggcgtggcaaggtcgacagtagnnnnnnnnnnnnnnnnnnnn

SEQ ID NO: 204981 - DNA, 244 bp, Homo sapiens
  misc_feature: GYAE6OF01DY823.21.10.A10.1.454.CMB.1.raw
  modified_base (145)..(145): a, c, t, g, unknown or other
  misc_feature (145)..(145): n is a, c, g, or t
  modified_base (190)..(190): a, c, t, g, unknown or other
  misc_feature (190)..(190): n is a, c, g, or t
  modified_base (202)..(202): a, c, t, g, unknown or other
  misc_feature (202)..(202): n is a, c, g, or t
  modified_base (213)..(244): a, c, t, g, unknown or other
  misc_feature (213)..(244): n is a, c, g, or t
tcagtcgtcgctcgcacgaccggtgctcgattttagcgtcgatctcagggggttccgggggaggatcgatgaggggtgtcctttggggttttggggggaagaggaagactgacggtccccccaggagttccaggtgctcggcacngcggccctgggctgcctggtcaaggactacttccctgtctctacngagcggcctggnaggcgcatagnnnnnnnnnnnnnnnnnnnnnnnnnnnnnnnn

SEQ ID NO: 204982 - DNA, 207 bp, Homo sapiens
  misc_feature: GYAE6OF01E47S1.21.10.A10.1.454.CMB.1.raw
  modified_base (204)..(207): a, c, t, g, unknown or other
  misc_feature (204)..(207): n is a, c, g, or t
tcagtcgtcgctcgcacgaccggtgctcgatttagcgtcgatctcagggtccgggagatcatgagggtgtccttgggttttggggggaagaggaagactgacggtccccccaggagttcaggtgctgggcacagcggccctgggctgcctggtcaaggactacttccctcgtctctactgacgcgggctggcaaggcgcatagnnnn

SEQ ID NO: 204983 - DNA, 222 bp, Homo sapiens
  misc_feature: GYAE6OF01ARCMC.21.10.A10.1.454.CMB.1.raw
  modified_base (202)..(222): a, c, t, g, unknown or other
  misc_feature (202)..(222): n is a, c, g, or t
tcagtcgtcgctcgcacgaccggtgctcgatttagcgtcgatctcaggggtccgggagatcatgagggtgtccttgggttttggggggaagaggaagactgacggtccccccaggagttcaggtgctggcacagcggccctgggctgcctggtcaaggactacttccctcgtctctactgagcggctggcaaggcacatagnnnnnnnnnnnnnnnnnnnnn

SEQ ID NO: 204984 - DNA, 220 bp, Homo sapiens
  misc_feature: GYAE6OF01AX8GB.21.10.A10.1.454.CMB.1.raw
  modified_base (208)..(220): a, c, t, g, unknown or other
  misc_feature (208)..(220): n is a, c, g, or t
tcagtcgtcgctcgcacgaccggtgctcgatttagcgtcgatctcaggggtccgggagatcatgagggtgtccttgggttttggggggaagaggaagactgacggtccccccaggagttcaggtgctgggcacagcggccctgggctgcctggtcaaggacctaccgttccctcgtctctactgagcgggctggacaaggcgcatagnnnnnnnnnnnnn

SEQ ID NO: 204985 - DNA, 197 bp, Homo sapiens
  misc_feature: GYAE6OF02G7T0P.21.10.A10.1.454.CMB.1.raw
  modified_base (196)..(197): a, c, t, g, unknown or other
  misc_feature (196)..(197): n is a, c, g, or t
tcagtcgtcgctcgcacgaccggtgctcgatttagcgtcgatctcagggtccggagatcatgagggtgtccttgggtttgggaagaggaagactgacggtccccaggagttcaggtgctgggcacagcggccctgggctgcctggtcaaggactacttccctcgtctctactgagcgggctggcaaggcgcatagnn

SEQ ID NO: 204986 - DNA, 281 bp, Homo sapiens
  misc_feature: GYAE6OF02IYAGD.21.10.A10.1.454.CMB.1.raw
  modified_base (251)..(281): a, c, t, g, unknown or other
  misc_feature (251)..(281): n is a, c, g, or t
tcagtcgtcgctcgcacgaccggtgctcgatttagcgtcgatctcagggtcttcgtagggctcacgtccaccaccacgccatgtgacctcagggtcccgggagatcatgagggtgtcccttgggttttgggggaagaggaagactgaccggtcccccaggagttcaggtgctagggcacagcggccctgggctgcctggtcaaggactacttccctcgtctctacgtgagcgggctggcaaggcgcatagnnnnnnnnnnnnnnnnnnnnnnnnnnnnnnn

SEQ ID NO: 204987 - DNA, 202 bp, Homo sapiens
  misc_feature: GYAE6OF02IURT1.21.10.A10.1.454.CMB.1.raw
  modified_base (200)..(202): a, c, t, g, unknown or other
  misc_feature (200)..(202): n is a, c, g, or t
tcagtcgtcgctcgcacgaccggtgctcgatttagcgtcgatctcagggtccgggagatcatgagggtgtccttgggttttggggaagaggaagactgacggtcccccaggagttcaggtgctgggcacagcggccctgggctgcctggtcaaggactacttccctcgtctctactgagcgggctggcaaggcgcatagnnn

SEQ ID NO: 204988 - DNA, 202 bp, Homo sapiens
  misc_feature: GYAE6OF02G0GW9.21.10.A10.1.454.CMB.1.raw
  modified_base (199)..(202): a, c, t, g, unknown or other
  misc_feature (199)..(202): n is a, c, g, or t
tcagtcgtcgctcgcacgaccggtgctcgatttagcgtcgatctcagggtccgggagatcatgagggtgtccttgggtttggggaagaggaagactgacggtcccccaggagttcaggtgctgggcacagcggccctgggctgcctggtcaaggactacttccctcgtctctactgagcgggctggcaaggcgcatagnnnn

SEQ ID NO: 204989 - DNA, 203 bp, Homo sapiens; identical to SEQ ID NO: 204955
  misc_feature: GYAE6OF02G1SD6.21.10.A10.1.454.CMB.1.raw
  modified_base (201)..(203): a, c, t, g, unknown or other
  misc_feature (201)..(203): n is a, c, g, or t

SEQ ID NO: 204990 - DNA, 245 bp, Homo sapiens
  misc_feature: GYAE6OF02ISFVG.21.10.A10.1.454.CMB.1.raw
  modified_base (241)..(245): a, c, t, g, unknown or other
  misc_feature (241)..(245): n is a, c, g, or t
tcagtcgtcgctcgcacgaccggtgctcgatttagcgtcgatctcagggtcttcgtggctcacgtccaccaccacgcatgtgacctcagggtccgggagatcatgagggtgtccttgggtttggggaagaggaagactgacggtcccccaggagttcaggtgctgggcacagcggccctgggctgcctggtcaaggactacttccctcgtctctactgagcgggctggcaaggcgcatagnnnnn

SEQ ID NO: 204991 - DNA, 203 bp, Homo sapiens; identical to SEQ ID NO: 204955
  misc_feature: GYAE6OF02HF354.21.10.A10.1.454.CMB.1.raw
  modified_base (201)..(203): a, c, t, g, unknown or other
  misc_feature (201)..(203): n is a, c, g, or t

SEQ ID NO: 204992 - DNA, 204 bp, Homo sapiens
  misc_feature: GYAE6OF02FK93A.21.10.A10.1.454.CMB.1.raw
  modified_base (202)..(204): a, c, t, g, unknown or other
  misc_feature (202)..(204): n is a, c, g, or t
tcagtcgtcgctcgcacgaccggtgctcgatttagcgtcgatctcaggggtccgggagatcatgagggtgtccttgggttttgggggaagaggaagactgacggtcccccaggagttcaggtgctgggcacagcggccctgggctgactggttaaggactacttccctcgtctctactgagcgggctggcaaggcgcatagnnn

SEQ ID NO: 204993 - DNA, 203 bp, Homo sapiens; identical to SEQ ID NO: 204955
  misc_feature: GYAE6OF02GDN4V.21.10.A10.1.454.CMB.1.raw
  modified_base (201)..(203): a, c, t, g, unknown or other
  misc_feature (201)..(203): n is a, c, g, or t

SEQ ID NO: 204994 - DNA, 203 bp, Homo sapiens
  misc_feature: GYAE6OF02IC22D.21.10.A10.1.454.CMB.1.raw
  modified_base (200)..(203): a, c, t, g, unknown or other
  misc_feature (200)..(203): n is a, c, g, or t
tcagtcgtcgctcgcacgaccggtgctcgatttagcgtcgatctcagggtccgggagatcatgagggtgtccttgggttttggggaagaggaagactgacggtcccccaggagttcaggtgctgggcacagcggccctgggctgcctggtcaaggactacttccctcgtctctactgagcgggctggcaaggcgcatagnnnn

SEQ ID NO: 204995 - DNA, 206 bp, Homo sapiens; identical to SEQ ID NO: 204935
  misc_feature: GYAE6OF02GLI00.21.10.A10.1.454.CMB.1.raw
  modified_base (202)..(206): a, c, t, g, unknown or other
  misc_feature (202)..(206): n is a, c, g, or t

SEQ ID NO: 204996 - DNA, 202 bp, Homo sapiens; identical to SEQ ID NO: 204924
  misc_feature: GYAE6OF02JH55S.21.10.A10.1.454.CMB.1.raw
  modified_base (201)..(202): a, c, t, g, unknown or other
  misc_feature (201)..(202): n is a, c, g, or t

SEQ ID NO: 204997 - DNA, 211 bp, Homo sapiens
  misc_feature: GYAE6OF02H6NVF.21.10.A10.1.454.CMB.1.raw
  modified_base (202)..(211): a, c, t, g, unknown or other
  misc_feature (202)..(211): n is a, c, g, or t
tcagtcgtcgctcgcacgaccggtgctcgatttagcgtcgatctcaggggtccgggagatcatgagggtgtccttgggttttgggggaagaggaagactgacggtcccccaggagttcaggtgctgggcacagcggccctgggctgcctggtcaaggactacttccctcgtctctactgagcgggctggcaaggcgcatagnnnnnnnnnn

SEQ ID NO: 204998 - DNA, 203 bp, Homo sapiens; identical to SEQ ID NO: 204955
  misc_feature: GYAE6OF02GE40R.21.10.A10.1.454.CMB.1.raw
  modified_base (201)..(203): a, c, t, g, unknown or other
  misc_feature (201)..(203): n is a, c, g, or t

SEQ ID NO: 204999 - DNA, 201 bp, Homo sapiens
  misc_feature: GYAE6OF02F1M28.21.10.A10.1.454.CMB.1.raw
  modified_base (200)..(201): a, c, t, g, unknown or other
  misc_feature (200)..(201): n is a, c, g, or t
tcagtcgtcgctcgcacgaccggtgctcgatttagcgtcgatctcagggtccgggagatcatgagggtgtccttgggttttgggggaagaggaagactgacggtcccccaggagttcaggtgctgggcacagcggccctgggctgcctggtcaaggactacttccctcgtctctactgagcggctggcaaggcgcatagnn

SEQ ID NO: 205000 - DNA, 235 bp, Homo sapiens
  misc_feature: GYAE6OF02F5TL6.21.10.A10.1.454.CMB.1.raw
  modified_base (202)..(235): a, c, t, g, unknown or other
  misc_feature (202)..(235): n is a, c, g, or t
tcagtcgtcgctcgcacgaccggtgctcgatttagcgtcgatctcaggggtccgggagatcatgagggtgtccttgggttttgggggaagaggaagactgacggtcccccaggagttcaggtgcctgggcacagcggccctgggctgcctggtcaaggactacttccctcgtctctactgagcggctggcaaggcgcatagnnnnnnnnnnnnnnnnnnnnnnnnnnnnnnnnnn

SEQ ID NO: 205001 - DNA, 204 bp, Homo sapiens
  misc_feature: GYAE6OF02H3PFG.21.10.A10.1.454.CMB.1.raw
  modified_base (202)..(204): a, c, t, g, unknown or other
  misc_feature (202)..(204): n is a, c, g, or t
tcagtcgtcgctcgcacgaccggtgctcgatttagcgtcgatctcaggggtccgggagatcatgagggtgtccttgggttttgggggaagaggaagactgacggtcccccaggagttcaggtgctgggcacagcggccctgggctgcctggtcaaggactacttccctcgtctctactgagcgggctggcaaggcgcatagnnn

SEQ ID NO: 205002 - DNA, 203 bp, Homo sapiens
  misc_feature: GYAE6OF02II5ZV.21.10.A10.1.454.CMB.1.raw
  modified_base (202)..(203): a, c, t, g, unknown or other
  misc_feature (202)..(203): n is a, c, g, or t
tcagtcgtcgctcgcacgaccggtgctcgatttagcgtcgatctcaggggtccgggagatcatgagggtgtccttgggttttgggggaagaggaagactgacggtcccccaggagttcaggtgctgggcacagcggccctgggctgcctggtcaaggactacttccctcgtctctactgagcgggctggcaaggcgcatagnn

SEQ ID NO: 205003 - DNA, 203 bp, Homo sapiens; identical to SEQ ID NO: 205002
  misc_feature: GYAE6OF02H6Y11.21.10.A10.1.454.CMB.1.raw
  modified_base (202)..(203): a, c, t, g, unknown or other
  misc_feature (202)..(203): n is a, c, g, or t

SEQ ID NO: 205004 - DNA, 204 bp, Homo sapiens; identical to SEQ ID NO: 205001
  misc_feature: GYAE6OF02GJT0V.21.10.A10.1.454.CMB.1.raw
  modified_base (202)..(204): a, c, t, g, unknown or other
  misc_feature (202)..(204): n is a, c, g, or t

SEQ ID NO: 205005 - DNA, 206 bp, Homo sapiens; identical to SEQ ID NO: 204935
  misc_feature: GYAE6OF02HW6AP.21.10.A10.1.454.CMB.1.raw
  modified_base (202)..(206): a, c, t, g, unknown or other
  misc_feature (202)..(206): n is a, c, g, or t

SEQ ID NO: 205006 - DNA, 202 bp, Homo sapiens; identical to SEQ ID NO: 204924
  misc_feature: GYAE6OF02F7LZL.21.10.A10.1.454.CMB.1.raw
  modified_base (201)..(202): a, c, t, g, unknown or other
  misc_feature (201)..(202): n is a, c, g, or t

SEQ ID NO: 205007 - DNA, 208 bp, Homo sapiens
  misc_feature: GYAE6OF02F5X4L.21.10.A10.1.454.CMB.1.raw
  modified_base (203)..(208): a, c, t, g, unknown or other
  misc_feature (203)..(208): n is a, c, g, or t
tcagtcgtcgctcgcacgaccggtgctcgatttagcgtcgatctcaggggtccgggagatcatgagggtgtccttgggttttgggggaagaggaagactggacggtcccccaggagttcaggtgctgggcacagcggccctgggctgcctggtcaaggactacttccctcgtctctactgagcgggctggcaaggcgcatagnnnnnn

SEQ ID NO: 205008 - DNA, 257 bp, Homo sapiens
  misc_feature: GYAE6OF02FVBJC.21.10.A10.1.454.CMB.1.raw
  modified_base (230)..(230): a, c, t, g, unknown or other
  misc_feature (230)..(230): n is a, c, g, or t
  modified_base (233)..(235): a, c, t, g, unknown or other
  misc_feature (233)..(235): n is a, c, g, or t
  modified_base (238)..(239): a, c, t, g, unknown or other
  misc_feature (238)..(239): n is a, c, g, or t
  modified_base (241)..(241): a, c, t, g, unknown or other
  misc_feature (241)..(241): n is a, c, g, or t
  modified_base (243)..(243): a, c, t, g, unknown or other
  misc_feature (243)..(243): n is a, c, g, or t
  modified_base (245)..(245): a, c, t, g, unknown or other
  misc_feature (245)..(245): n is a, c, g, or t
  modified_base (247)..(247): a, c, t, g, unknown or other
  misc_feature (247)..(247): n is a, c, g, or t
  modified_base (249)..(250): a, c, t, g, unknown or other
  misc_feature (249)..(250): n is a, c, g, or t
  modified_base (252)..(257): a, c, t, g, unknown or other
  misc_feature (252)..(257): n is a, c, g, or t
tcagtcgtcgctcgcacgaccggtgctcgatttagcgtcgatctcaggggtccggtagagtcatgacgggtcgtcccttgggttttgggggaagaggaagacctgacgggtccccccgaggagttcaggtgcgtgggcctacgttagggacggcccgtagggctgccgtccggtcgaaggtctacgttcctcgtcgtctactgagccggcgtgcgaacggcggcagtagntcnnnctnngngngngngnngnnnnnn

SEQ ID NO: 205009 - DNA, 227 bp, Homo sapiens
  misc_feature: GYAE6OF02FWVN3.21.10.A10.1.454.CMB.1.raw
  modified_base (204)..(227): a, c, t, g, unknown or other
  misc_feature (204)..(227): n is a, c, g, or t
tcagtcgtcgctcgcacgaccggtgctcgatttagcgtcgatctcaggggtccgggagatcatgagggtgtccttgggttttgggggaagaggaagactgacggtcccccaggagttcaggtgctgggcacagcggccctgggctgcctggtcgaaggactacttccctcgtctctactgagtcgggctggcaaggcgcatagnnnnnnnnnnnnnnnnnnnnnnnn

SEQ ID NO: 205010 - DNA, 203 bp, Homo sapiens; identical to SEQ ID NO: 205002
  misc_feature: GYAE6OF02IBAEP.21.10.A10.1.454.CMB.1.raw
  modified_base (202)..(203): a, c, t, g, unknown or other
  misc_feature (202)..(203): n is a, c, g, or t

SEQ ID NO: 205011 - DNA, 282 bp, Homo sapiens
  misc_feature: GYAE6OF02HPWJY.21.10.A10.1.454.CMB.1.raw
  modified_base (246)..(282): a, c, t, g, unknown or other
  misc_feature (246)..(282): n is a, c, g, or t
tcagtcgtcgctcgcacgaccggtgctcgatttagcgtcgatctcagggtcttcgtggctcacgtccaccaccacgcatgtgacctcagggtccgggagatcatgagggtgtccttgggttttgggggaagaggaagactgacggtcccccaggagtttcaggtgctgggcacagcggccctgggcctgcctggtcaaggctacttccctcggtctctactgagcgggctggccaaggcgcatagnnnnnnnnnnnnnnnnnnnnnnnnnnnnnnnnnnnnn

SEQ ID NO: 205012 - DNA, 206 bp, Homo sapiens; identical to SEQ ID NO: 204935
  misc_feature: GYAE6OF02GZR4L.21.10.A10.1.454.CMB.1.raw
  modified_base (202)..(206): a, c, t, g, unknown or other
  misc_feature (202)..(206): n is a, c, g, or t

SEQ ID NO: 205013 - DNA, 203 bp, Homo sapiens; identical to SEQ ID NO: 204955
  misc_feature: GYAE6OF02HHHPI.21.10.A10.1.454.CMB.1.raw
  modified_base (201)..(203): a, c, t, g, unknown or other
  misc_feature (201)..(203): n is a, c, g, or t

SEQ ID NO: 205014 - DNA, 247 bp, Homo sapiens; identical to SEQ ID NO: 204942
  misc_feature: GYAE6OF02H4RXW.21.10.A10.1.454.CMB.1.raw
  modified_base (244)..(247): a, c, t, g, unknown or other
  misc_feature (244)..(247): n is a, c, g, or t

SEQ ID NO: 205015 - DNA, 205 bp, Homo sapiens
  misc_feature: GYAE6OF02J2O8V.21.10.A10.1.454.CMB.1.raw
  modified_base (200)..(205): a, c, t, g, unknown or other
  misc_feature (200)..(205): n is a, c, g, or t
tcagtcgtcgctcgcacgaccggtgctcgatttagcgtcgatctcagggtccgggagatcatgagggtgtccttgggttttgggggaagaggaagactgacggtcccccaggagttcaggtgctgggcacagcggcctgggctgcctggtcaaggactacttccctcgtctctactgagcgggctggcaaggcgcatagnnnnnn

SEQ ID NO: 205016 - DNA, 204 bp, Homo sapiens; identical to SEQ ID NO: 205001
  misc_feature: GYAE6OF02HUNHG.21.10.A10.1.454.CMB.1.raw
  modified_base (202)..(204): a, c, t, g, unknown or other
  misc_feature (202)..(204): n is a, c, g, or t

SEQ ID NO: 205017 - DNA, 206 bp, Homo sapiens; identical to SEQ ID NO: 204935
  misc_feature: GYAE6OF02IOOIQ.21.10.A10.1.454.CMB.1.raw
  modified_base (202)..(206): a, c, t, g, unknown or other
  misc_feature (202)..(206): n is a, c, g, or t

SEQ ID NO: 205018 - DNA, 247 bp, Homo sapiens; identical to SEQ ID NO: 204934
  misc_feature: GYAE6OF02GYX19.21.10.A10.1.454.CMB.1.raw
  modified_base (243)..(247): a, c, t, g, unknown or other
  misc_feature (243)..(247): n is a, c, g, or t

SEQ ID NO: 205019 - DNA, 209 bp, Homo sapiens
  misc_feature: GYAE6OF02GJ9CC.21.10.A10.1.454.CMB.1.raw
  modified_base (203)..(209): a, c, t, g, unknown or other
  misc_feature (203)..(209): n is a, c, g, or t
tcagtcgtcgctcgcacgaccggtgctcgatttagcgtcgatctcaggggtccgggagatcatgagggtgtccttgggttttgggggaagaggaagactgacggtccccccaggagttcaggtgctgggcacagcggccctgggctgcctggtcaaggactacttccctcgtctctactgagcgggctggcaaggcgcatagnnnnnnn

SEQ ID NO: 205020 - DNA, 204 bp, Homo sapiens; identical to SEQ ID NO: 205001
  misc_feature: GYAE6OF02I4N6X.21.10.A10.1.454.CMB.1.raw
  modified_base (202)..(204): a, c, t, g, unknown or other
  misc_feature (202)..(204): n is a, c, g, or t

SEQ ID NO: 205021 - DNA, 208 bp, Homo sapiens; identical to SEQ ID NO: 204959
  misc_feature: GYAE6OF02I1YBN.21.10.A10.1.454.CMB.1.raw
  modified_base (202)..(208): a, c, t, g, unknown or other
  misc_feature (202)..(208): n is a, c, g, or t

SEQ ID NO: 205022 - DNA, 219 bp, Homo sapiens
  misc_feature: GYAE6OF02ISYI5.21.10.A10.1.454.CMB.1.raw
  modified_base (203)..(219): a, c, t, g, unknown or other
  misc_feature (203)..(219): n is a, c, g, or t
tcagtcgtcgctcgcacgaccggtgctcgatttagcgtcgatctcaggggtccgggagatcatgagggtgtccttgggttttggggggaagaggaagactgacggtccccccaggagttcaggtgctgggcacagcggccctgggctgcctggtcaaggactacttccctgtctctactgagcgggctggcaaggcgcatagnnnnnnnnnnnnnnnnn

SEQ ID NO: 205023 - DNA, 204 bp, Homo sapiens; identical to SEQ ID NO: 205001
  misc_feature: GYAE6OF02GKB4T.21.10.A10.1.454.CMB.1.raw
  modified_base (202)..(204): a, c, t, g, unknown or other
  misc_feature (202)..(204): n is a, c, g, or t

SEQ ID NO: 205024 - DNA, 205 bp, Homo sapiens; identical to SEQ ID NO: 204941
  misc_feature: GYAE6OF02I6RIM.21.10.A10.1.454.CMB.1.raw
  modified_base (202)..(205): a, c, t, g, unknown or other
  misc_feature (202)..(205): n is a, c, g, or t

SEQ ID NO: 205025 - DNA, 207 bp, Homo sapiens; identical to SEQ ID NO: 204972
  misc_feature: GYAE6OF02FY7O0.21.10.A10.1.454.CMB.1.raw
  modified_base (204)..(207): a, c, t, g, unknown or other
  misc_feature (204)..(207): n is a, c, g, or t

SEQ ID NO: 205026 - DNA, 208 bp, Homo sapiens
  misc_feature: GYAE6OF02IDLQ1.21.10.A10.1.454.CMB.1.raw
  modified_base (197)..(197): a, c, t, g, unknown or other
  misc_feature (197)..(197): n is a, c, g, or t
  modified_base (204)..(208): a, c, t, g, unknown or other
  misc_feature (204)..(208): n is a, c, g, or t
tcagtcgtcgctcgcacgaccggtgctcgatttagcgtcgatctcaggggtccgggagatcatgagggtgtccttgggttttggggggaagaggaagactgacggtcccccaggagttcaggtgctgggcacagcggccctgggctgcctggtcaaggactacttccctcgtctctactgagcgggctggcaaggcncgatagnnnnn

SEQ ID NO: 205027 - DNA, 249 bp, Homo sapiens; identical to SEQ ID NO: 204965
  misc_feature: GYAE6OF02HFYAW.21.10.A10.1.454.CMB.1.raw
  modified_base (245)..(249): a, c, t, g, unknown or other
  misc_feature (245)..(249): n is a, c, g, or t

SEQ ID NO: 205028 - DNA, 249 bp, Homo sapiens
  misc_feature: GYAE6OF02F4A4X.21.10.A10.1.454.CMB.1.raw
  modified_base (244)..(249): a, c, t, g, unknown or other
  misc_feature (244)..(249): n is a, c, g, or t
tcagtcgtcgctcgcacgaccggtgctcgatttagcgtcgatctcagggtcttcgtggctcacgtccaccaccacgcatgtgacctcaggggtccgggagatcatgagggtgtccttgggttttggggggaagaggaagactgacggtcccccaggagttcaggtgctgggcacagcggccctgggctgcctggtcaaggactacttccctcgtctctactgagcggctggcaaggcgcatagnnnnnn

SEQ ID NO: 205029 - DNA, 210 bp, Homo sapiens
  misc_feature: GYAE6OF02H52SR.21.10.A10.1.454.CMB.1.raw
  modified_base (203)..(210): a, c, t, g, unknown or other
  misc_feature (203)..(210): n is a, c, g, or t
tcagtcgtcgctcgcacgaccggtgctcgatttagcgtcgatctcaggggtccgggagatcatgagggtgtccttgggttttgggggaagaggaagactgacggtcccccaggagttcaggtgctgggcacagcggccctgggctgcctggtcaaaggactacttccctcgtctctactgagcgggctggcaaggcgcatagnnnnnnnn

SEQ ID NO: 205030 - DNA, 204 bp, Homo sapiens; identical to SEQ ID NO: 205001
  misc_feature: GYAE6OF02GU6RO.21.10.A10.1.454.CMB.1.raw
  modified_base (202)..(204): a, c, t, g, unknown or other
  misc_feature (202)..(204): n is a, c, g, or t

SEQ ID NO: 205031 - DNA, 253 bp, Homo sapiens
  misc_feature: GYAE6OF02JAO3X.21.10.A10.1.454.CMB.1.raw
  modified_base (246)..(253): a, c, t, g, unknown or other
  misc_feature (246)..(253): n is a, c, g, or t
tcagtcgtcgctcgcacgaccggtgctcgatttagcgtcgatctcagggtcttcgtggctcacgtccaccaccacgcatgtgacctcaggggtccgggagatcatgagggtgtccttgggttttggggggaagaggaagactgacggtccccccaggagttcaggtgctgggcacagcggccctgggctgcctggtcaaggactacttccctcgtctctactgagcgggctggcaaggcgcatagnnnnnnnn

SEQ ID NO: 205032 - DNA, 208 bp, Homo sapiens; identical to SEQ ID NO: 204959
  misc_feature: GYAE6OF02GR9FE.21.10.A10.1.454.CMB.1.raw
  modified_base (202)..(208): a, c, t, g, unknown or other
  misc_feature (202)..(208): n is a, c, g, or t

SEQ ID NO: 205033 - DNA, 205 bp, Homo sapiens; identical to SEQ ID NO: 204943
  misc_feature: GYAE6OF02GXJJV.21.10.A10.1.454.CMB.1.raw
  modified_base (203)..(205): a, c, t, g, unknown or other
  misc_feature (203)..(205): n is a, c, g, or t

SEQ ID NO: 205034 - DNA, 205 bp, Homo sapiens
  misc_feature: GYAE6OF02GOJHB.21.10.A10.1.454.CMB.1.raw
  modified_base (203)..(205): a, c, t, g, unknown or other
  misc_feature (203)..(205): n is a, c, g, or t
tcagtcgtcgctcgcacgaccggtgctcgatttagcgtcgatctcaggggtccgggagatcatgagggtgtccttgggttttgggggaagaggaagactgacggtccccccaggagttcaggtgctgggcacagcggccctgagctgcctggtcaaggactacttccctcgtctctactgagcgggctggcaaggcgcatagnnn

SEQ ID NO: 205035 - DNA, 209 bp, Homo sapiens; identical to SEQ ID NO: 205019
  misc_feature: GYAE6OF02F4KPF.21.10.A10.1.454.CMB.1.raw
  modified_base (203)..(209): a, c, t, g, unknown or other
  misc_feature (203)..(209): n is a, c, g, or t

SEQ ID NO: 205036 - DNA, 215 bp, Homo sapiens
  misc_feature: GYAE6OF02HUY9B.21.10.A10.1.454.CMB.1.raw
  modified_base (204)..(215): a, c, t, g, unknown or other
  misc_feature (204)..(215): n is a, c, g, or t
tcagtcgtcgctcgcacgaccggtgctcgatttagcgtcgatctcaggggtccgggagatcatgagggtgtccttgggttttggggggaagaggaagactgacggtccccccaggagttcaggtgctgggcacagcggccctgggctgcctggtcaaggactacttccctcgtctctactgagcgggctggcaaggcgcatagnnnnnnnnnnnn

SEQ ID NO: 205037 - DNA, 249 bp, Homo sapiens
  misc_feature: GYAE6OF02HUNC5.21.10.A10.1.454.CMB.1.raw
  modified_base (207)..(207): a, c, t, g, unknown or other
  misc_feature (207)..(207): n is a, c, g, or t
  modified_base (209)..(249): a, c, t, g, unknown or other
  misc_feature (209)..(249): n is a, c, g, or t
tcagtcgtcgctcgcacgaccggtgctcgatttagcgtcgatctcaggggttccggggagatcatgagggtgtccttgggttttggggggaagaggaagactgacggtccccccaggagttcaggtgctggcacagcggccctgggctgcctggtcaaaggacttacttccctcgtctctactgagcgggctggcaaggcgcatagncnnnnnnnnnnnnnnnnnnnnnnnnnnnnnnnnnnnnnnnnn

SEQ ID NO: 205038 - DNA, 250 bp, Homo sapiens
  misc_feature: GYAE6OF02JYT8W.21.10.A10.1.454.CMB.1.raw
  modified_base (244)..(250): a, c, t, g, unknown or other
  misc_feature (244)..(250): n is a, c, g, or t
tcagtcgtcgctcgcacgaccggtgctcgatttagcgtcgatctcagggtcttcgtggctcacgtccaccaccacgcatgtgacctcaggggtccgggagatcatgagggtgtccttgggtttggggggaagaggaagactgacggtcccccaggagttcaggtgctgggcacagcggccctgggctgcctggtcaaggactacttccctcgtctctactgagcgggctggcaaggcgcatagnnnnnnn

SEQ ID NO: 205039 - DNA, 207 bp, Homo sapiens; identical to SEQ ID NO: 204972
  misc_feature: GYAE6OF02IULBL.21.10.A10.1.454.CMB.1.raw
  modified_base (204)..(207): a, c, t, g, unknown or other
  misc_feature (204)..(207): n is a, c, g, or t

SEQ ID NO: 205040 - DNA, 214 bp, Homo sapiens
  misc_feature: GYAE6OF02FGGCG.21.10.A10.1.454.CMB.1.raw
  modified_base (196)..(196): a, c, t, g, unknown or other
  misc_feature (196)..(196): n is a, c, g, or t
  modified_base (202)..(214): a, c, t, g, unknown or other
  misc_feature (202)..(214): n is a, c, g, or t
tcagtcgtcgctcgcacgaccggtgctcgatttagcgtcgatctcaggggtccgggagatcatgagggtgtccttgggttttgggggaagaggaagactgacggtccccccaggagttcaggtgctgggcacagcggccctgggctgcctggtcaaggactacttccctgtctctactgagcgggctggcaaggcncatagnnnnnnnnnnnnn

SEQ ID NO: 205041 - DNA, 304 bp, Homo sapiens
  misc_feature: GYAE6OF02IHMLI.21.10.A10.1.454.CMB.1.raw
  modified_base (261)..(262): a, c, t, g, unknown or other
  misc_feature (261)..(262): n is a, c, g, or t
  modified_base (266)..(304): a, c, t, g, unknown or other
  misc_feature (266)..(304): n is a, c, g, or t
tcagtcgtcgctcgcacgaccggtgctcgatttagcgtcgatctcagggtcgttcgtggctcacgtccaccacccaccgcatgtgacctcaggggtccgggagatccatgaggtgtccttggggttttgggggagaggaagctgaccggtccccccgaggagttccgaggtcgctggggacacgagcggccctgggcctgccctggtcaacggactacgtcctccgtcttctatggagtcgggctgggccaggcgcatagnnagtnnnnnnnnnnnnnnnnnnnnnnnnnnnnnnnnnnnnnnn

SEQ ID NO: 205042 - DNA, 298 bp, Homo sapiens
  misc_feature: GYAE6OF02GKVV4.21.10.A10.1.454.CMB.1.raw
  modified_base (211)..(211): a, c, t, g, unknown or other
  misc_feature (211)..(211): n is a, c, g, or t
  modified_base (216)..(219): a, c, t, g, unknown or other
  misc_feature (216)..(219): n is a, c, g, or t
  modified_base (221)..(298): a, c, t, g, unknown or other
  misc_feature (221)..(298): n is a, c, g, or t
tcagtcgtcgctcgcacgaccggtgctcgatttagcgtcgatctcagggggtccgggagatcatgagggtgtccgttgggttttgggggggaagagggtaaggacgtgaccgggtccccccaggagttccaggtgcgtggcacaggcggcctgggctcgctggtcaacggtctcttcctctctctactgagcgggtctggactaaggcganagtgnnnncnnnnnnnnnnnnnnnnnnnnnnnnnnnnnnnnnnnnnnnnnnnnnnnnnnnnnnnnnnnnnnnnnnnnnnnnnnnnnn

SEQ ID NO: 205043 - DNA, 153 bp, Homo sapiens
  misc_feature: GYAE6OF01DCNTQ.30.25.C03.1.454.CMB.1.raw
  modified_base (153)..(153): a, c, t, g, unknown or other
  misc_feature (153)..(153): n is a, c, g, or t
tcagcacgctacgtcacgaccggtgctcgatttagtagtgtagatttgggtttgggaagaggaagactgacggtcctgccacagcggccctgggctgcctggtcaaggactacttccacgtagcgtgctgagcgggctggcaaggcgcatagn

SEQ ID NO: 205044 - DNA, 150 bp, Homo sapiens
  misc_feature: GYAE6OF01AHZQY.30.25.C03.1.454.CMB.1.raw
  modified_base (148)..(150): a, c, t, g, unknown or other
  misc_feature (148)..(150): n is a, c, g, or t
tcagcacgctacgtcacgaccggtgctcgattagtagtgtagattgggttgggaaggaggagactgacggtcctgccacagcggccctggctgcctggtcaaggactacttccacgtagcgtgctgagcggctggcaaggcgcatagnnn

SEQ ID NO: 205045 - DNA, 183 bp, Homo sapiens
  misc_feature: GYAE6OF01CF925.30.25.C03.1.454.CMB.1.raw
  modified_base (155)..(183): a, c, t, g, unknown or other
  misc_feature (155)..(183): n is a, c, g, or t
tcagcacgctacgtcacgaccggtgctcgatttagtagtgtagatttgggtttggggaaggaggaagactgacggtcctgccacagcggccctgggctgcctggtcaaggactacttccacgtagcgtgctgagcgggctggcaaggcgcatagnnnnnnnnnnnnnnnnnnnnnnnnnnnnn

SEQ ID NO: 205046 - DNA, 228 bp, Homo sapiens
  misc_feature: GYAE6OF01DADZ5.30.25.C03.1.454.CMB.1.raw
  modified_base (225)..(228): a, c, t, g, unknown or other
  misc_feature (225)..(228): n is a, c, g, or t
tcagcacgctacgtcacgaccggtgctcgatttagtagtgtagattgggtttgggtgcccaagctgctggagggcacggtcaccgtctcctcagcctccaccaagggcccatcggtcttcccctggcacctcctccaagagcacctctggggcacagcggcctgggctgcctggtcaaggactacttccacgtagcgtgctgagcgggctggcaaggcgcatagnnnn

SEQ ID NO: 205047 - DNA, 151 bp, Homo sapiens
  misc_feature: GYAE6OF01B0ERB.30.25.C03.1.454.CMB.1.raw
  modified_base (151)..(151): a, c, t, g, unknown or other
  misc_feature (151)..(151): n is a, c, g, or t
tcagcacgctacgtcacgaccggtgctcgatttagtagtgtagattgggttgggaagaggaagactgacggtcctgccacagcggccctgggctgcctggtcaaggactacttccacgtagcgtgctgagcgggctggcaaggcgcatagn

SEQ ID NO: 205048 - DNA, 171 bp, Homo sapiens
  misc_feature: GYAE6OF01BP8M9.30.25.C03.1.454.CMB.1.raw
  modified_base (171)..(171): a, c, t, g, unknown or other
  misc_feature (171)..(171): n is a, c, g, or t
tcagcacgctacgtcacgaccggtgctcgatttagtagtgtagatttgggtttggggaagaggaagactgacggtccccaggagttcaggtgctgggcacagcggccctgggctgcctggtcaaggactacttccacgtagcgtgctgagcgggctggcaaggcgcatagn

SEQ ID NO: 205049 - DNA, 229 bp, Homo sapiens
  misc_feature: GYAE6OF01ADEF6.30.25.C03.1.454.CMB.1.raw
  modified_base (228)..(229): a, c, t, g, unknown or other
  misc_feature (228)..(229): n is a, c, g, or t
tcagcacgctacgtcacgaccggtgctcgatttagtagtgtagatttgggtttgggtgcccaagctgctggagggcacggtcaccgtctcctcagcctccaccaagggcccatcggtcttcccctggcaccctcctccaagagcacctctggggcacagcggccctgggctgcctggtcaaggactacttccacgtagcgtgctgagcgggctggcaaggcgcatagnn

SEQ ID NO: 205050 - DNA, 173 bp, Homo sapiens
  misc_feature: GYAE6OF01CC9HJ.30.25.C03.1.454.CMB.1.raw
  modified_base (170)..(173): a, c, t, g, unknown or other
  misc_feature (170)..(173): n is a, c, g, or t
tcagcacgctacgtcacgaccggtgctcgatttagtagtgtagatttgggtttgggaagaggaagactgacggtccccaggagttcaggtgctgggcacagcggccctgggctgcctggtcaaggactacttccacgtagcgtgctgagcgggctggcaaggcgcatagnnnn

SEQ ID NO: 205051 - DNA, 196 bp, Homo sapiens
  misc_feature: GYAE6OF01AHCZX.30.25.C03.1.454.CMB.1.raw
  modified_base (173)..(196): a, c, t, g, unknown or other
  misc_feature (173)..(196): n is a, c, g, or t
tcagcacgctacgtcacgaccggtgctcgatttagtagtgtagatttgggtttgggggaagaggaagactgacggtcccccaggagttcaggtgctgggcacagcggccctgggctgcctggtcaaggactacttccacgtagcgtgctgagcgggctggcaaggcgcatagnnnnnnnnnnnnnnnnnnnnnnnn

SEQ ID NO: 205052 - DNA, 229 bp, Homo sapiens; identical to SEQ ID NO: 205049
  misc_feature: GYAE6OF01CP846.30.25.C03.1.454.CMB.1.raw
  modified_base (228)..(229): a, c, t, g, unknown or other
  misc_feature (228)..(229): n is a, c, g, or t

SEQ ID NO: 205053 - DNA, 171 bp, Homo sapiens; identical to SEQ ID NO: 205048
  misc_feature: GYAE6OF01DJ2XN.30.25.C03.1.454.CMB.1.raw
  modified_base (171)..(171): a, c, t, g, unknown or other
  misc_feature (171)..(171): n is a, c, g, or t

SEQ ID NO: 205054 - DNA, 229 bp, Homo sapiens
  misc_feature: GYAE6OF01AYV3S.30.25.C03.1.454.CMB.1.raw
  modified_base (226)..(229): a, c, t, g, unknown or other
  misc_feature (226)..(229): n is a, c, g, or t
tcagcacgctacgtcacgaccggtgctcgatttagtagtgtagatttgggttggtgcccaagctgctggagggcacggtcaccgtctcctcagcctccaccaagggcccatcggtcttcccctggcaccctcctccaagagcacctctggggcacagcggccctgggctgcctggtcaaggactacttccacgtagcgtgctgagcgggctggcaaggcgcatagnnnn

SEQ ID NO: 205055 - DNA, 153 bp, Homo sapiens
  misc_feature: GYAE6OF01AX6QL.30.25.C03.1.454.CMB.1.raw
  modified_base (153)..(153): a, c, t, g, unknown or other
  misc_feature (153)..(153): n is a, c, g, or t
tcagcacgctacgtcacgaccggtgctcgatttagtagtgtagatttgggttggggaagaggaagactgacggtcctgccacagcggccctgggctgcctggtcaaggactacttccacgtagcgtgctgagcgggctggcaaggcgcatagn

SEQ ID NO: 205056 - DNA, 239 bp, Homo sapiens
  misc_feature: GYAE6OF01DTMO1.30.25.C03.1.454.CMB.1.raw
  modified_base (230)..(239): a, c, t, g, unknown or other
  misc_feature (230)..(239): n is a, c, g, or t
tcagcacgctacgtcacgaccggtgctcgatttagtagtgtagatttgggtttgggtgcccgaagctgctggagggcacggtcaccgtctcctcagcctccaccaagggcccatcggtcttccccctggcaccctcctccaagagcacctctggggcacagcggcctgggctgcctggtcaaggactacttccacgtagcgtgctgagcgggctggcaaggcgcagtagnnnnnnnnnn

SEQ ID NO: 205057 - DNA, 167 bp, Homo sapiens
  misc_feature: GYAE6OF01BDXGO.30.25.C03.1.454.CMB.1.raw
  modified_base (166)..(167): a, c, t, g, unknown or other
  misc_feature (166)..(167): n is a, c, g, or t
tcagcacgctacgtcacgaccggtgctcgatttagtagtgtagattggttgggaagaggaagactgacggtcccaggagttcaggtgctgggcacagcggccctgggctgcctggtcaaggactacttccacgtagcgtgctgagcgggctggcaaggcgcatagnn

SEQ ID NO: 205058 - DNA, 227 bp, Homo sapiens
  misc_feature: GYAE6OF01ESHJR.30.25.C03.1.454.CMB.1.raw
  modified_base (227)..(227): a, c, t, g, unknown or other
  misc_feature (227)..(227): n is a, c, g, or t
tcagcacgctacgtcacgaccggtgctcgatttagtagtgtagatttgggttgggtgcccaagctgctggagggcacggtcaccgtctcctcagcctccaccaagggcccatcggtcttcccctggcaccctcctccaagagcacctctggggcacagcggccctgggctgcctggtcaaggactacttccacgtagcgtgctgagcgggctggcaaggcgcatagn

SEQ ID NO: 205059 - DNA, 156 bp, Homo sapiens
  misc_feature: GYAE6OF01B90R6.30.25.C03.1.454.CMB.1.raw
  modified_base (150)..(156): a, c, t, g, unknown or other
  misc_feature (150)..(156): n is a, c, g, or t
tcagcacgctacgtcacgaccggtgctcgatttagtagtgtagatttgggtttgggaagaggaagactgacggtcctgccacagcggcctggctgcctggtcaaggactacttccacgtagcgtgctgagcggctggcaaggcgcatagnnnnnnn

SEQ ID NO: 205060 - DNA, 154 bp, Homo sapiens
  misc_feature: GYAE6OF01DOIYC.30.25.C03.1.454.CMB.1.raw
  modified_base (154)..(154): a, c, t, g, unknown or other
  misc_feature (154)..(154): n is a, c, g, or t
tcagcacgctacgtcacgaccggtgctcgatttagtagtgtagatttgggtttggggaagaggaagactgacggtcctgccacagcggccctgggctgcctggtcaaggactacttccacgtagcgtgctgagcgggctggcaaggcgcatagn

SEQ ID NO: 205061 - DNA, 231 bp, Homo sapiens
  misc_feature: GYAE6OF01C09XI.30.25.C03.1.454.CMB.1.raw
  modified_base (228)..(231): a, c, t, g, unknown or other
  misc_feature (228)..(231): n is a, c, g, or t
tcagcacgctacgtcacgaccggtgctcgatttagtagtgtagatttgggtttgggtgcccaagctgctggagggcacggtcaccgtctcctcagcctccaccaagggcccatcggtcttcccctggcaccctcctccaagagcacctctggggcacagcggccctgggctgcctggtcaaggactacttccacgtagcgtgctgagcgggctggcaaggcgcatagnnnn

SEQ ID NO: 205062 - DNA, 173 bp, Homo sapiens
  misc_feature: GYAE6OF01EC75L.30.25.C03.1.454.CMB.1.raw
  modified_base (172)..(173): a, c, t, g, unknown or other
  misc_feature (172)..(173): n is a, c, g, or t
tcagcacgctacgtcacgaccggtgctcgatttagtagtgtagatttgggtttggggaagaggaagactgacggtccccaggagttcaggtgctgggcacagcggccctgggcctgcctggtcaaggactacttccacgtagcgtgctgagcgggctggcaaggcgcatagnn

SEQ ID NO: 205063 - DNA, 232 bp, Homo sapiens
  misc_feature: GYAE6OF01D7SQA.30.25.C03.1.454.CMB.1.raw
  modified_base (230)..(232): a, c, t, g, unknown or other
  misc_feature (230)..(232): n is a, c, g, or t
tcagcacgctacgtcacgaccggtgctcgatttagtagtgtagatttgggtttgggtgcccaagctgctggagggcacggtcaccgtctcctcagcctccaccaagggcccatcggtcttccccctggcaccctcctccaagagcacctctgggggcacagcggccctgggctgcctggtcaaggactacttccacgtagcgtgctgagcgggctggcaaggcgcatagnnn

SEQ ID NO: 205064 - DNA, 230 bp, Homo sapiens
  misc_feature: GYAE6OF01BNOT7.30.25.C03.1.454.CMB.1.raw
  modified_base (228)..(230): a, c, t, g, unknown or other
  misc_feature (228)..(230): n is a, c, g, or t
tcagcacgctacgtcacgaccggtgctcgatttagtagtgtagatttgggtttgggtgcccaagctgctggagggcacggtcaccgtctcctcagcctccaccaagggcccatcggtcttcccctggcaccctcctccaagagcacctctggggcacagcggccctgggctgcctggtcaaggactacttccacgtagcgtgctgagcgggctggcaaggcgcatagnnn

SEQ ID NO: 205065 - DNA, 174 bp, Homo sapiens
  misc_feature: GYAE6OF01AEZMH.30.25.C03.1.454.CMB.1.raw
  modified_base (174)..(174): a, c, t, g, unknown or other
  misc_feature (174)..(174): n is a, c, g, or t
tcagcacgctacgtcacgaccggtgctcgatttagtagtgtagatttgggtttgggggaagaggaagactgacggtacccccaggagttcaggtgctgggcacagcggccctgggctgcctggtcaaggactacttccacgtagcgtgctgagcgggctggcaaggcgcatagn

SEQ ID NO: 205066 - DNA, 254 bp, Homo sapiens
  misc_feature: GYAE6OF01CIZ75.30.25.C03.1.454.CMB.1.raw
  modified_base (230)..(254): a, c, t, g, unknown or other
  misc_feature (230)..(254): n is a, c, g, or t
tcagcacgctacgtcacgaccggtgctcgatttagtagtgtagatttgggtttgggtgcccaaaggctgctggagggcacggtcaccgtctcctcagcctccaccaagggcccatcggtcttcccctggcaccctcctccaagagcacctctggggcacagcggccctgggctgcctggtcaaggactacttccacgtagcgtgctgagcgggctggcaaggcgcatagnnnnnnnnnnnnnnnnnnnnnnnnn

SEQ ID NO: 205067 - DNA, 188 bp, Homo sapiens
  misc_feature: GYAE6OF01CDUIH.30.25.C03.1.454.CMB.1.raw
  modified_base (156)..(188): a, c, t, g, unknown or other
  misc_feature (156)..(188): n is a, c, g, or t
tcagcacgctacgtcacgaccggtgctcgatttagtagtgtagatttgggtttgggggaagaggaagactgacggtcctgccacagcggccctgggctgcctggtcaaggactacttccacgtagcgtgctgagcgggctggcaaggcgcatacgnnnnnnnnnnnnnnnnnnnnnnnnnnnnnnnnn

SEQ ID NO: 205068 - DNA, 152 bp, Homo sapiens
  misc_feature: GYAE6OF01DDKNS.30.25.C03.1.454.CMB.1.raw
  modified_base (149)..(152): a, c, t, g, unknown or other
  misc_feature (149)..(152): n is a, c, g, or t
tcagcacgctacgtcacgaccggtgctcgattagtagtgtagattggtttgggaagaggaagactgacggtcctgccacagcggcctgggctgcctggtcaaggactacttccacgtagcgtgctgagcgggctggcaaggcgcatagnnnn

SEQ ID NO: 205069 - DNA, 151 bp, Homo sapiens; identical to SEQ ID NO: 205047
  misc_feature: GYAE6OF01D73YU.30.25.C03.1.454.CMB.1.raw
  modified_base (151)..(151): a, c, t, g, unknown or other
  misc_feature (151)..(151): n is a, c, g, or t

SEQ ID NO: 205070 - DNA, 161 bp, Homo sapiens
  misc_feature: GYAE6OF01AEPUI.30.25.C03.1.454.CMB.1.raw
  modified_base (155)..(161): a, c, t, g, unknown or other
  misc_feature (155)..(161): n is a, c, g, or t
tcagcacgctacgtcacgaccggtgctcgatttagtagtgtagatttgggtttgggggaagaggaagactgacggtcctgccacagcggccctgggctgcctggtcaaggactacttccacgtagcgtgctgagcgggctggcaaggcgcatagnnnnnnn

SEQ ID NO: 205071 - DNA, 230 bp, Homo sapiens
  misc_feature: GYAE6OF01BXO52.30.25.C03.1.454.CMB.1.raw
  modified_base (229)..(230): a, c, t, g, unknown or other
  misc_feature (229)..(230): n is a, c, g, or t
tcagcacgctacgtcacgaccggtgctcgatttagtagtgtagatttgggtttgggtgcccaagctgctggagggcacggtcaccgtctcctcagcctccaccaagggcccatcggtcttcccctggcaccctcctccaagagcacctctgggggcacagcggccctgggctgcctggtcaaggactacttccacgtagcgtgctgagcgggctggcaaggcgcatagnn

SEQ ID NO: 205072 - DNA, 154 bp, Homo sapiens; identical to SEQ ID NO: 205060
  misc_feature: GYAE6OF01DTMFQ.30.25.C03.1.454.CMB.1.raw
  modified_base (154)..(154): a, c, t, g, unknown or other
  misc_feature (154)..(154): n is a, c, g, or t

SEQ ID NO: 205073 - DNA, 153 bp, Homo sapiens; identical to SEQ ID NO: 205043
  misc_feature: GYAE6OF01BXWGB.30.25.C03.1.454.CMB.1.raw
  modified_base (153)..(153): a, c, t, g, unknown or other
  misc_feature (153)..(153): n is a, c, g, or t

SEQ ID NO: 205074 - DNA, 177 bp, Homo sapiens
  misc_feature: GYAE6OF01BLOZI.30.25.C03.1.454.CMB.1.raw
  modified_base (139)..(139): a, c, t, g, unknown or other
  misc_feature (139)..(139): n is a, c, g, or t
  modified_base (155)..(177): a, c, t, g, unknown or other
  misc_feature (155)..(177): n is a, c, g, or t
tcagcacgctacgtcacgaccggtgctcgatttagtagtgtagattgggttgggggaagaggaagactgacggtcctgccacagcggccctgggctgcctggtccaaggacctacttccacgtagcgtgctgagcgggntggcaaggcgcatagnnnnnnnnnnnnnnnnnnnnnnn

SEQ ID NO: 205075 - DNA, 228 bp, Homo sapiens
  misc_feature: GYAE6OF01CY83W.30.25.C03.1.454.CMB.1.raw
  modified_base (227)..(228): a, c, t, g, unknown or other
  misc_feature (227)..(228): n is a, c, g, or t
tcagcacgctacgtcacgaccggtgctcgatttagtagtgtagatttggttgggtgcccaagctgctggagggcacggtcaccgtctcctcagcctccaccaagggcccatcggtcttccccctggcaccctcctccaagagcacctctggggcacagcggccctgggctgcctggtcaaggactacttccacgtagcgtgctgagcgggctggcaaggcgcatagnn

SEQ ID NO: 205076 - DNA, 155 bp, Homo sapiens
  misc_feature: GYAE6OF01DSCZ6.30.25.C03.1.454.CMB.1.raw
  modified_base (155)..(155): a, c, t, g, unknown or other
  misc_feature (155)..(155): n is a, c, g, or t
tcagcacgctacgtcacgaccggtgctcgatttagtagtgtagatttgggtttgggggaagaggaagactgacggtcctgccacagcggccctgggctgcctggtcaaggactacttccacgtagcgtgctgagcgggctggcaaggcgcatagn

SEQ ID NO: 205077 - DNA, 174 bp, Homo sapiens
  misc_feature: GYAE6OF01AV9WV.30.25.C03.1.454.CMB.1.raw
  modified_base (173)..(174): a, c, t, g, unknown or other
  misc_feature (173)..(174): n is a, c, g, or t
tcagcacgctacgtcacgaccggtgctcgatttagtagtgtagatttgggtttgggggaagaggaagactgacggtcccccaggagttcaggtgctgggcacagcggccctgggctgcctggtcaaggactacttccacgtagcgtgctgagcgggctggcaaggcgcatagnn

SEQ ID NO: 205078 - DNA, 180 bp, Homo sapiens
  misc_feature: GYAE6OF01A445H.30.25.C03.1.454.CMB.1.raw
  modified_base (172)..(180): a, c, t, g, unknown or other
  misc_feature (172)..(180): n is a, c, g, or t
tcagcacgctacgtcacgaccggtgctcgatttagtagtgtagatttgggtttggggaagaggaagacgtgacggtccccaggagttcaggtgctgggcacagcggccctgggctgcctggtcaaggactacttccacgtagcgtgctgagcgggctggcaaggcgcatagnnnnnnnnn

SEQ ID NO: 205079 - DNA, 229 bp, Homo sapiens; identical to SEQ ID NO: 205049
  misc_feature: GYAE6OF01DKIES.30.25.C03.1.454.CMB.1.raw
  modified_base (228)..(229): a, c, t, g, unknown or other
  misc_feature (228)..(229): n is a, c, g, or t

SEQ ID NO: 205080 - DNA, 197 bp, Homo sapiens
  misc_feature: GYAE6OF01CCOJN.30.25.C03.1.454.CMB.1.raw
  modified_base (175)..(197): a, c, t, g, unknown or other
  misc_feature (175)..(197): n is a, c, g, or t
tcagcacgctacgtcacgaccggtgctcgatttagtagtgtagatttgggtttgggggaagaggaagactgacggtcccccaggagttcaggtgctgggcacagcggccctgggctagcctggtcaaggactacttaccacgtagcgtgctgagcgggctggcaaggcgcatagnnnnnnnnnnnnnnnnnnnnnnn

SEQ ID NO: 205081 - DNA, 184 bp, Homo sapiens
  misc_feature: GYAE6OF01AY0GN.30.25.C03.1.454.CMB.1.raw
  modified_base (154)..(184): a, c, t, g, unknown or other
  misc_feature (154)..(184): n is a, c, g, or t
tcagcacgctacgtcacgaccggtgctcgatttagtagtgtagatttgggttggggaagaggaagactgacggtcctgccacagcggccctgggctgcctggtcaaggactacttccacgtagcgtgctgagcgggctggcaaggcgcatagcnnnnnnnnnnnnnnnnnnnnnnnnnnnnnnn

SEQ ID NO: 205082 - DNA, 243 bp, Homo sapiens
  misc_feature: GYAE6OF01E024Y.30.25.C03.1.454.CMB.1.raw
  modified_base (231)..(243): a, c, t, g, unknown or other
  misc_feature (231)..(243): n is a, c, g, or t
tcagcacgctacgtcacgaccggtgctcgatttagtagtgtagatttgggttgggtgacccaagcctgctggagggccacggtcaccgtctcctcagcctccaccaagggcccatcggtcttcccctggcaccctcctccaagagcacctctgggggcacagcggccctgggctgcctggtcaaggactacttccacgtagcgtgctgagcgggctggcaaggcgcatagnnnnnnnnnnnnn

SEQ ID NO: 205083 - DNA, 174 bp, Homo sapiens; identical to SEQ ID NO: 205077
  misc_feature: GYAE6OF01CILVQ.30.25.C03.1.454.CMB.1.raw
  modified_base (173)..(174): a, c, t, g, unknown or other
  misc_feature (173)..(174): n is a, c, g, or t

SEQ ID NO: 205084 - DNA, 173 bp, Homo sapiens
  misc_feature: GYAE6OF01C7V7A.30.25.C03.1.454.CMB.1.raw
  modified_base (173)..(173): a, c, t, g, unknown or other
  misc_feature (173)..(173): n is a, c, g, or t
tcagcacgctacgtcacgaccggtgctcgatttagtagtgtagatttgggtttgggggaagaggaagactgacggtcccccaggagttcaggtgctgggcacagcggccctgggctgcctggtcaaggactacttccacgtagcgtgctgagcgggctggcaaggcgcatagn

SEQ ID NO: 205085 - DNA, 232 bp, Homo sapiens
  misc_feature: GYAE6OF01ETK17.30.25.C03.1.454.CMB.1.raw
  modified_base (229)..(232): a, c, t, g, unknown or other
  misc_feature (229)..(232): n is a, c, g, or t
tcagcacgctacgtcacgaccggtgctcgatttagtagtgtagatttgggtttgggtgcccaagctgctggagggcacggtcaccgtctcctcagcctccaccaagggcccatcggtcttcccctggcaccctcctccaagagcacctctgggggcacagcggccctgggctgcctggtcaaggactacttccacgtagcgtgctgagcgggctggcaaggcgcatagnnnn

SEQ ID NO: 205086 - DNA, 231 bp, Homo sapiens; identical to SEQ ID NO: 205061
  misc_feature: GYAE6OF01C7LLT.30.25.C03.1.454.CMB.1.raw
  modified_base (228)..(231): a, c, t, g, unknown or other
  misc_feature (228)..(231): n is a, c, g, or t

SEQ ID NO: 205087 - DNA, 227 bp, Homo sapiens
  misc_feature: GYAE6OF01EVNDA.30.25.C03.1.454.CMB.1.raw
  modified_base (226)..(227): a, c, t, g, unknown or other
  misc_feature (226)..(227): n is a, c, g, or t
tcagcacgctacgtcacgaccggtgctcgatttagtagtgtagatttgggttggtgcccaagctgctggagggcacggtcaccgtctcctcagcctccaccaagggcccatcggtcttcccctggcaccctcctccaagagtacctctggggcacagcggccctgggctgcctggtcaaggactacttccacgtagcgtgctgagcgggctggcaaggcgcatagnn

SEQ ID NO: 205088 - DNA, 265 bp, Homo sapiens
  misc_feature: GYAE6OF01C2X7O.30.25.C03.1.454.CMB.1.raw
  modified_base (231)..(265): a, c, t, g, unknown or other
  misc_feature (231)..(265): n is a, c, g, or t
tcagcacgctacgtcacgaccggtgctcgatttagtagtgtagatttgggtttgggtggcccaagctgctggagggcacggtcaccgtctccgtcacgcctccaccaagggcccatcggtcttcccctggcacctctccagagcacctctggggcacagcggccctgggctgcctggtcaaggactacttccacgtagcgttgctgagcgggctggccaaggcgcataggnnnnnnnnnnnnnnnnnnnnnnnnnnnnnnnnnnn

SEQ ID NO: 205089 - DNA, 230 bp, Homo sapiens; identical to SEQ ID NO: 205064
  misc_feature: GYAE6OF01DFEJ3.30.25.C03.1.454.CMB.1.raw
  modified_base (228)..(230): a, c, t, g, unknown or other
  misc_feature (228)..(230): n is a, c, g, or t

SEQ ID NO: 205090 - DNA, 173 bp, Homo sapiens; identical to SEQ ID NO: 205084
  misc_feature: GYAE6OF01CZDJR.30.25.C03.1.454.CMB.1.raw
  modified_base (173)..(173): a, c, t, g, unknown or other
  misc_feature (173)..(173): n is a, c, g, or t

SEQ ID NO: 205091 - DNA, 154 bp, Homo sapiens; identical to SEQ ID NO: 205060
  misc_feature: GYAE6OF01C7GMY.30.25.C03.1.454.CMB.1.raw
  modified_base (154)..(154): a, c, t, g, unknown or other
  misc_feature (154)..(154): n is a, c, g, or t

SEQ ID NO: 205092 - DNA, 294 bp, Homo sapiens
  misc_feature: GYAE6OF01B81ZL.30.25.C03.1.454.CMB.1.raw
  modified_base (237)..(237): a, c, t, g, unknown or other
  misc_feature (237)..(237): n is a, c, g, or t
  modified_base (239)..(251): a, c, t, g, unknown or other
  misc_feature (239)..(251): n is a, c, g, or t
  modified_base (254)..(294): a, c, t, g, unknown or other
  misc_feature (254)..(294): n is a, c, g, or t
tcagcacgctacgtcacgaccggtgctcgatttagtagtgtagatttgggtttgggtggcccaagctcgctggaggggcacggtcaccgtctcctcagccgtcccaccaagggcccatccggtcgttccccctggcaccctcctccaagagcacctctggggcacagcggccctgggctgcctggtccaaggactacttccatgtagcgtgctgagcgggctggcaaggcgcatagngnnnnnnnnnnnnnagnnnnnnnnnnnnnnnnnnnnnnnnnnnnnnnnnnnnnnnnn

SEQ ID NO: 205093 - DNA, 178 bp, Homo sapiens
  misc_feature: GYAE6OF01C2FVI.30.25.C03.1.454.CMB.1.raw
  modified_base (173)..(178): a, c, t, g, unknown or other
  misc_feature (173)..(178): n is a, c, g, or t
tcagcacgctacgtcacgaccggtgctcgatttagtagtgtagatttgggtttgggggaagaggaagactgacggtcccccaggagttcaggtgctgggcacagcggccctgggctgcctggtcaaggactacttccacgtagcgtgctgagcgggctggcaaggcgcatagnnnnnn

SEQ ID NO: 205094 - DNA, 156 bp, Homo sapiens
  misc_feature: GYAE6OF01CNV4G.30.25.C03.1.454.CMB.1.raw
  modified_base (155)..(156): a, c, t, g, unknown or other
  misc_feature (155)..(156): n is a, c, g, or t
tcagcacgctacgtcacgaccggtgctcgatttagtagtgtagatttgggtttgggggaagaggaagactgacggtcctgccacagcggccctgggctgcctggtcaaggactacttccacgtagcgtgctgagcgggctggcaaggcgcatagnn

SEQ ID NO: 205095 - DNA, 230 bp, Homo sapiens
  misc_feature: GYAE6OF01AC5FZ.30.25.C03.1.454.CMB.1.raw
  modified_base (230)..(230): a, c, t, g, unknown or other
  misc_feature (230)..(230): n is a, c, g, or t
tcagcacgctacgtcacgaccggtgctcgatttagtagtgtagatttgggtttgggtgcccaagctgctggagggcacggtcaccgtctcctcagcctccaccaagggcccatcggtcttccccctggcaccctcctccaagagcacctctgggggcacagcggccctgggctgcctggtcaaggactacttccacgtagcgtgctgagcgggctggcaaggcgcatagn

SEQ ID NO: 205096 - DNA, 173 bp, Homo sapiens
  misc_feature: GYAE6OF01CWXH6.30.25.C03.1.454.CMB.1.raw
  modified_base (171)..(173): a, c, t, g, unknown or other
  misc_feature (171)..(173): n is a, c, g, or t
tcagcacgctacgtcacgaccggtgctcgatttagtagtgtagatttgggttggggaagaggaagactgacggtcccccaggagttcaggtgctgggcacagcggccctgggctgcctggtcaaggactacttccacgtagcgtgctgagcgggctggcaaggcgcatagnnn

SEQ ID NO: 205097 - DNA, 295 bp, Homo sapiens
  misc_feature: GYAE6OF01B5J2X.30.25.C03.1.454.CMB.1.raw
  modified_base (237)..(295): a, c, t, g, unknown or other
  misc_feature (237)..(295): n is a, c, g, or t
tcagcacgctacgtcacgaccggtgctcgatttagtagtgtagatttgggtttgggtgcccgaagctgctggagggcacggtcaccgtctcctcagcctccaccaagggcccactcggtcttccccctggccaccctccgtccaagagcacctctggggcacagcggccctgggctggcctggtcaaggactacttccacgtagccgtgctgagcgggctggcaacggcgcatacgnnnnnnnnnnnnnnnnnnnnnnnnnnnnnnnnnnnnnnnnnnnnnnnnnnnnnnnnnnn

SEQ ID NO: 205098 - DNA, 243 bp, Homo sapiens
  misc_feature: GYAE6OF01ATUU3.30.25.C03.1.454.CMB.1.raw
  modified_base (230)..(243): a, c, t, g, unknown or other
  misc_feature (230)..(243): n is a, c, g, or t
tcagcacgctacgtcacgaccggtgctcgatttagtagtgtagatttgggtttgggtgcccaagctgctggagggcacggtcaccgtctcctcagcctccaccaagggcccatcggtcttccccctggcaccctccgtccaagagcacctctggggcacagcggccctgggctgcctggtcaaggactacttccacgtagcgtgctgagcgggctggcaaggcgcatagnnnnnnnnnnnnnn

SEQ ID NO: 205099 - DNA, 252 bp, Homo sapiens
  misc_feature: GYAE6OF01E22X6.30.25.C03.1.454.CMB.1.raw
  modified_base (237)..(252): a, c, t, g, unknown or other
  misc_feature (237)..(252): n is a, c, g, or t
tcagcacgctacgtcacgaccggtgctcgatttagtagtgtagatttgggtttgggtgcccaaggctgctggagggcacggtcaccgtctccttcagccttccacctaagggcccatcggtcttccccctggcaccctcctccaagagcacctctgggggcacagcggccctgggcttgcctggtcaaggtactacttccacgtagcgtgctgagcgggctggcaaggcggcatagnnnnnnnnnnnnnnnn

SEQ ID NO: 205100 - DNA, 174 bp, Homo sapiens; identical to SEQ ID NO: 205077
  misc_feature: GYAE6OF01CQINQ.30.25.C03.1.454.CMB.1.raw
  modified_base (173)..(174): a, c, t, g, unknown or other
  misc_feature (173)..(174): n is a, c, g, or t

SEQ ID NO: 205101 - DNA, 247 bp, Homo sapiens
  misc_feature: GYAE6OF01DIXEG.30.25.C03.1.454.CMB.1.raw
  modified_base (231)..(247): a, c, t, g, unknown or other
  misc_feature (231)..(247): n is a, c, g, or t
tcagcacgctacgtcacgaccggtgctcgatttagtagtgtagatttgggtttgggtgcccaagctgctggagggcacggtcaccgtctccctcagcctccaccaagggcccatcggtcttccccctggcaccctcctccaagagcacctctggggcacagcggccctgggctgcctggtcaaggactacttccacgtagcgtgctgagcgggctggccaaggcgcatagnnnnnnnnnnnnnnnnn

SEQ ID NO: 205102 - DNA, 175 bp, Homo sapiens
  misc_feature: GYAE6OF01DONR7.30.25.C03.1.454.CMB.1.raw
  modified_base (173)..(175): a, c, t, g, unknown or other
  misc_feature (173)..(175): n is a, c, g, or t
tcagcacgctacgtcacgaccggtgctcgatttagtagtgtagatttgggtttgggggaagaggaagactgacggtcccccaggagttcaggtgctgggcacagcggccctgggctgcctggtcaaggactacttccacgtagcgtgctgagcgggctggcaaggcgcatagnnn

SEQ ID NO: 205103 - DNA, 171 bp, Homo sapiens; identical to SEQ ID NO: 205048
  misc_feature: GYAE6OF01DOLAF.30.25.C03.1.454.CMB.1.raw
  modified_base (171)..(171): a, c, t, g, unknown or other
  misc_feature (171)..(171): n is a, c, g, or t

SEQ ID NO: 205104 - DNA, 174 bp, Homo sapiens; identical to SEQ ID NO: 205077
  misc_feature: GYAE6OF01C0T74.30.25.C03.1.454.CMB.1.raw
  modified_base (173)..(174): a, c, t, g, unknown or other
  misc_feature (173)..(174): n is a, c, g, or t

SEQ ID NO: 205105 - DNA, 154 bp, Homo sapiens; identical to SEQ ID NO: 205060
  misc_feature: GYAE6OF01BX842.30.25.C03.1.454.CMB.1.raw
  modified_base (154)..(154): a, c, t, g, unknown or other
  misc_feature (154)..(154): n is a, c, g, or t

SEQ ID NO: 205106 - DNA, 213 bp, Homo sapiens
  misc_feature: GYAE6OF01A1POD.30.25.C03.1.454.CMB.1.raw
  modified_base (173)..(213): a, c, t, g, unknown or other
  misc_feature (173)..(213): n is a, c, g, or t
tcagcacgctacgtcacgaccggtgctcgatttagtagtgtagatttgggtttgggggaagaggaagactgacggtcccccaggagttcaggtgctgggcacagcggccctgggctgcctggtcaaggactacttccacgtagcgtgctgagcgggctggcaaggcgcatagnnnnnnnnnnnnnnnnnnnnnnnnnnnnnnnnnnnnnnnnn

SEQ ID NO: 205107 - DNA, 230 bp, Homo sapiens; identical to SEQ ID NO: 205064
  misc_feature: GYAE6OF01EBPZ1.30.25.C03.1.454.CMB.1.raw
  modified_base (228)..(230): a, c, t, g, unknown or other
  misc_feature (228)..(230): n is a, c, g, or t

SEQ ID NO: 205108 - DNA, 211 bp, Homo sapiens
  misc_feature: GYAE6OF01AHVCU.30.25.C03.1.454.CMB.1.raw
  modified_base (175)..(175): a, c, t, g, unknown or other
  misc_feature (175)..(175): n is a, c, g, or t
  modified_base (177)..(211): a, c, t, g, unknown or other
  misc_feature (177)..(211): n is a, c, g, or t
tcagcacgctacgtcacgaccggtgctcgatttagtagtgtagatttgggttggggggaagaggaagactcgacggtcccccaggagttcaggtgctgggcacagccggccctgggctgcctggtcaaggactacttccacgtagcgtgctgagcgggctggcaaggcgcatagncnnnnnnnnnnnnnnnnnnnnnnnnnnnnnnnnnnn

SEQ ID NO: 205109 - DNA, 240 bp, Homo sapiens
  misc_feature: GYAE6OF01BPPS6.30.25.C03.1.454.CMB.1.raw
  modified_base (230)..(240): a, c, t, g, unknown or other
  misc_feature (230)..(240): n is a, c, g, or t
tcagcacgctacgtcacgaccggtgctcgatttagtagtgtagatttgggtttgggtgcccaagctgctggagggcacggtcaccgtctcctcagcctccaccaagggcccatcggtcttccccctggcaccctcctccaagagcacctctgggggcacagcggccctgggctgcctggtcaaggactacttccacgtagcgtgctgagcgggctggcaaggcgcatagnnnnnnnnnnn

SEQ ID NO: 205110 - DNA, 173 bp, Homo sapiens; identical to SEQ ID NO: 205084
  misc_feature: GYAE6OF01BQRW7.30.25.C03.1.454.CMB.1.raw
  modified_base (173)..(173): a, c, t, g, unknown or other
  misc_feature (173)..(173): n is a, c, g, or t

SEQ ID NO: 205111 - DNA, 155 bp, Homo sapiens; identical to SEQ ID NO: 205076
  misc_feature: GYAE6OF01B0LP3.30.25.C03.1.454.CMB.1.raw
  modified_base (155)..(155): a, c, t, g, unknown or other
  misc_feature (155)..(155): n is a, c, g, or t

SEQ ID NO: 205112 - DNA, 155 bp, Homo sapiens; identical to SEQ ID NO: 205076
  misc_feature: GYAE6OF01EFGCP.30.25.C03.1.454.CMB.1.raw
  modified_base (155)..(155): a, c, t, g, unknown or other
  misc_feature (155)..(155): n is a, c, g, or t

SEQ ID NO: 205113 - DNA, 232 bp, Homo sapiens; identical to SEQ ID NO: 205085
  misc_feature: GYAE6OF01CBFVO.30.25.C03.1.454.CMB.1.raw
  modified_base (229)..(232): a, c, t, g, unknown or other
  misc_feature (229)..(232): n is a, c, g, or t

SEQ ID NO: 205114 - DNA, 157 bp, Homo sapiens
  misc_feature: GYAE6OF01EARIB.30.25.C03.1.454.CMB.1.raw
  modified_base (155)..(157): a, c, t, g, unknown or other
  misc_feature (155)..(157): n is a, c, g, or t
tcagcacgctacgtcacgaccggtgctcgatttagtagtgtagatttgggtttgggggaagaggaagactgacggtcctgccacagcggccctgggctgcctggtcaaggactacttccacgtagcgtgctgagcgggctggcaaggcgcatagnnn

SEQ ID NO: 205115 - DNA, 182 bp, Homo sapiens
  misc_feature: GYAE6OF01BEOU5.30.25.C03.1.454.CMB.1.raw
  modified_base (157)..(182): a, c, t, g, unknown or other
  misc_feature (157)..(182): n is a, c, g, or t
tcagcacgctacgtcacgaccggtgctcgatttagtagtgtagatttgggttgggggaagaggaagactgacggtcctgccacagcggccctgggctgccgtcggtcaaggactacttccacggtagcgtgctgagcgggctggcaaggcgcatagnnnnnnnnnnnnnnnnnnnnnnnnnn

SEQ ID NO: 205116 - DNA, 154 bp, Homo sapiens; identical to SEQ ID NO: 205060
  misc_feature: GYAE6OF01CR1T7.30.25.C03.1.454.CMB.1.raw
  modified_base (154)..(154): a, c, t, g, unknown or other
  misc_feature (154)..(154): n is a, c, g, or t

SEQ ID NO: 205117 - DNA, 231 bp, Homo sapiens; identical to SEQ ID NO: 205061
  misc_feature: GYAE6OF01CLKJ6.30.25.C03.1.454.CMB.1.raw
  modified_base (228)..(231): a, c, t, g, unknown or other
  misc_feature (228)..(231): n is a, c, g, or t

SEQ ID NO: 205118 - DNA, 230 bp, Homo sapiens; identical to SEQ ID NO: 205064
  misc_feature: GYAE6OF01BP392.30.25.C03.1.454.CMB.1.raw
  modified_base (228)..(230): a, c, t, g, unknown or other
  misc_feature (228)..(230): n is a, c, g, or t

SEQ ID NO: 205119 - DNA, 173 bp, Homo sapiens; identical to SEQ ID NO: 205084
  misc_feature: GYAE6OF01DKR13.30.25.C03.1.454.CMB.1.raw
  modified_base (173)..(173): a, c, t, g, unknown or other
  misc_feature (173)..(173): n is a, c, g, or t

SEQ ID NO: 205120 - DNA, 231 bp, Homo sapiens
  misc_feature: GYAE6OF01AJP7Z.30.25.C03.1.454.CMB.1.raw
  modified_base (230)..(231): a, c, t, g, unknown or other
  misc_feature (230)..(231): n is a, c, g, or t
tcagcacgctacgtcacgaccggtgctcgatttagtagtgtagatttgggtttgggtgcccaagctgctggagggcacggtcaccgtctcctcagcctccaccaagggcccatcggtcttccccctggcaccctcctccaagagcacctctgggggcacagcggccctgggctgcctggtcaaggactacttccacgtagcgtgctgagcgggctggcaaggcgcatagnn

SEQ ID NO: 205121 - DNA, 155 bp, Homo sapiens; identical to SEQ ID NO: 205076
  misc_feature: GYAE6OF01CHJXZ.30.25.C03.1.454.CMB.1.raw
  modified_base (155)..(155): a, c, t, g, unknown or other
  misc_feature (155)..(155): n is a, c, g, or t

SEQ ID NO: 205122 - DNA, 153 bp, Homo sapiens; identical to SEQ ID NO: 205055
  misc_feature: GYAE6OF01DEZ9N.30.25.C03.1.454.CMB.1.raw
  modified_base (153)..(153): a, c, t, g, unknown or other
  misc_feature (153)..(153): n is a, c, g, or t

SEQ ID NO: 205123 - DNA, 232 bp, Homo sapiens
  misc_feature: GYAE6OF01BK1BL.30.25.C03.1.454.CMB.1.raw
  modified_base (229)..(232): a, c, t, g, unknown or other
  misc_feature (229)..(232): n is a, c, g, or t
tcagcacgctacgtcacgaccggtgctcgatttagtagtgtagatttgggtttgggtgcccaagctgctggagggcacggtcaccgtctcctcagcctccaccaagggcccatcggtcttccccctggcaccctcctccaagagcacctctggggcacagcggccctgggctgcctggtcaaggactacttccacgtagcgtgctgagcgggctggcaaggcgcatagnnnn

SEQ ID NO: 205124 - DNA, 176 bp, Homo sapiens
  misc_feature: GYAE6OF01EZ7HD.30.25.C03.1.454.CMB.1.raw
  modified_base (173)..(176): a, c, t, g, unknown or other
  misc_feature (173)..(176): n is a, c, g, or t
tcagcacgctacgtcacgaccggtgctcgatttagtagtgtagatttgggtttgggggaagaggaagactgacggtcccccaggagttcaggtgctgggcacagcggccctgggctgcctggtcaaggactacttccacgtagcgtgctgagcgggctggcaaggcgcatagnnnn

SEQ ID NO: 205125 - DNA, 155 bp, Homo sapiens; identical to SEQ ID NO: 205076
  misc_feature: GYAE6OF01B1QLI.30.25.C03.1.454.CMB.1.raw
  modified_base (155)..(155): a, c, t, g, unknown or other
  misc_feature (155)..(155): n is a, c, g, or t

SEQ ID NO: 205126 - DNA, 173 bp, Homo sapiens; identical to SEQ ID NO: 205084
  misc_feature: GYAE6OF01EIBPG.30.25.C03.1.454.CMB.1.raw
  modified_base (173)..(173): a, c, t, g, unknown or other
  misc_feature (173)..(173): n is a, c, g, or t

SEQ ID NO: 205127 - DNA, 230 bp, Homo sapiens; identical to SEQ ID NO: 205095
  misc_feature: GYAE6OF01D9SI8.30.25.C03.1.454.CMB.1.raw
  modified_base (230)..(230): a, c, t, g, unknown or other
  misc_feature (230)..(230): n is a, c, g, or t

SEQ ID NO: 205128 - DNA, 231 bp, Homo sapiens
  misc_feature: GYAE6OF01DPQP9.30.25.C03.1.454.CMB.1.raw
  modified_base (227)..(231): a, c, t, g, unknown or other
  misc_feature (227)..(231): n is a, c, g, or t
tcagcacgctacgtcacgaccggtgctcgatttagtagtgtagatttgggtttgggtgcccaagctgctggagggcacggtcaccgtctcctcagcctccaccaagggcccatcggtcttcccctggcaccctcctccaagagcacctctggggcacagcggcctgggctgcctggtcaaggactacttccacgtagcgtgctgagcgggctggcaaggcgcatagnnnnn

SEQ ID NO: 205129 - DNA, 231 bp, Homo sapiens
  misc_feature: GYAE6OF01DU7X2.30.25.C03.1.454.CMB.1.raw
  modified_base (229)..(231): a, c, t, g, unknown or other
  misc_feature (229)..(231): n is a, c, g, or t
tcagcacgctacgtcacgaccggtgctcgatttagtagtgtagatttgggtttgggtgcccaagctgctggagggcacggtcaccgtctcctcagcctccaccaagggcccatcggtcttccccctggcaccctcctccaagagcacctctggggcacagcggccctgggctgcctggtcaaggactacttccacgtagcgtgctgagcgggctggcaaggcgcatagnnn

SEQ ID NO: 205130 - DNA, 155 bp, Homo sapiens; identical to SEQ ID NO: 205076
  misc_feature: GYAE6OF01EZT79.30.25.C03.1.454.CMB.1.raw
  modified_base (155)..(155): a, c, t, g, unknown or other
  misc_feature (155)..(155): n is a, c, g, or t

SEQ ID NO: 205131 - DNA, 155 bp, Homo sapiens; identical to SEQ ID NO: 205076
  misc_feature: GYAE6OF01ELZRI.30.25.C03.1.454.CMB.1.raw
  modified_base (155)..(155): a, c, t, g, unknown or other
  misc_feature (155)..(155): n is a, c, g, or t

SEQ ID NO: 205132 - DNA, 230 bp, Homo sapiens; identical to SEQ ID NO: 205064
  misc_feature: GYAE6OF01DU4NV.30.25.C03.1.454.CMB.1.raw
  modified_base (228)..(230): a, c, t, g, unknown or other
  misc_feature (228)..(230): n is a, c, g, or t

SEQ ID NO: 205133 - DNA, 157 bp, Homo sapiens
  misc_feature: GYAE6OF01C9SI2.30.25.C03.1.454.CMB.1.raw
  modified_base (154)..(157): a, c, t, g, unknown or other
  misc_feature (154)..(157): n is a, c, g, or t
tcagcacgctacgtcacgaccggtgctcgatttagtagtgtagatttgggtttggggaagaggaagactgacggtcctgccacagcggccctgggctgcctggtcaaggactacttccacgtagcgtgctgagcgggctggcaaggcgcatagnnnn

SEQ ID NO: 205134 - DNA, 155 bp, Homo sapiens; identical to SEQ ID NO: 205076
  misc_feature: GYAE6OF01EO4NW.30.25.C03.1.454.CMB.1.raw
  modified_base (155)..(155): a, c, t, g, unknown or other
  misc_feature (155)..(155): n is a, c, g, or t

SEQ ID NO: 205135 - DNA, 231 bp, Homo sapiens; identical to SEQ ID NO: 205120
  misc_feature: GYAE6OF01A8H5Z.30.25.C03.1.454.CMB.1.raw
  modified_base (230)..(231): a, c, t, g, unknown or other
  misc_feature (230)..(231): n is a, c, g, or t

SEQ ID NO: 205136 - DNA, 229 bp, Homo sapiens
  misc_feature: GYAE6OF01DO5DK.30.25.C03.1.454.CMB.1.raw
  modified_base (229)..(229): a, c, t, g, unknown or other
  misc_feature (229)..(229): n is a, c, g, or t
tcagcacgctacgtcacgaccggtgctcgatttagtagtgtagatttgggtttgggtgcccaagctgctggagggcacggtcaccgtctcctcagcctccaccaagggcccatcggtcttccccctggcaccctcctccaagagcacctctggggcacagcggccctgggctgcctggtcaaggactacttccacgtagcgtgctgagcgggctggcaaggcgcatagn

SEQ ID NO: 205137 - DNA, 235 bp, Homo sapiens
  misc_feature: GYAE6OF01C2S8V.30.25.C03.1.454.CMB.1.raw
  modified_base (226)..(235): a, c, t, g, unknown or other
  misc_feature (226)..(235): n is a, c, g, or t
tcagcacgctacgtcacgaccggtgctcgatttagtagtgtagattgggtttgggtgcccaagctgctggaggcacggtcaccgtctcctcagcctccaccaagggcccatcggtcttcccctggcaccctcctccaagagcacctctggggcacagcggccctgggctgcctggtcaaggactacttccacgtagcgtgctgagcgggctggcaaggcgcatagnnnnnnnnnn

SEQ ID NO: 205138 - DNA, 231 bp, Homo sapiens
  misc_feature: GYAE6OF01BXNPY.30.25.C03.1.454.CMB.1.raw
  modified_base (228)..(231): a, c, t, g, unknown or other
  misc_feature (228)..(231): n is a, c, g, or t
tcagcacgctacgtcacgaccggtgctcgatttagtagtgtagatttgggtttgggtgcccaagctgctggagggcacggtcaccgtctcctcagcctccaccaagggcccatcggtcttcccctggcaccctcctccaagagcacctctggggcacagtggccctgggctgcctggtcaaggactacttccacgtagcgtgctgagcgggctggcaaggcgcatagnnnn

SEQ ID NO: 205139 - DNA, 156 bp, Homo sapiens; identical to SEQ ID NO: 205094
  misc_feature: GYAE6OF01AZ5CY.30.25.C03.1.454.CMB.1.raw
  modified_base (155)..(156): a, c, t, g, unknown or other
  misc_feature (155)..(156): n is a, c, g, or t

SEQ ID NO: 205140 - DNA, 152 bp, Homo sapiens
  misc_feature: GYAE6OF01CWQ4J.30.25.C03.1.454.CMB.1.raw
  modified_base (152)..(152): a, c, t, g, unknown or other
  misc_feature (152)..(152): n is a, c, g, or t
tcagcacgctacgtcacgaccggtgctcgatttagtagtgtagatttgggttgggaagaggaagactgacggtcctgccacagcggccctgggctgcctggtcaaggactacttccacgtagcgtgctgagcgggctggcaaggcgcatagn

SEQ ID NO: 205141 - DNA, 175 bp, Homo sapiens; identical to SEQ ID NO: 205102
  misc_feature: GYAE6OF01CC6IX.30.25.C03.1.454.CMB.1.raw
  modified_base (173)..(175): a, c, t, g, unknown or other
  misc_feature (173)..(175): n is a, c, g, or t

SEQ ID NO: 205142 - DNA, 174 bp, Homo sapiens; identical to SEQ ID NO: 205077
  misc_feature: GYAE6OF01A9L14.30.25.C03.1.454.CMB.1.raw
  modified_base (173)..(174): a, c, t, g, unknown or other
  misc_feature (173)..(174): n is a, c, g, or t

SEQ ID NO: 205143 - DNA, 231 bp, Homo sapiens
  misc_feature: GYAE6OF01D7CAG.30.25.C03.1.454.CMB.1.raw
  modified_base (231)..(231): a, c, t, g, unknown or other
  misc_feature (231)..(231): n is a, c, g, or t
tcagcacgctacgtcacgaccggtgctcgatttagtagtgtagatttgggtttgggtgcccaagctgctggagggcacggtcaccgtctcctcagcctccaccaagggcccatcggtcttccccctggcaccctcctccaagagcacctctgggggcacagcggccctgggctgcctggtcaaggactaccttccacgtagcgtgctgagcgggctggcaaggcgcatagn

SEQ ID NO: 205144 - DNA, 241 bp, Homo sapiens
  misc_feature: GYAE6OF01BR1X7.30.25.C03.1.454.CMB.1.raw
  modified_base (179)..(186): a, c, t, g, unknown or other
  misc_feature (179)..(186): n is a, c, g, or t
  modified_base (188)..(241): a, c, t, g, unknown or other
  misc_feature (188)..(241): n is a, c, g, or t
tcagcacgctacgtcacgaccggtgctcgatttagtagtgtagatttgggtttgggggaagagggaacgactgacggtccccccaggagttcaggtgctgggcacagcggccctgggctgcctgggtcaaggactacttccacgtagcgtgactgagcgggctgggcaaggcgcatagnnnnnnnncnnnnnnnnnnnnnnnnnnnnnnnnnnnnnnnnnnnnnnnnnnnnnnnnnnnnnn

SEQ ID NO: 205145 - DNA, 174 bp, Homo sapiens; identical to SEQ ID NO: 205077
  misc_feature: GYAE6OF01DARLD.30.25.C03.1.454.CMB.1.raw
  modified_base (173)..(174): a, c, t, g, unknown or other
  misc_feature (173)..(174): n is a, c, g, or t

SEQ ID NO: 205146 - DNA, 173 bp, Homo sapiens; identical to SEQ ID NO: 205084
  misc_feature: GYAE6OF01DCRQF.30.25.C03.1.454.CMB.1.raw
  modified_base (173)..(173): a, c, t, g, unknown or other
  misc_feature (173)..(173): n is a, c, g, or t

SEQ ID NO: 205147 - DNA, 215 bp, Homo sapiens
  misc_feature: GYAE6OF01EGQOB.30.25.C03.1.454.CMB.1.raw
  modified_base (178)..(215): a, c, t, g, unknown or other
  misc_feature (178)..(215): n is a, c, g, or t
tcagcacgctacgtcacgaccggtgctcgatttagtagtgtagatttgggttgggggaagagggaagaccgtgacggtcccccaggacgttcaggtgctgggcacagcggcccttgggctgcctggtcaaggactacgttccacgtagcgtgctgagcgggctggcaaggcgcatagnnnnnnnnnnnnnnnnnnnnnnnnnnnnnnnnnnnnnn

SEQ ID NO: 205148 - DNA, 173 bp, Homo sapiens; identical to SEQ ID NO: 205084
  misc_feature: GYAE6OF01EJZPM.30.25.C03.1.454.CMB.1.raw
  modified_base (173)..(173): a, c, t, g, unknown or other
  misc_feature (173)..(173): n is a, c, g, or t

SEQ ID NO: 205149 - DNA, 155 bp, Homo sapiens; identical to SEQ ID NO: 205076
  misc_feature: GYAE6OF01BV6HT.30.25.C03.1.454.CMB.1.raw
  modified_base (155)..(155): a, c, t, g, unknown or other
  misc_feature (155)..(155): n is a, c, g, or t

SEQ ID NO: 205150 - DNA, 173 bp, Homo sapiens; identical to SEQ ID NO: 205084
  misc_feature: GYAE6OF01EJTCN.30.25.C03.1.454.CMB.1.raw
  modified_base (173)..(173): a, c, t, g, unknown or other
  misc_feature (173)..(173): n is a, c, g, or t

SEQ ID NO: 205151 - DNA, 173 bp, Homo sapiens; identical to SEQ ID NO: 205084
  misc_feature: GYAE6OF01BN4XB.30.25.C03.1.454.CMB.1.raw
  modified_base (173)..(173): a, c, t, g, unknown or other
  misc_feature (173)..(173): n is a, c, g, or t

SEQ ID NO: 205152 - DNA, 232 bp, Homo sapiens; identical to SEQ ID NO: 205063
  misc_feature: GYAE6OF01D946M.30.25.C03.1.454.CMB.1.raw
  modified_base (230)..(232): a, c, t, g, unknown or other
  misc_feature (230)..(232): n is a, c, g, or t

SEQ ID NO: 205153 - DNA, 158 bp, Homo sapiens
  misc_feature: GYAE6OF01ECRRC.30.25.C03.1.454.CMB.1.raw
  modified_base (155)..(158): a, c, t, g, unknown or other
  misc_feature (155)..(158): n is a, c, g, or t
tcagcacgctacgtcacgaccggtgctcgatttagtagtgtagatttgggtttgggggaagaggaagactgacggtcctgccacagcggccctgggctgcctggtcaaggactacttccacgtagcgtgctgagcgggctggcaaggcgcatagnnnn

SEQ ID NO: 205154 - DNA, 183 bp, Homo sapiens
  misc_feature: GYAE6OF01D1GOO.30.25.C03.1.454.CMB.1.raw
  modified_base (173)..(183): a, c, t, g, unknown or other
  misc_feature (173)..(183): n is a, c, g, or t
tcagcacgctacgtcacgaccggtgctcgatttagtagtgtagatttgggtttgggggaagaggaagactgacggtcccccaggagttcaggtgctgggcacagcggccctgggctgcctggtcaaggactacttccacgtagcgtgctgagcgggctggcaaggcgcatagnnnnnnnnnnn

SEQ ID NO: 205155 - DNA, 174 bp, Homo sapiens; identical to SEQ ID NO: 205077
  misc_feature: GYAE6OF01CQ5TI.30.25.C03.1.454.CMB.1.raw
  modified_base (173)..(174): a, c, t, g, unknown or other
  misc_feature (173)..(174): n is a, c, g, or t

SEQ ID NO: 205156 - DNA, 232 bp, Homo sapiens; identical to SEQ ID NO: 205063
  misc_feature: GYAE6OF01BA3WE.30.25.C03.1.454.CMB.1.raw
  modified_base (230)..(232): a, c, t, g, unknown or other
  misc_feature (230)..(232): n is a, c, g, or t

SEQ ID NO: 205157 - DNA, 182 bp, Homo sapiens
  misc_feature: GYAE6OF01DBI7K.30.25.C03.1.454.CMB.1.raw
  modified_base (161)..(182): a, c, t, g, unknown or other
  misc_feature (161)..(182): n is a, c, g, or t
tcagcacgctacgtcacgaccggtgctcgatttagtagtgtagatttgggtttggggggtaaggaggaagactcgacggtcctgccacagcggccctgggctgccgtggtcaaggactacttccacgtaggcgtgctgagcgggctggcaaggcgcatagnnnnnnnnnnnnnnnnnnnnnn

SEQ ID NO: 205158 - DNA, 230 bp, Homo sapiens
  misc_feature: GYAE6OF01B3RYR.30.25.C03.1.454.CMB.1.raw
  modified_base (229)..(230): a, c, t, g, unknown or other
  misc_feature (229)..(230): n is a, c, g, or t
tcagcacgctacgtcacgaccggtgctcgatttagtagtgtagatttgggtttgggtgcccaagctgctggagggcacggtcaccgtctcctcagcctccaccaagggcccatcggtcttccccctggcaccctcctccaagagcacctctgggggcacagcggccctgggctgcctggtcaaggactacttccacgagcgtgctgagcgggctggcaaggcgcatagnn

SEQ ID NO: 205159 - DNA, 175 bp, Homo sapiens; identical to SEQ ID NO: 205102
  misc_feature: GYAE6OF01BVWR0.30.25.C03.1.454.CMB.1.raw
  modified_base (173)..(175): a, c, t, g, unknown or other
  misc_feature (173)..(175): n is a, c, g, or t

SEQ ID NO: 205160 - DNA, 260 bp, Homo sapiens
  misc_feature: GYAE6OF01DGSID.30.25.C03.1.454.CMB.1.raw
  modified_base (229)..(233): a, c, t, g, unknown or other
  misc_feature (229)..(233): n is a, c, g, or t
  modified_base (235)..(260): a, c, t, g, unknown or other
  misc_feature (235)..(260): n is a, c, g, or t
tcagcacgctacgtcacgaccggtgctcgatttagtagtgtagatttgggtttgggtgcccaagctgctggagggcacggtcaccgtctcctcagcctccaccaagggcccatcggtcttccccctggcaccctcctccaagagcacctctgggggcacagcggccctgggctgcctggtcaagactacttccacgtagcgtgctgagcgggctggcaaggcgcatagnnnnnannnnnnnnnnnnnnnnnnnnnnnnnn

SEQ ID NO: 205161 - DNA, 240 bp, Homo sapiens
  misc_feature: GYAE6OF01C6PM2.30.25.C03.1.454.CMB.1.raw
  modified_base (226)..(240): a, c, t, g, unknown or other
  misc_feature (226)..(240): n is a, c, g, or t
tcagcacgctacgtcacgaccggtgctcgatttagtagtgtagatttgggtttgggtgccaagctgctggagggcacggtcaccgtctcctcagcctccaccaagggcccatcggtcttcccctggcaccctcctccaagagcacctctggggcacagcggccctgggctgcctggtcaaggctacttccacgtagcgtgctgagcgggctggcaaggcgcatagnnnnnnnnnnnnnnn

SEQ ID NO: 205162 - DNA, 249 bp, Homo sapiens
  misc_feature: GYAE6OF01D8276.30.25.C03.1.454.CMB.1.raw
  modified_base (230)..(249): a, c, t, g, unknown or other
  misc_feature (230)..(249): n is a, c, g, or t
tcagcacgctacgtcacgaccggtgctcgatttagtagtgtagatttgggtttgggtgcccaagctgctggagggcacggtcaccgtctcctcagcctccaccaagggcccatcggtcttccccctggcaccctcctccaagagcacctctgggggcacagcggccctgggctgcctggtccaaggctacttccacgtagcgtgctgagcgggctggcaaggcgcatagnnnnnnnnnnnnnnnnnnnn

SEQ ID NO: 205163 - DNA, 230 bp, Homo sapiens; identical to SEQ ID NO: 205071
  misc_feature: GYAE6OF01AMG37.30.25.C03.1.454.CMB.1.raw
  modified_base (229)..(230): a, c, t, g, unknown or other
  misc_feature (229)..(230): n is a, c, g, or t

SEQ ID NO: 205164 - DNA, 238 bp, Homo sapiens
  misc_feature: GYAE6OF01ESWCM.30.25.C03.1.454.CMB.1.raw
  modified_base (229)..(238): a, c, t, g, unknown or other
  misc_feature (229)..(238): n is a, c, g, or t
tcagcacgctacgtcacgaccggtgctcgatttagtagtgtagatttgggtttgggtggcccaagctgctggagggcacggtcaccgtctcctcagcctccaccaagggcccatcggtcttcccctggcaccctcctccaagagcacctctgggggcacagcggcctgggctgcctggtcaaggactacttccacgtagcgtgctgagcgggctggcaaggcgcatagnnnnnnnnnn

SEQ ID NO: 205165 - DNA, 155 bp, Homo sapiens; identical to SEQ ID NO: 205076
  misc_feature: GYAE6OF01ADOC1.30.25.C03.1.454.CMB.1.raw
  modified_base (155)..(155): a, c, t, g, unknown or other
  misc_feature (155)..(155): n is a, c, g, or t

SEQ ID NO: 205166 - DNA, 256 bp, Homo sapiens
  misc_feature: GYAE6OF01C1K8W.30.25.C03.1.454.CMB.1.raw
  modified_base (232)..(256): a, c, t, g, unknown or other
  misc_feature (232)..(256): n is a, c, g, or t
tcagcacgctacgtcacgaccggtgctcgatttagtagtgtagatttgggtttgggtgcccaagctggctggagggcacggtcaccgtctcctcagcctccaccaagggcccatcggtcttccccctggcaccctcctccgaagagcacctctgggggcacagcggcctgggctgcctggtcaaggactacgttccacgtagcgtgctgagcgggctggcaaggcgcatagnnnnnnnnnnnnnnnnnnnnnnnnn

SEQ ID NO: 205167 - DNA, 172 bp, Homo sapiens
  misc_feature: GYAE6OF01AL97F.30.25.C03.1.454.CMB.1.raw
tcagcacgctacgtcacgaccggtgctcgatttagtagtgtagatttgggtttgggggaagaggaagactgacggtcccccaggagttcaggtgctgggcacagcggccctgggctgcctggtcaaggactacttccacgtagcgtgctgagcgggctggcaaggcgcatag

SEQ ID NO: 205168 - DNA, 230 bp, Homo sapiens; identical to SEQ ID NO: 205095
  misc_feature: GYAE6OF01EHYR0.30.25.C03.1.454.CMB.1.raw
  modified_base (230)..(230): a, c, t, g, unknown or other
  misc_feature (230)..(230): n is a, c, g, or t

SEQ ID NO: 205169 - DNA, 242 bp, Homo sapiens
  misc_feature: GYAE6OF01D7CDZ.30.25.C03.1.454.CMB.1.raw
  modified_base (231)..(242): a, c, t, g, unknown or other
  misc_feature (231)..(242): n is a, c, g, or t
tcagcacgctacgtcacgaccggtgctcgatttagtagtgtagatttgggtttgggtggcccaagctgctggagggcacggtcaccgtctcctcagcctccaccaagggcccatcggtcttccccctggcaccctcctccaagagcacctctgggggcacagcggccctgggctgcctggtcaaggactacttccacgtagcgtgctgagcgggctggcaaggcgcatagnnnnnnnnnnnn

SEQ ID NO: 205170 - DNA, 170 bp, Homo sapiens
  misc_feature: GYAE6OF01BCD13.30.25.C03.1.454.CMB.1.raw
  modified_base (167)..(170): a, c, t, g, unknown or other
  misc_feature (167)..(170): n is a, c, g, or t
tcagcacgctacgtcacgaccggtgctcgattagtagtgtagattggttggggaagaggaagactgacggtccccaggagttcaggtgctgggcacagcggccctgggctgcctggtcaaggactacttccacgtagcgtgctgagcgggctggcaaggcgcatagnnnn

SEQ ID NO: 205171 - DNA, 255 bp, Homo sapiens
  misc_feature: GYAE6OF01DS76L.30.25.C03.1.454.CMB.1.raw
  modified_base (229)..(255): a, c, t, g, unknown or other
  misc_feature (229)..(255): n is a, c, g, or t
tcagcacgctacgtcacgaccggtgctcgatttagtagtgtagatttggggtttgggtggcccaagctgctggagggcacggtcaccgtctcctcagcctccaccaagggcccatcggtcttcccctggcaccctcctccaagagcacctctgggggcacagcggcctgggctgcctggtcaaggctacttccacgtagcgtgctgagcgggctggcaaggcgcatagnnnnnnnnnnnnnnnnnnnnnnnnnnn

SEQ ID NO: 205172 - DNA, 174 bp, Homo sapiens
  misc_feature: GYAE6OF01A14V3.30.25.C03.1.454.CMB.1.raw
  modified_base (171)..(174): a, c, t, g, unknown or other
  misc_feature (171)..(174): n is a, c, g, or t
tcagcacgctacgtcacgaccggtgctcgatttagtagtgtagatttgggtttggggaagaggaagactgacggtccccaggagttcaggtgctgggcacagcggccctgggctgcctggttaaggactacttccacgtagcgtgctgagcgggctggcaaggcgcatagnnnn

SEQ ID NO: 205173 - DNA, 173 bp, Homo sapiens; identical to SEQ ID NO: 205084
  misc_feature: GYAE6OF01EXNXS.30.25.C03.1.454.CMB.1.raw
  modified_base (173)..(173): a, c, t, g, unknown or other
  misc_feature (173)..(173): n is a, c, g, or t

SEQ ID NO: 205174 - DNA, 229 bp, Homo sapiens; identical to SEQ ID NO: 205136
  misc_feature: GYAE6OF01D5RH8.30.25.C03.1.454.CMB.1.raw
  modified_base (229)..(229): a, c, t, g, unknown or other
  misc_feature (229)..(229): n is a, c, g, or t

SEQ ID NO: 205175 - DNA, 176 bp, Homo sapiens
  misc_feature: GYAE6OF01ECCQP.30.25.C03.1.454.CMB.1.raw
  modified_base (174)..(176): a, c, t, g, unknown or other
  misc_feature (174)..(176): n is a, c, g, or t
tcagcacgctacgtcacgaccggtgctcgatttagtagtgtagatttgggttttgggggaagaggaagactgacggtcccccaggagttcaggtgctgggcacagcggccctgggctgcctggtcaaggactacttccacgtagcgtgctgagcgggctggcaaggcgcatagnnn

SEQ ID NO: 205176 - DNA, 245 bp, Homo sapiens
  misc_feature: GYAE6OF01DEPPL.30.25.C03.1.454.CMB.1.raw
  modified_base (231)..(245): a, c, t, g, unknown or other
  misc_feature (231)..(245): n is a, c, g, or t
tcagcacgctacgtcacgaccggtgctcgatttagtagtgtagatttgggtttgggtgcccaagctgcttggagggcacggtcaccgtctcctcagcctccaccaaggcccatcggtcttccccctggcacccgtcctccaagagcacctcgtggggccacagcggccctgggctgcctggtcaggactacttccacgtagcgtgctgagcgggctggcaaggcgcatagnnnnnnnnnnnnnnn

SEQ ID NO: 205177 - DNA, 156 bp, Homo sapiens
  misc_feature: GYAE6OF01BAD9K.30.25.C03.1.454.CMB.1.raw
  modified_base (155)..(156): a, c, t, g, unknown or other
  misc_feature (155)..(156): n is a, c, g, or t
tcagcacgctacgtcacgaccggtgctcgatttagtagtgtagatttgggtttgggggaagaggaagactgacggtcctgcaacagcggccctgggctgcctggtcaaggactacttccacgtagcgtgctgagcgggctggcaaggcgcatagnn

SEQ ID NO: 205178 - DNA, 155 bp, Homo sapiens; identical to SEQ ID NO: 205076
  misc_feature: GYAE6OF01DZOP9.30.25.C03.1.454.CMB.1.raw
  modified_base (155)..(155): a, c, t, g, unknown or other
  misc_feature (155)..(155): n is a, c, g, or t

SEQ ID NO: 205179 - DNA, 230 bp, Homo sapiens; identical to SEQ ID NO: 205095
  misc_feature: GYAE6OF01EA4D1.30.25.C03.1.454.CMB.1.raw
  modified_base (230)..(230): a, c, t, g, unknown or other
  misc_feature (230)..(230): n is a, c, g, or t

SEQ ID NO: 205180 - DNA, 231 bp, Homo sapiens
  misc_feature: GYAE6OF01BXXNB.30.25.C03.1.454.CMB.1.raw
  modified_base (229)..(231): a, c, t, g, unknown or other
  misc_feature (229)..(231): n is a, c, g, or t
tcagcacgctacgtcacgaccggtgctcgatttagtagtgtagatttgggtttgggtgcccaagctgctggagggcacggtcaccgtctcctcagcctccaccaagggcccatcggtcttcccctggcaccctcctccaagagcacctctgggggcacagcggccctgggctgcctggtcaaggactacttccacgtagcgtgctgagcgggctggcaaggcgcatagnnn

SEQ ID NO: 205181 - DNA, 176 bp, Homo sapiens; identical to SEQ ID NO: 205124
  misc_feature: GYAE6OF01BCYJT.30.25.C03.1.454.CMB.1.raw
  modified_base (173)..(176): a, c, t, g, unknown or other
  misc_feature (173)..(176): n is a, c, g, or t

SEQ ID NO: 205182 - DNA, 232 bp, Homo sapiens; identical to SEQ ID NO: 205085
  misc_feature: GYAE6OF01D1HK8.30.25.C03.1.454.CMB.1.raw
  modified_base (229)..(232): a, c, t, g, unknown or other
  misc_feature (229)..(232): n is a, c, g, or t

SEQ ID NO: 205183 - DNA, 232 bp, Homo sapiens; identical to SEQ ID NO: 205063
  misc_feature: GYAE6OF01EBKCJ.30.25.C03.1.454.CMB.1.raw
  modified_base (230)..(232): a, c, t, g, unknown or other
  misc_feature (230)..(232): n is a, c, g, or t

SEQ ID NO: 205184 - DNA, 232 bp, Homo sapiens; identical to SEQ ID NO: 205123
  misc_feature: GYAE6OF01CI28K.30.25.C03.1.454.CMB.1.raw
  modified_base (229)..(232): a, c, t, g, unknown or other
  misc_feature (229)..(232): n is a, c, g, or t

SEQ ID NO: 205185 - DNA, 174 bp, Homo sapiens; identical to SEQ ID NO: 205077
  misc_feature: GYAE6OF01BIX6T.30.25.C03.1.454.CMB.1.raw
  modified_base (173)..(174): a, c, t, g, unknown or other
  misc_feature (173)..(174): n is a, c, g, or t

SEQ ID NO: 205186 - DNA, 232 bp, Homo sapiens; identical to SEQ ID NO: 205085
  misc_feature: GYAE6OF01CG9XW.30.25.C03.1.454.CMB.1.raw
  modified_base (229)..(232): a, c, t, g, unknown or other
  misc_feature (229)..(232): n is a, c, g, or t

SEQ ID NO: 205187 - DNA, 216 bp, Homo sapiens
  misc_feature: GYAE6OF01D93I8.30.25.C03.1.454.CMB.1.raw
  modified_base (177)..(180): a, c, t, g, unknown or other
  misc_feature (177)..(180): n is a, c, g, or t
  modified_base (182)..(216): a, c, t, g, unknown or other
  misc_feature (182)..(216): n is a, c, g, or t
tcagcacgctacgtcacgaccggtgctcgatttagtagtgtagatttgggtttggggggaagaggaagactagacggtcccccaaggagttcaggtgctgggcacagcggccctgggctgccttggttcaaggactacttccacgtagcgtgctgagcggctggcaaggcgcatagnnnntnnnnnnnnnnnnnnnnnnnnnnnnnnnnnnnnnnn

SEQ ID NO: 205188 - DNA, 231 bp, Homo sapiens; identical to SEQ ID NO: 205120
  misc_feature: GYAE6OF01ESQ0U.30.25.C03.1.454.CMB.1.raw
  modified_base (230)..(231): a, c, t, g, unknown or other
  misc_feature (230)..(231): n is a, c, g, or t

SEQ ID NO: 205189 - DNA, 233 bp, Homo sapiens
  misc_feature: GYAE6OF01AYJ2U.30.25.C03.1.454.CMB.1.raw
  modified_base (230)..(233): a, c, t, g, unknown or other
  misc_feature (230)..(233): n is a, c, g, or t
tcagcacgctacgtcacgaccggtgctcgatttagtagtgtagatttgggtttgggtgcccaagctgctggagggcacggtcaccgtctcctcagcctccaccaagggcccatcggtcttccccctggcaccctcctccaagagcacctctgggggcacagcggccctgggctgcctggtcaaggactacttccacgtagcgtgctgagcgggctggcaaggcgcatagnnnn

SEQ ID NO: 205190 - DNA, 167 bp, Homo sapiens
  misc_feature: GYAE6OF01C3EO8.30.25.C03.1.454.CMB.1.raw
  modified_base (156)..(167): a, c, t, g, unknown or other
  misc_feature (156)..(167): n is a, c, g, or t
tcagcacgctacgtcacgaccggtgctcgatttagtagtgtagatttgggtttgggggaaggaggaagactgacggtcctgccacagcggccctgggctgcctggtcaaggactacttccacgtagcgtgctgagcgggctggcaaggcgcatagnnnnnnnnnnnn

SEQ ID NO: 205191 - DNA, 230 bp, Homo sapiens
  misc_feature: GYAE6OF01DIDI0.30.25.C03.1.454.CMB.1.raw
  modified_base (229)..(230): a, c, t, g, unknown or other
  misc_feature (229)..(230): n is a, c, g, or t
tcagcacgctacgtcacgaccggtgctcgatttagtagtgtagatttgggtttgggtgcccaagctgctggagggcacggtcaccgtctcctcagcctccaccaagggcccatcggtcttccccctggcaccctcctccaagagcacctctggggcacagcggccctgggctgcctggtcaaggactacttccacgtagcgtgctgagcgggctggcaaggcgcatagnn

SEQ ID NO: 205192 - DNA, 229 bp, Homo sapiens
  misc_feature: GYAE6OF01DJQYO.30.25.C03.1.454.CMB.1.raw
  modified_base (229)..(229): a, c, t, g, unknown or other
  misc_feature (229)..(229): n is a, c, g, or t
tcagcacgctacgtcacgaccggtgctcgatttagtagtgtagatttgggtttgggtgcccaagctgctggagggcacggtcaccgtctcctcagcctccaccagggcccatcggtcttcccctggcaccctcctccaaagagcacctcgtggtcgacagcggccctgggctgcctggtcaaggactacttccacgtagcgtgctgagcgggctggcaaggcgcatagn

SEQ ID NO: 205193 - DNA, 233 bp, Homo sapiens; identical to SEQ ID NO: 205189
  misc_feature: GYAE6OF01AKR9N.30.25.C03.1.454.CMB.1.raw
  modified_base (230)..(233): a, c, t, g, unknown or other
  misc_feature (230)..(233): n is a, c, g, or t

SEQ ID NO: 205194 - DNA, 240 bp, Homo sapiens
  misc_feature: GYAE6OF01EB7D0.30.25.C03.1.454.CMB.1.raw
  modified_base (229)..(240): a, c, t, g, unknown or other
  misc_feature (229)..(240): n is a, c, g, or t
tcagcacgctacgtcacgaccggtgctcgatttagtagtgtagatttgggtttgggtgcccaagctgctggagggcacggtcaccgtctcctcagcctccaccaagggcccatcggtcttcccctggcaccctcctccaagagcacctctgggggcacagcggccctgggctgcctggtcaaggactacttccacgtagcgtgctgagcgggctggcaaggcgcatagnnnnnnnnnnnn

SEQ ID NO: 205195 - DNA, 154 bp, Homo sapiens
  misc_feature: GYAE6OF01D4Y24.30.25.C03.1.454.CMB.1.raw
tcagcacgctacgtcacgaccggtgctcgatttagtagtgtagatttgggtttgggggaagaggaagactgacggtcctgccacagcggccctgggctgcctggtcaaggactacttccacgtagcgtgctgagcgggctggcaaggcgcatag

SEQ ID NO: 205196 - DNA, 233 bp, Homo sapiens; identical to SEQ ID NO: 205189
  misc_feature: GYAE6OF01APVUV.30.25.C03.1.454.CMB.1.raw
  modified_base (230)..(233): a, c, t, g, unknown or other
  misc_feature (230)..(233): n is a, c, g, or t

SEQ ID NO: 205197 - DNA, 654 bp, Homo sapiens
  misc_feature: GYAE6OF01BTR62.30.25.C03.1.454.CMB.1.raw
  modified_base (61)..(61): a, c, t, g, unknown or other
  misc_feature (61)..(61): n is a, c, g, or t
  modified_base (150)..(156): a, c, t, g, unknown or other
  misc_feature (150)..(156): n is a, c, g, or t
  modified_base (167)..(167): a, c, t, g, unknown or other
  misc_feature (167)..(167): n is a, c, g, or t
  modified_base (171)..(171): a, c, t, g, unknown or other
  misc_feature (171)..(171): n is a, c, g, or t
  modified_base (178)..(178): a, c, t, g, unknown or other
  misc_feature (178)..(178): n is a, c, g, or t
  modified_base (183)..(183): a, c, t, g, unknown or other
  misc_feature (183)..(183): n is a, c, g, or t
  modified_base (187)..(187): a, c, t, g, unknown or other
  misc_feature (187)..(187): n is a, c, g, or t
  modified_base (192)..(193): a, c, t, g, unknown or other
  misc_feature (192)..(193): n is a, c, g, or t
  modified_base (196)..(196): a, c, t, g, unknown or other
  misc_feature (196)..(196): n is a, c, g, or t
  modified_base (203)..(203): a, c, t, g, unknown or other
  misc_feature (203)..(203): n is a, c, g, or t
  modified_base (208)..(208): a, c, t, g, unknown or other
  misc_feature (208)..(208): n is a, c, g, or t
  modified_base (217)..(217): a, c, t, g, unknown or other
  misc_feature (217)..(217): n is a, c, g, or t
  modified_base (222)..(222): a, c, t, g, unknown or other
  misc_feature (222)..(222): n is a, c, g, or t
  modified_base (225)..(225): a, c, t, g, unknown or other
  misc_feature (225)..(225): n is a, c, g, or t
  modified_base (228)..(228): a, c, t, g, unknown or other
  misc_feature (228)..(228): n is a, c, g, or t
  modified_base (231)..(231): a, c, t, g, unknown or other
  misc_feature (231)..(231): n is a, c, g, or t
  modified_base (236)..(236): a, c, t, g, unknown or other
  misc_feature (236)..(236): n is a, c, g, or t
  modified_base (289)..(289): a, c, t, g, unknown or other
  misc_feature (289)..(289): n is a, c, g, or t
  modified_base (641)..(641): a, c, t, g, unknown or other
  misc_feature (641)..(641): n is a, c, g, or t
tcagcacgctacgtcacgaccggtgctcgatttagtagtgtagatttgggtttgggggaanaggaagactgacggtcctgccacagcggcctgggctgcctggtcaaggctactccagtagcgtgctgagcggctggcaaggcgcatagnnnnnnntcgtgctgctnctgntgctgcngtcgnctgntacgnntcngtgatcngtgcncgtactgcncgtangtngtngcngtacngcgtcagtacgtgacgtcgtacgtcgtagtccgtggtacctagtaccggtacncgtttcgacgtaccgtcgttacgtacgacgtttaacggcgtaagtccgttagtaaccggttctacggttacgtaaccgtttcgacccggtaggttacccgtaacggtaacgttcgtaaacggtcgttacgaccgttacgtaaccggtcgtaccgtaggtaccctaggtcgtaacccgtagtccgtacgttcacggtttaacgccgttaacgggtccaaacggttcgaccgttagggtaccttaaccgtggtccgttaacggtaccgtaacgttacggtacgttcgggtaacaccgggtttacggacccgtttacggtaccgttaccggtaaaggttccccgtttaaaacggngttttaacccggg

SEQ ID NO: 205198 - DNA, 232 bp, Homo sapiens
  misc_feature: GYAE6OF01DSICR.30.25.C03.1.454.CMB.1.raw
  modified_base (228)..(232): a, c, t, g, unknown or other
  misc_feature (228)..(232): n is a, c, g, or t
tcagcacgctacgtcacgaccggtgctcgatttagtagtgtagatttgggtttgggtgcccaagctgctggagggcacggtcaccgtctcctcagcctccaccaagggcccatcggtcttcccctggcaccctcctccaagagcacctctggggcacagcggccctgggctgcctggtcaaggactacttccacgtagcgtgctgagcgggctggcaaggcgcatagnnnnn

SEQ ID NO: 205199 - DNA, 157 bp, Homo sapiens; identical to SEQ ID NO: 205114
  misc_feature: GYAE6OF01CA7J5.30.25.C03.1.454.CMB.1.raw
  modified_base (155)..(157): a, c, t, g, unknown or other
  misc_feature (155)..(157): n is a, c, g, or t

SEQ ID NO: 205200 - DNA, 193 bp, Homo sapiens
  misc_feature: GYAE6OF01CS22O.30.25.C03.1.454.CMB.1.raw
  modified_base (160)..(161): a, c, t, g, unknown or other
  misc_feature (160)..(161): n is a, c, g, or t
  modified_base (163)..(193): a, c, t, g, unknown or other
  misc_feature (163)..(193): n is a, c, g, or t
tcagcacgctacgtcacgaccggtgctcgatttagtagtgtagatttgggttgggggaaggaggaagactgacggtcctgccacagcggccctgggctgcctggtcaagggacctacttccacggtagccgtcgtgagcgggctggcaaggcgcataggnnannnnnnnnnnnnnnnnnnnnnnnnnnnnnnn

SEQ ID NO: 205201 - DNA, 232 bp, Homo sapiens; identical to SEQ ID NO: 205063
  misc_feature: GYAE6OF01BFBRR.30.25.C03.1.454.CMB.1.raw
  modified_base (230)..(232): a, c, t, g, unknown or other
  misc_feature (230)..(232): n is a, c, g, or t

SEQ ID NO: 205202 - DNA, 174 bp, Homo sapiens; identical to SEQ ID NO: 205077
  misc_feature: GYAE6OF01DF113.30.25.C03.1.454.CMB.1.raw
  modified_base (173)..(174): a, c, t, g, unknown or other
  misc_feature (173)..(174): n is a, c, g, or t

SEQ ID NO: 205203 - DNA, 241 bp, Homo sapiens
  misc_feature: GYAE6OF01D9G5S.30.25.C03.1.454.CMB.1.raw
  modified_base (232)..(241): a, c, t, g, unknown or other
  misc_feature (232)..(241): n is a, c, g, or t
tcagcacgctacgtcacgaccggtgctcgatttagtagtgtagatttgggtttgggtggcccaagctgctggagggcacggtcaccgtctcctcagcctccaccaagggcccatcggtcttccccctggcaccctcctccaagagcacctctgggggcacagcggccctgggctgcctggtcaaggactacttccacgtagcgtgctgagcgggctggcgaaggcgcatagnnnnnnnnnn

SEQ ID NO: 205204 - DNA, 155 bp, Homo sapiens; identical to SEQ ID NO: 205076
  misc_feature: GYAE6OF01CG6PY.30.25.C03.1.454.CMB.1.raw
  modified_base (155)..(155): a, c, t, g, unknown or other
  misc_feature (155)..(155): n is a, c, g, or t

SEQ ID NO: 205205 - DNA, 231 bp, Homo sapiens
  misc_feature: GYAE6OF01A3ATT.30.25.C03.1.454.CMB.1.raw
  modified_base (229)..(231): a, c, t, g, unknown or other
  misc_feature (229)..(231): n is a, c, g, or t
tcagcacgctacgtcacgaccggtgctcgatttagtagtgtagatttgggtttgggtgcccaagctgctggagggcacggtcaccgtctcctcagcctccaccaagggcccatcggtcttcccctggcaccctcctccaagagcacctcgtgggggcacagcggccctgggctgcctggtcaaggactacttccactagcgtgctgagcgggctggcaaggcgcatagnnn

SEQ ID NO: 205206 - DNA, 155 bp, Homo sapiens
  misc_feature: GYAE6OF01DEFHM.30.25.C03.1.454.CMB.1.raw
  modified_base (154)..(155): a, c, t, g, unknown or other
  misc_feature (154)..(155): n is a, c, g, or t
tcagcacgctacgtcacgaccggtgctcgatttagtagtgtagatttgggtttgggggaagaggaagactgacggtcctgccacagcggccctgggctgcctggcaaggactacttccacgtagcgtgctgagcgggctggcaaggcgcatagnn

SEQ ID NO: 205207 - DNA, 233 bp, Homo sapiens
  misc_feature: GYAE6OF01C9RWY.30.25.C03.1.454.CMB.1.raw
  modified_base (229)..(233): a, c, t, g, unknown or other
  misc_feature (229)..(233): n is a, c, g, or t
tcagcacgctacgtcacgaccggtgctcgatttagtagtgtagatttgggtttgggtgcccaagctgctggagggcacggtcaccgtctcctcagcctccaccaagggcccatcggtcttccccctggcaccctcctccaagagcacctctggggcacagcggccctgggctgcctggtcaaggactacttccacgtagcgtgctgagcgggctggcaaggcgcatagnnnnn

SEQ ID NO: 205208 - DNA, 232 bp, Homo sapiens; identical to SEQ ID NO: 205198
  misc_feature: GYAE6OF01CQ3EU.30.25.C03.1.454.CMB.1.raw
  modified_base (228)..(232): a, c, t, g, unknown or other
  misc_feature (228)..(232): n is a, c, g, or t

SEQ ID NO: 205209 - DNA, 173 bp, Homo sapiens; identical to SEQ ID NO: 205084
  misc_feature: GYAE6OF01A5CMG.30.25.C03.1.454.CMB.1.raw
  modified_base (173)..(173): a, c, t, g, unknown or other
  misc_feature (173)..(173): n is a, c, g, or t

SEQ ID NO: 205210 - DNA, 175 bp, Homo sapiens; identical to SEQ ID NO: 205102
  misc_feature: GYAE6OF01C34WH.30.25.C03.1.454.CMB.1.raw
  modified_base (173)..(175): a, c, t, g, unknown or other
  misc_feature (173)..(175): n is a, c, g, or t

SEQ ID NO: 205211 - DNA, 157 bp, Homo sapiens; identical to SEQ ID NO: 205114
  misc_feature: GYAE6OF01EY5W0.30.25.C03.1.454.CMB.1.raw
  modified_base (155)..(157): a, c, t, g, unknown or other
  misc_feature (155)..(157): n is a, c, g, or t

SEQ ID NO: 205212 - DNA, 158 bp, Homo sapiens; identical to SEQ ID NO: 205153
  misc_feature: GYAE6OF01D8FFG.30.25.C03.1.454.CMB.1.raw
  modified_base (155)..(158): a, c, t, g, unknown or other
  misc_feature (155)..(158): n is a, c, g, or t

SEQ ID NO: 205213 - DNA, 232 bp, Homo sapiens; identical to SEQ ID NO: 205063
  misc_feature: GYAE6OF01EF5UQ.30.25.C03.1.454.CMB.1.raw
  modified_base (230)..(232): a, c, t, g, unknown or other
  misc_feature (230)..(232): n is a, c, g, or t

SEQ ID NO: 205214 - DNA, 172 bp, Homo sapiens
  misc_feature: GYAE6OF01CJRG0.30.25.C03.1.454.CMB.1.raw
  modified_base (168)..(172): a, c, t, g, unknown or other
  misc_feature (168)..(172): n is a, c, g, or t
tcagcacgctacgtcacgaccggtgctcgatttagtagtgtagatttgggtttgggaagaggaagactgacggtccccaggagttcaggtgctggcacagcggccctgggctgcctggtcaaggactacttcacgtagcgtgctgagcgggctggcaaggcgcatagnnnnn

SEQ ID NO: 205215 - DNA, 176 bp, Homo sapiens; identical to SEQ ID NO: 205124
  misc_feature: GYAE6OF01B0SSM.30.25.C03.1.454.CMB.1.raw
  modified_base (173)..(176): a, c, t, g, unknown or other
  misc_feature (173)..(176): n is a, c, g, or t

SEQ ID NO: 205216 - DNA, 190 bp, Homo sapiens
  misc_feature: GYAE6OF01AIEKC.30.25.C03.1.454.CMB.1.raw
  modified_base (173)..(190): a, c, t, g, unknown or other
  misc_feature (173)..(190): n is a, c, g, or t
tcagcacgctacgtcacgaccggtgctcgatttagtagtgtagatttgggtttgggggaagaggaagactgacggtcccccaggagttcaggtgctgggcacagcggccctgggctgcctggtcaaggactacttccacgtagcgtgctgagcgggctggcaaggcgcatagnnnnnnnnnnnnnnnnnn

SEQ ID NO: 205217 - DNA, 155 bp, Homo sapiens; identical to SEQ ID NO: 205076
  misc_feature: GYAE6OF01EM7CB.30.25.C03.1.454.CMB.1.raw
  modified_base (155)..(155): a, c, t, g, unknown or other
  misc_feature (155)..(155): n is a, c, g, or t

SEQ ID NO: 205218 - DNA, 234 bp, Homo sapiens
  misc_feature: GYAE6OF01D05CP.30.25.C03.1.454.CMB.1.raw
  modified_base (229)..(234): a, c, t, g, unknown or other
  misc_feature (229)..(234): n is a, c, g, or t
tcagcacgctacgtcacgaccggtgctcgatttagtagtgtagatttgggtttgggtgcccaagctgctggagggcacggtcaccgtctcctcagcctccaccaagggcccatcggtcttcccctggcaccctcctccaagagcacctctgggggcacagcggccctgggctgcctggtcaaggactacttccacgtagcgtgctgagcgggctggcaaggcgcatagnnnnnn

SEQ ID NO: 205219 - DNA, 249 bp, Homo sapiens; identical to SEQ ID NO: 205162
  misc_feature: GYAE6OF01B9NEK.30.25.C03.1.454.CMB.1.raw
  modified_base (230)..(249): a, c, t, g, unknown or other
  misc_feature (230)..(249): n is a, c, g, or t

SEQ ID NO: 205220 - DNA, 231 bp, Homo sapiens; identical to SEQ ID NO: 205120
  misc_feature: GYAE6OF01AXML1.30.25.C03.1.454.CMB.1.raw
  modified_base (230)..(231): a, c, t, g, unknown or other
  misc_feature (230)..(231): n is a, c, g, or t

SEQ ID NO: 205221 - DNA, 175 bp, Homo sapiens; identical to SEQ ID NO: 205102
  misc_feature: GYAE6OF01DLXGW.30.25.C03.1.454.CMB.1.raw
  modified_base (173)..(175): a, c, t, g, unknown or other
  misc_feature (173)..(175): n is a, c, g, or t

SEQ ID NO: 205222 - DNA, 173 bp, Homo sapiens; identical to SEQ ID NO: 205084
  misc_feature: GYAE6OF01EXP90.30.25.C03.1.454.CMB.1.raw
  modified_base (173)..(173): a, c, t, g, unknown or other
  misc_feature (173)..(173): n is a, c, g, or t

SEQ ID NO: 205223 - DNA, 233 bp, Homo sapiens
  misc_feature: GYAE6OF01BCL0O.30.25.C03.1.454.CMB.1.raw
  modified_base (229)..(233): a, c, t, g, unknown or other
  misc_feature (229)..(233): n is a, c, g, or t
tcagcacgctacgtcacgaccggtgctcgatttagtagtgtagatttgggtttgggtgcccaagctgctggagggcacggtcaccgtctcctcagcctccaccaagggcccatcggtcttcccctggcaccctcctccaagagcacctctgggggcacagcggccctgggctgcctggtcaaggactacttccacgtagcgtgctgagcgggctggcaaggcgcatagnnnnn

SEQ ID NO: 205224 - DNA, 174 bp, Homo sapiens; identical to SEQ ID NO: 205077
  misc_feature: GYAE6OF01CJR7L.30.25.C03.1.454.CMB.1.raw
  modified_base (173)..(174): a, c, t, g, unknown or other
  misc_feature (173)..(174): n is a, c, g, or t

SEQ ID NO: 205225 - DNA, 156 bp, Homo sapiens
  misc_feature: GYAE6OF01CUW30.30.25.C03.1.454.CMB.1.raw
  modified_base (153)..(156): a, c, t, g, unknown or other
  misc_feature (153)..(156): n is a, c, g, or t
tcagcacgctacgtcacgaccggtgctcgatttagtagtgtagatttgggttgggggaagaggaagactgacggtcctgccacagcggcctgggctgcctggtcaaggactacttccacgtagcgtgctgagcgggctggcaaggcgcatagnnnn

SEQ ID NO: 205226 - DNA, 173 bp, Homo sapiens; identical to SEQ ID NO: 205084
  misc_feature: GYAE6OF01CYHKZ.30.25.C03.1.454.CMB.1.raw
  modified_base (173)..(173): a, c, t, g, unknown or other
  misc_feature (173)..(173): n is a, c, g, or t

SEQ ID NO: 205227 - DNA, 231 bp, Homo sapiens; identical to SEQ ID NO: 205129
  misc_feature: GYAE6OF01EL8R3.30.25.C03.1.454.CMB.1.raw
  modified_base (229)..(231): a, c, t, g, unknown or other
  misc_feature (229)..(231): n is a, c, g, or t

SEQ ID NO: 205228 - DNA, 170 bp, Homo sapiens
  misc_feature: GYAE6OF01EX3RY.30.25.C03.1.454.CMB.1.raw
  modified_base (166)..(170): a, c, t, g, unknown or other
  misc_feature (166)..(170): n is a, c, g, or t
tcagcacgctacgtcacgaccggtgctcgatttagtagtgtagatttgggtttgggggaagggaggtaagacgtggaccggtacctgccacaggcggccctgggactgcctcggtcaaggactacttccacgtacgccgtgctgagcggctggcaaggcgcatagnnnnn

SEQ ID NO: 205229 - DNA, 217 bp, Homo sapiens
  misc_feature: GYAE6OF01E4WZ8.30.25.C03.1.454.CMB.1.raw
  modified_base (146)..(146): a, c, t, g, unknown or other
  misc_feature (146)..(146): n is a, c, g, or t
  modified_base (177)..(217): a, c, t, g, unknown or other
  misc_feature (177)..(217): n is a, c, g, or t
tcagcacgctacgtcacgaccggtgctcgatttagtagtgtagatttgggtttgggggtaaggaggaagactgacggtcccccaggagttcaggtgctgggcaccagcggccctgggctgcctggtcaaggactacttccacgtanccgtgctgagcgggctggcaaggcgcatagnnnnnnnnnnnnnnnnnnnnnnnnnnnnnnnnnnnnnnnnn

SEQ ID NO: 205230 - DNA, 237 bp, Homo sapiens
  misc_feature: GYAE6OF01DEN4G.30.25.C03.1.454.CMB.1.raw
  modified_base (230)..(237): a, c, t, g, unknown or other
  misc_feature (230)..(237): n is a, c, g, or t
tcagcacgctacgtcacgaccggtgctcgatttagtagtgtagatttgggtttgggtgcccaagctgctggagggcacggtcaccgtctcctcagcctccaccaagggcccatcggtcttccccctggcaccctcctccaagagcacctctgggggcacagcggccctgggctgcctggtcaaggactacttccacgtagcgtgctgagcgggctggcaaggcgcatagnnnnnnnn

SEQ ID NO: 205231 - DNA, 231 bp, Homo sapiens; identical to SEQ ID NO: 205180
  misc_feature: GYAE6OF01BLNNM.30.25.C03.1.454.CMB.1.raw
  modified_base (229)..(231): a, c, t, g, unknown or other
  misc_feature (229)..(231): n is a, c, g, or t

SEQ ID NO: 205232 - DNA, 177 bp, Homo sapiens
  misc_feature: GYAE6OF01AM2MR.30.25.C03.1.454.CMB.1.raw
  modified_base (173)..(177): a, c, t, g, unknown or other
  misc_feature (173)..(177): n is a, c, g, or t
tcagcacgctacgtcacgaccggtgctcgatttagtagtgtagatttgggtttgggggaagaggaagactgacggtcccccaggagttcaggtgctgggcacagcggccctgggctgcctggtcaaggactacttccacgtagcgtgctgagcgggctggcaaggcgcatagnnnnn

SEQ ID NO: 205233 - DNA, 233 bp, Homo sapiens; identical to SEQ ID NO: 205189
  misc_feature: GYAE6OF01BXLLS.30.25.C03.1.454.CMB.1.raw
  modified_base (230)..(233): a, c, t, g, unknown or other
  misc_feature (230)..(233): n is a, c, g, or t

SEQ ID NO: 205234 - DNA, 173 bp, Homo sapiens; identical to SEQ ID NO: 205084
  misc_feature: GYAE6OF01ELJSQ.30.25.C03.1.454.CMB.1.raw
  modified_base (173)..(173): a, c, t, g, unknown or other
  misc_feature (173)..(173): n is a, c, g, or t

SEQ ID NO: 205235 - DNA, 174 bp, Homo sapiens; identical to SEQ ID NO: 205077
  misc_feature: GYAE6OF01DTMWF.30.25.C03.1.454.CMB.1.raw
  modified_base (173)..(174): a, c, t, g, unknown or other
  misc_feature (173)..(174): n is a, c, g, or t

SEQ ID NO: 205236 - DNA, 256 bp, Homo sapiens
  misc_feature: GYAE6OF01DWCJL.30.25.C03.1.454.CMB.1.raw
  modified_base (232)..(256): a, c, t, g, unknown or other
  misc_feature (232)..(256): n is a, c, g, or t
tcagcacgctacgtcacgaccggtgctcgatttagtagtgtagatttgggtttgggtgcccaagctgctggagggcacggtcaccgtctcctcagcctccaccaagggcccatcggtcttccccctggcaccctcctccaagagcacctctgggggcacgagcggccctgggctgcctggtcaaggactacttccacgtagcgtgctgagcgggctgggcaaggcgcatagnnnnnnnnnnnnnnnnnnnnnnnnn

SEQ ID NO: 205237 - DNA, 174 bp, Homo sapiens; identical to SEQ ID NO: 205077
  misc_feature: GYAE6OF01AUMHT.30.25.C03.1.454.CMB.1.raw
  modified_base (173)..(174): a, c, t, g, unknown or other
  misc_feature (173)..(174): n is a, c, g, or t

SEQ ID NO: 205238 - DNA, 175 bp, Homo sapiens; identical to SEQ ID NO: 205102
  misc_feature: GYAE6OF01D7WGC.30.25.C03.1.454.CMB.1.raw
  modified_base (173)..(175): a, c, t, g, unknown or other
  misc_feature (173)..(175): n is a, c, g, or t

SEQ ID NO: 205239 - DNA, 232 bp, Homo sapiens; identical to SEQ ID NO: 205198
  misc_feature: GYAE6OF01A8CTS.30.25.C03.1.454.CMB.1.raw
  modified_base (228)..(232): a, c, t, g, unknown or other
  misc_feature (228)..(232): n is a, c, g, or t

SEQ ID NO: 205240 - DNA, 238 bp, Homo sapiens
  misc_feature: GYAE6OF01EEAIB.30.25.C03.1.454.CMB.1.raw
  modified_base (234)..(238): a, c, t, g, unknown or other
  misc_feature (234)..(238): n is a, c, g, or t
tcagcacgctacgtcacgaccggtgctcgatttagtagtgtagatttgggtttgggtgcccaagctgctggagggcacggtcaccgtctcctcagcctccaccaagggcccatcggtcttccccctggcaccctcctccaagagcacctctgggggcacagcggccctgggctgcctggtcaaggactacttccacgtagcgtgctgaggcggtgtcggacgaggcacagtagnnnnn

SEQ ID NO: 205241 - DNA, 231 bp, Homo sapiens; identical to SEQ ID NO: 205128
  misc_feature: GYAE6OF01DFGZR.30.25.C03.1.454.CMB.1.raw
  modified_base (227)..(231): a, c, t, g, unknown or other
  misc_feature (227)..(231): n is a, c, g, or t

SEQ ID NO: 205242 - DNA, 234 bp, Homo sapiens
  misc_feature: GYAE6OF01CE4GZ.30.25.C03.1.454.CMB.1.raw
  modified_base (230)..(234): a, c, t, g, unknown or other
  misc_feature (230)..(234): n is a, c, g, or t
tcagcacgctacgtcacgaccggtgctcgatttagtagtgtagatttgggtttgggtgcccaagctgctggagggcacggtcaccgtctcctcagcctccaccaagggcccatcggtcttccccctggcaccctcctccaagagcacctctgggggcacagcggccctgggctgcctggtcaaggactacttccacgtagcgtgctgagcgggctggcaaggcgcatagnnnnn

SEQ ID NO: 205243 - DNA, 173 bp, Homo sapiens; identical to SEQ ID NO: 205084
  misc_feature: GYAE6OF01BE0ZN.30.25.C03.1.454.CMB.1.raw
  modified_base (173)..(173): a, c, t, g, unknown or other
  misc_feature (173)..(173): n is a, c, g, or t

SEQ ID NO: 205244 - DNA, 174 bp, Homo sapiens; identical to SEQ ID NO: 205077
  misc_feature: GYAE6OF01C5ABK.30.25.C03.1.454.CMB.1.raw
  modified_base (173)..(174): a, c, t, g, unknown or other
  misc_feature (173)..(174): n is a, c, g, or t

SEQ ID NO: 205245 - DNA, 232 bp, Homo sapiens; identical to SEQ ID NO: 205063
  misc_feature: GYAE6OF01DWU5Q.30.25.C03.1.454.CMB.1.raw
  modified_base (230)..(232): a, c, t, g, unknown or other
  misc_feature (230)..(232): n is a, c, g, or t

SEQ ID NO: 205246 - DNA, 155 bp, Homo sapiens; identical to SEQ ID NO: 205076
  misc_feature: GYAE6OF01BJWUZ.30.25.C03.1.454.CMB.1.raw
  modified_base (155)..(155): a, c, t, g, unknown or other
  misc_feature (155)..(155): n is a, c, g, or t

SEQ ID NO: 205247 - DNA, 232 bp, Homo sapiens; identical to SEQ ID NO: 205198
  misc_feature: GYAE6OF01CQUIG.30.25.C03.1.454.CMB.1.raw
  modified_base (228)..(232): a, c, t, g, unknown or other
  misc_feature (228)..(232): n is a, c, g, or t

SEQ ID NO: 205248 - DNA, 165 bp, Homo sapiens
  misc_feature: GYAE6OF01EF9AX.30.25.C03.1.454.CMB.1.raw
  modified_base (156)..(165): a, c, t, g, unknown or other
  misc_feature (156)..(165): n is a, c, g, or t
tcagcacgctacgtcacgaccggtgctcgatttagtagtgtagatttgggtttggggggaagaggaagactgacggtcctgccacagcggccctgggctgcctggtcaaggactacttccacgtagcgtgctgagcgggctggcaaggcgcatagnnnnnnnnnn

SEQ ID NO: 205249 - DNA, 162 bp, Homo sapiens
  misc_feature: GYAE6OF01ENUWS.30.25.C03.1.454.CMB.1.raw
  modified_base (154)..(162): a, c, t, g, unknown or other
  misc_feature (154)..(162): n is a, c, g, or t
tcagcacgctacgtcacgaccggtgctcgatttagtagtgtagatttgggtttgggggaagaggaagactgacggtcctgccacagcggccctgggctgcctggtcaaggactacttccacgtagcgtctgagcgggctggcaaggcgcatagnnnnnnnnn

SEQ ID NO: 205250 - DNA, 237 bp, Homo sapiens; identical to SEQ ID NO: 205230
  misc_feature: GYAE6OF01D4VNI.30.25.C03.1.454.CMB.1.raw
  modified_base (230)..(237): a, c, t, g, unknown or other
  misc_feature (230)..(237): n is a, c, g, or t

SEQ ID NO: 205251 - DNA, 175 bp, Homo sapiens; identical to SEQ ID NO: 205102
  misc_feature: GYAE6OF01BXVEM.30.25.C03.1.454.CMB.1.raw
  modified_base (173)..(175): a, c, t, g, unknown or other
  misc_feature (173)..(175): n is a, c, g, or t

SEQ ID NO: 205252 - DNA, 155 bp, Homo sapiens; identical to SEQ ID NO: 205076
  misc_feature: GYAE6OF01AJ9F4.30.25.C03.1.454.CMB.1.raw
  modified_base (155)..(155): a, c, t, g, unknown or other
  misc_feature (155)..(155): n is a, c, g, or t

SEQ ID NO: 205253 - DNA, 174 bp, Homo sapiens; identical to SEQ ID NO: 205077
  misc_feature: GYAE6OF01B8XTL.30.25.C03.1.454.CMB.1.raw
  modified_base (173)..(174): a, c, t, g, unknown or other
  misc_feature (173)..(174): n is a, c, g, or t

SEQ ID NO: 205254 - DNA, 173 bp, Homo sapiens; identical to SEQ ID NO: 205084
  misc_feature: GYAE6OF01EF7US.30.25.C03.1.454.CMB.1.raw
  modified_base (173)..(173): a, c, t, g, unknown or other
  misc_feature (173)..(173): n is a, c, g, or t

SEQ ID NO: 205255 - DNA, 231 bp, Homo sapiens; identical to SEQ ID NO: 205180
  misc_feature: GYAE6OF01BFGB4.30.25.C03.1.454.CMB.1.raw
  modified_base (229)..(231): a, c, t, g, unknown or other
  misc_feature (229)..(231): n is a, c, g, or t

SEQ ID NO: 205256 - DNA, 229 bp, Homo sapiens
  misc_feature: GYAE6OF01CVN85.30.25.C03.1.454.CMB.1.raw
  modified_base (227)..(229): a, c, t, g, unknown or other
  misc_feature (227)..(229): n is a, c, g, or t
tcagcacgctacgtcacgaccggtgctcgatttagtagtgtagatttgggtttgggtgcccaagctgctggagggcacggtcaccgtctcctcagcctccaccaagggcccatcggtcttcccctggcaccctcctccaagagcacctctggggcacagcggccctgggctgcctggtcaaggactacttccagtagcgtgctgagcgggctggcaaggcgcatagnnn

SEQ ID NO: 205257 - DNA, 154 bp, Homo sapiens
  misc_feature: GYAE6OF01BWSAW.30.25.C03.1.454.CMB.1.raw
  modified_base (154)..(154): a, c, t, g, unknown or other
  misc_feature (154)..(154): n is a, c, g, or t
tcagcacgctacgtcacgaccggtgctcgatttagtagtgtagatttgggtttgggggaagaggaagactgacggtcctgccacagcggccctgggctgcctggtcaggacgacttccacgtagcgtgctgagcgggctggcaaggcgcatagn

SEQ ID NO: 205258 - DNA, 246 bp, Homo sapiens
  misc_feature: GYAE6OF01B37OI.30.25.C03.1.454.CMB.1.raw
  modified_base (231)..(246): a, c, t, g, unknown or other
  misc_feature (231)..(246): n is a, c, g, or t
tcagcacgctacgtcacgaccggtgctcgatttagtagtgtagatttgggtttgggtgcccgaagctgctggagggcacggtcaccgtctcctcagcctccaccaagggcccatcggtcttccccctggcaccctcctccaagagcacctctgggggcacaggcggccctgggctgcctggtcaaggctacttccacgtagcgtgctgagcgggctggcaaggcgcatagnnnnnnnnnnnnnnnn

SEQ ID NO: 205259 - DNA, 229 bp, Homo sapiens; identical to SEQ ID NO: 205049
  misc_feature: GYAE6OF01CAB3N.30.25.C03.1.454.CMB.1.raw
  modified_base (228)..(229): a, c, t, g, unknown or other
  misc_feature (228)..(229): n is a, c, g, or t

SEQ ID NO: 205260 - DNA, 171 bp, Homo sapiens; identical to SEQ ID NO: 205048
  misc_feature: GYAE6OF01E1F7X.30.25.C03.1.454.CMB.1.raw
  modified_base (171)..(171): a, c, t, g, unknown or other
  misc_feature (171)..(171): n is a, c, g, or t

SEQ ID NO: 205261 - DNA, 155 bp, Homo sapiens; identical to SEQ ID NO: 205076
  misc_feature: GYAE6OF01C3AIK.30.25.C03.1.454.CMB.1.raw
  modified_base (155)..(155): a, c, t, g, unknown or other
  misc_feature (155)..(155): n is a, c, g, or t

SEQ ID NO: 205262 - DNA, 154 bp, Homo sapiens
  misc_feature: GYAE6OF01CR5XR.30.25.C03.1.454.CMB.1.raw
  modified_base (154)..(154): a, c, t, g, unknown or other
  misc_feature (154)..(154): n is a, c, g, or t
tcagcacgctacgtcacgaccggtgctcgatttagtagtgtagatttgggtttgggggaagaggaagactgacggtcctgccacagcggccctgggctgcctggtcaggactacttccacgtagcgtgctgagcgggctggcaaggcgcatagn

SEQ ID NO: 205263 - DNA, 233 bp, Homo sapiens; identical to SEQ ID NO: 205189
  misc_feature: GYAE6OF01EJRX0.30.25.C03.1.454.CMB.1.raw
  modified_base (230)..(233): a, c, t, g, unknown or other
  misc_feature (230)..(233): n is a, c, g, or t

SEQ ID NO: 205264 - DNA, 179 bp, Homo sapiens
  misc_feature: GYAE6OF01CASGF.30.25.C03.1.454.CMB.1.raw
  modified_base (173)..(179): a, c, t, g, unknown or other
  misc_feature (173)..(179): n is a, c, g, or t
tcagcacgctacgtcacgaccggtgctcgatttagtagtgtagatttgggtttgggggaagaggaagactgacggtcccccaggagttcaggtgctgggcacagcggccctgggctgcctggtcaaggactacttccacgtagcgtgctgagcgggctggcaaggcgcatagnnnnnnn

SEQ ID NO: 205265 - DNA, 233 bp, Homo sapiens; identical to SEQ ID NO: 205189
  misc_feature: GYAE6OF01A4BRC.30.25.C03.1.454.CMB.1.raw
  modified_base (230)..(233): a, c, t, g, unknown or other
  misc_feature (230)..(233): n is a, c, g, or t

SEQ ID NO: 205266 - DNA, 156 bp, Homo sapiens; identical to SEQ ID NO: 205094
  misc_feature: GYAE6OF01EJRTI.30.25.C03.1.454.CMB.1.raw
  modified_base (155)..(156): a, c, t, g, unknown or other
  misc_feature (155)..(156): n is a, c, g, or t

SEQ ID NO: 205267 - DNA, 160 bp, Homo sapiens
  misc_feature: GYAE6OF01EEZS8.30.25.C03.1.454.CMB.1.raw
  modified_base (155)..(160): a, c, t, g, unknown or other
  misc_feature (155)..(160): n is a, c, g, or t
tcagcacgctacgtcacgaccggtgctcgatttagtagtgtagatttgggtttgggggaagaggaagactgacggtcctgccacagcggccctgggctgcctggtcaaggactacttccacgtagcgtgctgagcgggctggcaaggcgcatagnnnnnn

SEQ ID NO: 205268 - DNA, 155 bp, Homo sapiens; identical to SEQ ID NO: 205076
  misc_feature: GYAE6OF01DF3XQ.30.25.C03.1.454.CMB.1.raw
  modified_base (155)..(155): a, c, t, g, unknown or other
  misc_feature (155)..(155): n is a, c, g, or t

SEQ ID NO: 205269 - DNA, 231 bp, Homo sapiens; identical to SEQ ID NO: 205120
  misc_feature: GYAE6OF01APO92.30.25.C03.1.454.CMB.1.raw
  modified_base (230)..(231): a, c, t, g, unknown or other
  misc_feature (230)..(231): n is a, c, g, or t

SEQ ID NO: 205270 - DNA, 155 bp, Homo sapiens; identical to SEQ ID NO: 205076
  misc_feature: GYAE6OF01BM8XC.30.25.C03.1.454.CMB.1.raw
  modified_base (155)..(155): a, c, t, g, unknown or other
  misc_feature (155)..(155): n is a, c, g, or t

SEQ ID NO: 205271 - DNA, 173 bp, Homo sapiens; identical to SEQ ID NO: 205084
  misc_feature: GYAE6OF01EM1W4.30.25.C03.1.454.CMB.1.raw
  modified_base (173)..(173): a, c, t, g, unknown or other
  misc_feature (173)..(173): n is a, c, g, or t

SEQ ID NO: 205272 - DNA, 155 bp, Homo sapiens; identical to SEQ ID NO: 205076
  misc_feature: GYAE6OF01EZ12E.30.25.C03.1.454.CMB.1.raw
  modified_base (155)..(155): a, c, t, g, unknown or other
  misc_feature (155)..(155): n is a, c, g, or t

SEQ ID NO: 205273 - DNA, 155 bp, Homo sapiens; identical to SEQ ID NO: 205076
  misc_feature: GYAE6OF01C603N.30.25.C03.1.454.CMB.1.raw
  modified_base (155)..(155): a, c, t, g, unknown or other
  misc_feature (155)..(155): n is a, c, g, or t

SEQ ID NO: 205274 - DNA, 174 bp, Homo sapiens
  misc_feature: GYAE6OF01BGIUW.30.25.C03.1.454.CMB.1.raw
  modified_base (172)..(174): a, c, t, g, unknown or other
  misc_feature (172)..(174): n is a, c, g, or t
tcagcacgctacgtcacgaccggtgctcgatttagtagtgtagatttgggttgggggaagaggaagactgacggtcccccaggagttcaggtgctgggcacagcggccctgggctgcttggtcaaggactacttccacgtagcgtgctgagcgggctggcaaggcgcatagnnn

SEQ ID NO: 205275 - DNA, 173 bp, Homo sapiens; identical to SEQ ID NO: 205084
  misc_feature: GYAE6OF01EE9BA.30.25.C03.1.454.CMB.1.raw
  modified_base (173)..(173): a, c, t, g, unknown or other
  misc_feature (173)..(173): n is a, c, g, or t

SEQ ID NO: 205276 - DNA, 274 bp, Homo sapiens
  misc_feature: GYAE6OF01BCK0C.30.25.C03.1.454.CMB.1.raw
  modified_base (232)..(274): a, c, t, g, unknown or other
  misc_feature (232)..(274): n is a, c, g, or t
tcagcacgctacgtcacgaccggtgctcgatttagtagtgtagatttgggtttgggtggcccaagctgctggagggccacggtccaccgtctcctcacgcctccaccaagggcccatcggtcttccccctggcaccctctccaagacgcacctctgggggcacagcggcctgggctgcctggtcaaggctactccacgtagcgtgctgaggcgggctggccaggcgcatagnnnnnnnnnnnnnnnnnnnnnnnnnnnnnnnnnnnnnnnnnnn

SEQ ID NO: 205277 - DNA, 155 bp, Homo sapiens; identical to SEQ ID NO: 205076
  misc_feature: GYAE6OF01DKSSL.30.25.C03.1.454.CMB.1.raw
  modified_base (155)..(155): a, c, t, g, unknown or other
  misc_feature (155)..(155): n is a, c, g, or t

SEQ ID NO: 205278 - DNA, 232 bp, Homo sapiens; identical to SEQ ID NO: 205063
  misc_feature: GYAE6OF01A4Y9Y.30.25.C03.1.454.CMB.1.raw
  modified_base (230)..(232): a, c, t, g, unknown or other
  misc_feature (230)..(232): n is a, c, g, or t

SEQ ID NO: 205279 - DNA, 234 bp, Homo sapiens; identical to SEQ ID NO: 205242
  misc_feature: GYAE6OF01DLYQY.30.25.C03.1.454.CMB.1.raw
  modified_base (230)..(234): a, c, t, g, unknown or other
  misc_feature (230)..(234): n is a, c, g, or t

SEQ ID NO: 205280 - DNA, 233 bp, Homo sapiens; identical to SEQ ID NO: 205189
  misc_feature: GYAE6OF01AGOA0.30.25.C03.1.454.CMB.1.raw
  modified_base (230)..(233): a, c, t, g, unknown or other
  misc_feature (230)..(233): n is a, c, g, or t

SEQ ID NO: 205281 - DNA, 156 bp, Homo sapiens; identical to SEQ ID NO: 205094
  misc_feature: GYAE6OF01A0NF3.30.25.C03.1.454.CMB.1.raw
  modified_base (155)..(156): a, c, t, g, unknown or other
  misc_feature (155)..(156): n is a, c, g, or t

SEQ ID NO: 205282 - DNA, 167 bp, Homo sapiens
  misc_feature: GYAE6OF01CKD48.30.25.C03.1.454.CMB.1.raw
  modified_base (155)..(167): a, c, t, g, unknown or other
  misc_feature (155)..(167): n is a, c, g, or t
tcagcacgctacgtcacgaccggtgctcgatttagtagtgtagatttgggtttgggggaagaggaagactgacggtcctgccacagcggccctgggctgcctggtcaaggactacttccacgtagcgtgctgagcgggctggcaaggcgcatagnnnnnnnnnnnnn

SEQ ID NO: 205283 - DNA, 232 bp, Homo sapiens; identical to SEQ ID NO: 205063
  misc_feature: GYAE6OF01E2NBT.30.25.C03.1.454.CMB.1.raw
  modified_base (230)..(232): a, c, t, g, unknown or other
  misc_feature (230)..(232): n is a, c, g, or t

SEQ ID NO: 205284 - DNA, 173 bp, Homo sapiens; identical to SEQ ID NO: 205084
  misc_feature: GYAE6OF01BS739.30.25.C03.1.454.CMB.1.raw
  modified_base (173)..(173): a, c, t, g, unknown or other
  misc_feature (173)..(173): n is a, c, g, or t

SEQ ID NO: 205285 - DNA, 232 bp, Homo sapiens; identical to SEQ ID NO: 205063
  misc_feature: GYAE6OF01DUUOA.30.25.C03.1.454.CMB.1.raw
  modified_base (230)..(232): a, c, t, g, unknown or other
  misc_feature (230)..(232): n is a, c, g, or t

SEQ ID NO: 205286 - DNA, 243 bp, Homo sapiens
  misc_feature: GYAE6OF01CREFF.30.25.C03.1.454.CMB.1.raw
  modified_base (230)..(243): a, c, t, g, unknown or other
  misc_feature (230)..(243): n is a, c, g, or t
tcagcacgctacgtcacgaccggtgctcgatttagtagtgtagatttgggtttgggtgcccaagctgctggagggcacggtcaccgtctcctcagcctccaccaagggcccatcggtcttcccctggcaccctcctccaagagcacctctgggggcacagcggccctgggctgcctggtcaaaggactacttccacgtagcgtgctgagcgggctggcaaggcgcatagnnnnnnnnnnnnnn

SEQ ID NO: 205287 - DNA, 155 bp, Homo sapiens; identical to SEQ ID NO: 205076
  misc_feature: GYAE6OF01EZBDE.30.25.C03.1.454.CMB.1.raw
  modified_base (155)..(155): a, c, t, g, unknown or other
  misc_feature (155)..(155): n is a, c, g, or t

SEQ ID NO: 205288 - DNA, 239 bp, Homo sapiens
  misc_feature: GYAE6OF01BJLQ0.30.25.C03.1.454.CMB.1.raw
  modified_base (229)..(239): a, c, t, g, unknown or other
  misc_feature (229)..(239): n is a, c, g, or t
tcagcacgctacgtcacgaccggtgctcgatttagtagtgtagatttgggtttgggtgcccaagctgctggagggcacggtcaccgtctcctcagcctccaccaagggcccatcggtcttcccctggcaccctcctccaagagcacctctgggggcacagcggccctgggctgcctggtcaaggactacttccacgtagcgtgctgagcgggctggcaaggcgcatagnnnnnnnnnnn

SEQ ID NO: 205289 - DNA, 174 bp, Homo sapiens; identical to SEQ ID NO: 205077
  misc_feature: GYAE6OF01DYTHW.30.25.C03.1.454.CMB.1.raw
  modified_base (173)..(174): a, c, t, g, unknown or other
  misc_feature (173)..(174): n is a, c, g, or t

SEQ ID NO: 205290 - DNA, 290 bp, Homo sapiens
  misc_feature: GYAE6OF01EFNI9.30.25.C03.1.454.CMB.1.raw
  modified_base (235)..(290): a, c, t, g, unknown or other
  misc_feature (235)..(290): n is a, c, g, or t
tcagcacgctacgtcacgaccggtgctcgatttagtagtgtagatttgggtttgggttggcccaagtctgctggagggtcacggtcaccggtctcctcagcctccaccaagggcccatcgtcttcccctggcacctctcaagagcacctctggggcacagcggccctagggctcgacctggtcaagtactacttccacgtagcgtgctggacgcgggctggcaacggcgcatagnnnnnnnnnnnnnnnnnnnnnnnnnnnnnnnnnnnnnnnnnnnnnnnnnnnnnnnn

SEQ ID NO: 205291 - DNA, 234 bp, Homo sapiens; identical to SEQ ID NO: 205242
  misc_feature: GYAE6OF01CD6PQ.30.25.C03.1.454.CMB.1.raw
  modified_base (230)..(234): a, c, t, g, unknown or other
  misc_feature (230)..(234): n is a, c, g, or t

SEQ ID NO: 205292 - DNA, 232 bp, Homo sapiens; identical to SEQ ID NO: 205198
  misc_feature: GYAE6OF01CHYSX.30.25.C03.1.454.CMB.1.raw
  modified_base (228)..(232): a, c, t, g, unknown or other
  misc_feature (228)..(232): n is a, c, g, or t

SEQ ID NO: 205293 - DNA, 174 bp, Homo sapiens; identical to SEQ ID NO: 205077
  misc_feature: GYAE6OF01CMZ9D.30.25.C03.1.454.CMB.1.raw
  modified_base (173)..(174): a, c, t, g, unknown or other
  misc_feature (173)..(174): n is a, c, g, or t

SEQ ID NO: 205294 - DNA, 175 bp, Homo sapiens; identical to SEQ ID NO: 205102
  misc_feature: GYAE6OF01DR5AG.30.25.C03.1.454.CMB.1.raw
  modified_base (173)..(175): a, c, t, g, unknown or other
  misc_feature (173)..(175): n is a, c, g, or t

SEQ ID NO: 205295 - DNA, 234 bp, Homo sapiens; identical to SEQ ID NO: 205242
  misc_feature: GYAE6OF01DKAD1.30.25.C03.1.454.CMB.1.raw
  modified_base (230)..(234): a, c, t, g, unknown or other
  misc_feature (230)..(234): n is a, c, g, or t

SEQ ID NO: 205296 - DNA, 270 bp, Homo sapiens
  misc_feature: GYAE6OF01DBHYW.30.25.C03.1.454.CMB.1.raw
  modified_base (222)..(222): a, c, t, g, unknown or other
  misc_feature (222)..(222): n is a, c, g, or t
  modified_base (230)..(270): a, c, t, g, unknown or other
  misc_feature (230)..(270): n is a, c, g, or t
tcagcacgctacgtcacgaccggtgctcgatttagtagtgtagatttgggtttgggtgcccaagctgctggaggcacggtcaccgtctcctcagcctccaccaagggcccatcggtcttccccctggcaccctcctccaagagcactctggggcacagcggcctgggctgccttggcaaggactacttccacgtagcgtgctgagcgggatggcgaagggcncatagcgnnnnnnnnnnnnnnnnnnnnnnnnnnnnnnnnnnnnnnnnn

SEQ ID NO: 205297 - DNA, 180 bp, Homo sapiens
  misc_feature: GYAE6OF01A3NRL.30.25.C03.1.454.CMB.1.raw
  modified_base (174)..(180): a, c, t, g, unknown or other
  misc_feature (174)..(180): n is a, c, g, or t
tcagcacgctacgtcacgaccggtgctcgatttagtagtgtagatttgggtttgggggaagaggaagactgaccggtcccccaggagttcaggtgctgggcacagcggccctgggctgcctggtcaaggactacttccacgtagcgtgctgagcgggctggcaaggcgcatagnnnnnnn

SEQ ID NO: 205298 - DNA, 156 bp, Homo sapiens
  misc_feature: GYAE6OF01BSE8E.30.25.C03.1.454.CMB.1.raw
  modified_base (156)..(156): a, c, t, g, unknown or other
  misc_feature (156)..(156): n is a, c, g, or t
tcagcacgctacgtcacgaccggtgctcgatttagtagtgtagatttgggtttgggggaagaggaagactgacggtcctgccacagcggccctgggctgcctggtcaaggactacttccacgtagcgtgctgaggcgggctggcaaggcgcatagn

SEQ ID NO: 205299 - DNA, 232 bp, Homo sapiens; identical to SEQ ID NO: 205063
  misc_feature: GYAE6OF01ELAF2.30.25.C03.1.454.CMB.1.raw
  modified_base (230)..(232): a, c, t, g, unknown or other
  misc_feature (230)..(232): n is a, c, g, or t

SEQ ID NO: 205300 - DNA, 235 bp, Homo sapiens
  misc_feature: GYAE6OF01EYDCY.30.25.C03.1.454.CMB.1.raw
  modified_base (232)..(235): a, c, t, g, unknown or other
  misc_feature (232)..(235): n is a, c, g, or t
tcagcacgctacgtcacgaccggtgctcgatttagtagtgtagatttgggtttgggtgcccaagctgctggagggcacggtcaccgtctcctcagcctccaccaagggcccatcggtcttccccctggcacccctcctccaagagcacctcgtgggggcacagcggccctgggctgcctggtcaaggactacttccacgtagcgtgctgagcgggctggcaaggcgcatagnnnn

SEQ ID NO: 205301 - DNA, 233 bp, Homo sapiens; identical to SEQ ID NO: 205189
  misc_feature: GYAE6OF01EH6VV.30.25.C03.1.454.CMB.1.raw
  modified_base (230)..(233): a, c, t, g, unknown or other
  misc_feature (230)..(233): n is a, c, g, or t

SEQ ID NO: 205302 - DNA, 176 bp, Homo sapiens; identical to SEQ ID NO: 205124
  misc_feature: GYAE6OF01B8JN1.30.25.C03.1.454.CMB.1.raw
  modified_base (173)..(176): a, c, t, g, unknown or other
  misc_feature (173)..(176): n is a, c, g, or t

SEQ ID NO: 205303 - DNA, 234 bp, Homo sapiens; identical to SEQ ID NO: 205242
  misc_feature: GYAE6OF01A2VLS.30.25.C03.1.454.CMB.1.raw
  modified_base (230)..(234): a, c, t, g, unknown or other
  misc_feature (230)..(234): n is a, c, g, or t

SEQ ID NO: 205304 - DNA, 233 bp, Homo sapiens; identical to SEQ ID NO: 205189
  misc_feature: GYAE6OF01BC8XE.30.25.C03.1.454.CMB.1.raw
  modified_base (230)..(233): a, c, t, g, unknown or other
  misc_feature (230)..(233): n is a, c, g, or t

SEQ ID NO: 205305 - DNA, 233 bp, Homo sapiens
  misc_feature: GYAE6OF01BBCYT.30.25.C03.1.454.CMB.1.raw
  modified_base (230)..(233): a, c, t, g, unknown or other
  misc_feature (230)..(233): n is a, c, g, or t
tcagcacgctacgtcacgaccggtgctcgatttagtagtgtagatttgggtttgggtgcccaagctgctggagggcacggtcaccgtctcctcagcctccaccaagggcccatcggtcttccccctggcaccctcctccaagagcacctctgggggcacagcggccctgggctgcctggtcaaggaatacttccacgtagcgtgctgagcgggctggcaaggcgcatagnnnn

SEQ ID NO: 205306 - DNA, 231 bp, Homo sapiens; identical to SEQ ID NO: 205061
  misc_feature: GYAE6OF01C1WF6.30.25.C03.1.454.CMB.1.raw
  modified_base (228)..(231): a, c, t, g, unknown or other
  misc_feature (228)..(231): n is a, c, g, or t

SEQ ID NO: 205307 - DNA, 241 bp, Homo sapiens
  misc_feature: GYAE6OF01COK81.30.25.C03.1.454.CMB.1.raw
  modified_base (228)..(241): a, c, t, g, unknown or other
  misc_feature (228)..(241): n is a, c, g, or t
tcagcacgctacgtcacgaccggtgctcgatttagtagtgtagatttgggtttgggtgcccaagctgctggagggcacggtcaccgtctcctcagcctccaccaagggcccatcggtcttcccctggcaccctcctccaagagcacctctggggcacagcggccctgggctgcctggtcaaggactacttccacgtagcgtgctgagcgggctggcaaggcgcatagnnnnnnnnnnnnnn

SEQ ID NO: 205308 - DNA, 174 bp, Homo sapiens
  misc_feature: GYAE6OF01C57I7.30.25.C03.1.454.CMB.1.raw
  modified_base (173)..(174): a, c, t, g, unknown or other
  misc_feature (173)..(174): n is a, c, g, or t
tcagcacgctacgtcacgaccggtgctcgatttagtagtgtagatttgggtttgggggaagaggaagactgacggtcccccaggagttcaggtgctgggcacagcggccctgggctgcttggtcaaggactacttccacgtagcgtgctgagcgggctggcaaggcgcatagnn

SEQ ID NO: 205309 - DNA, 155 bp, Homo sapiens; identical to SEQ ID NO: 205076
  misc_feature: GYAE6OF01EMJPZ.30.25.C03.1.454.CMB.1.raw
  modified_base (155)..(155): a, c, t, g, unknown or other
  misc_feature (155)..(155): n is a, c, g, or t

SEQ ID NO: 205310 - DNA, 233 bp, Homo sapiens; identical to SEQ ID NO: 205189
  misc_feature: GYAE6OF01EAWS5.30.25.C03.1.454.CMB.1.raw
  modified_base (230)..(233): a, c, t, g, unknown or other
  misc_feature (230)..(233): n is a, c, g, or t

SEQ ID NO: 205311 - DNA, 175 bp, Homo sapiens; identical to SEQ ID NO: 205102
  misc_feature: GYAE6OF01C9UOI.30.25.C03.1.454.CMB.1.raw
  modified_base (173)..(175): a, c, t, g, unknown or other
  misc_feature (173)..(175): n is a, c, g, or t

SEQ ID NO: 205312 - DNA, 155 bp, Homo sapiens; identical to SEQ ID NO: 205076
  misc_feature: GYAE6OF01EN3FV.30.25.C03.1.454.CMB.1.raw
  modified_base (155)..(155): a, c, t, g, unknown or other
  misc_feature (155)..(155): n is a, c, g, or t

SEQ ID NO: 205313 - DNA, 233 bp, Homo sapiens; identical to SEQ ID NO: 205207
  misc_feature: GYAE6OF01BYR45.30.25.C03.1.454.CMB.1.raw
  modified_base (229)..(233): a, c, t, g, unknown or other
  misc_feature (229)..(233): n is a, c, g, or t

SEQ ID NO: 205314 - DNA, 172 bp, Homo sapiens
  misc_feature: GYAE6OF01BJXRO.30.25.C03.1.454.CMB.1.raw
  modified_base (170)..(172): a, c, t, g, unknown or other
  misc_feature (170)..(172): n is a, c, g, or t
tcagcacgctacgtcacgaccggtgctcgatttagtagtgtagatttgggtttgggaagaggaagactgacggtccccaggagttcaggtgctgggcacagcggccctgggctgcctggtcaaggactacttccacgtagcgtgctgagcgggctggcaaggcgcatagnnn

SEQ ID NO: 205315 - DNA, 173 bp, Homo sapiens; identical to SEQ ID NO: 205084
  misc_feature: GYAE6OF01BFGOD.30.25.C03.1.454.CMB.1.raw
  modified_base (173)..(173): a, c, t, g, unknown or other
  misc_feature (173)..(173): n is a, c, g, or t

SEQ ID NO: 205316 - DNA, 241 bp, Homo sapiens
  misc_feature: GYAE6OF01DCQ9D.30.25.C03.1.454.CMB.1.raw
  modified_base (229)..(241): a, c, t, g, unknown or other
  misc_feature (229)..(241): n is a, c, g, or t
tcagcacgctacgtcacgaccggtgctcgatttagtagtgtagatttgggtttgggtgcccaagctgctggagggcacggtcaccgtctcctcagcctccaccaagggcccatcggtcttccccctggcaccctcctccaagagcacctctggggcacagcggccctgggctgcctggtcaaggactacttccacgtagcgtgctgagcgggctggcaaggcgcatagnnnnnnnnnnnnn

SEQ ID NO: 205317 - DNA, 166 bp, Homo sapiens
  misc_feature: GYAE6OF01BO1FV.30.25.C03.1.454.CMB.1.raw
  modified_base (157)..(166): a, c, t, g, unknown or other
  misc_feature (157)..(166): n is a, c, g, or t
tcagcacgctacgtcacgaccggtgctcgatttagtagtgtagatttgggtttgggggaaggaggaaggactgacggtcctgccacagcggccctgggctgcctggtcaaggactacttccacgtagcgtgctgagcgggctggcaaggcgcatagnnnnnnnnnn

SEQ ID NO: 205318 - DNA, 235 bp, Homo sapiens
  misc_feature: GYAE6OF01BGQQY.30.25.C03.1.454.CMB.1.raw
  modified_base (230)..(235): a, c, t, g, unknown or other
  misc_feature (230)..(235): n is a, c, g, or t
tcagcacgctacgtcacgaccggtgctcgatttagtagtgtagatttgggtttgggtgcccaagctgctggagggcacggtcaccgtctcctcagcctccaccaagggcccatcggtcttccccctggcaccctcctccaagagcacctctgggggcacagcggccctgggctgcctggtcaaggactacttccacgtagcgtgctgagcgggctggcaaggcgcatagnnnnnn

SEQ ID NO: 205319 - DNA, 232 bp, Homo sapiens; identical to SEQ ID NO: 205123
  misc_feature: GYAE6OF01C51BB.30.25.C03.1.454.CMB.1.raw
  modified_base (229)..(232): a, c, t, g, unknown or other
  misc_feature (229)..(232): n is a, c, g, or t

SEQ ID NO: 205320 - DNA, 251 bp, Homo sapiens
  misc_feature: GYAE6OF01DJLOW.30.25.C03.1.454.CMB.1.raw
  modified_base (231)..(251): a, c, t, g, unknown or other
  misc_feature (231)..(251): n is a, c, g, or t
tcagcacgctacgtcacgaccggtgctcgatttagtagtgtagatttgggtttgggtgcccaagctgctggagggcacggtcaccgtctcctcagcctccaccaagggcccatcggtcttccccctggcaccctcctccaagagcacctcgtgggggcacagcggccctgggctgcctggtcaaggactacttccacgtagcgtgctgagcgggctggcaaggcgcatagnnnnnnnnnnnnnnnnnnnnn

SEQ ID NO: 205321 - DNA, 251 bp, Homo sapiens
  misc_feature: GYAE6OF01EE2JF.30.25.C03.1.454.CMB.1.raw
  modified_base (231)..(251): a, c, t, g, unknown or other
  misc_feature (231)..(251): n is a, c, g, or t
tcagcacgctacgtcacgaccggtgctcgatttagtagtgtagatttgggtttgggtgcccaagtctgctggagggcacggtcaccgtctcctcagcctccaccaagggcccatcggtcttcccctggcaccctcctccaagagcacctctgggggcacagcggccctagggctgcctggtcaaggactacttccacgtagcgtgctgagcgggctggcaaggcgcatagnnnnnnnnnnnnnnnnnnnnn

SEQ ID NO: 205322 - DNA, 231 bp, Homo sapiens; identical to SEQ ID NO: 205120
  misc_feature: GYAE6OF01D8KPI.30.25.C03.1.454.CMB.1.raw
  modified_base (230)..(231): a, c, t, g, unknown or other
  misc_feature (230)..(231): n is a, c, g, or t

SEQ ID NO: 205323 - DNA, 173 bp, Homo sapiens; identical to SEQ ID NO: 205084
  misc_feature: GYAE6OF01CH5JU.30.25.C03.1.454.CMB.1.raw
  modified_base (173)..(173): a, c, t, g, unknown or other
  misc_feature (173)..(173): n is a, c, g, or t

SEQ ID NO: 205324 - DNA, 154 bp, Homo sapiens; identical to SEQ ID NO: 205195
  misc_feature: GYAE6OF01DQF2R.30.25.C03.1.454.CMB.1.raw

SEQ ID NO: 205325 - DNA, 234 bp, Homo sapiens; identical to SEQ ID NO: 205242
  misc_feature: GYAE6OF01AKSVO.30.25.C03.1.454.CMB.1.raw
  modified_base (230)..(234): a, c, t, g, unknown or other
  misc_feature (230)..(234): n is a, c, g, or t

SEQ ID NO: 205326 - DNA, 177 bp, Homo sapiens; identical to SEQ ID NO: 205232
  misc_feature: GYAE6OF01A04A3.30.25.C03.1.454.CMB.1.raw
  modified_base (173)..(177): a, c, t, g, unknown or other
  misc_feature (173)..(177): n is a, c, g, or t

SEQ ID NO: 205327 - DNA, 187 bp, Homo sapiens
  misc_feature: GYAE6OF01A5555.30.25.C03.1.454.CMB.1.raw
  modified_base (174)..(187): a, c, t, g, unknown or other
  misc_feature (174)..(187): n is a, c, g, or t
tcagcacgctacgtcacgaccggtgctcgatttagtagtgtagatttgggtttggggggaagaggaagactgacggtcccccaggagttcaggtgctgggcacagcggccctgggctgcctggtcaaggactacttccacgtagcgtgctgagcgggctggcaaggcgcatagnnnnnnnnnnnnnn

SEQ ID NO: 205328 - DNA, 233 bp, Homo sapiens; identical to SEQ ID NO: 205189
  misc_feature: GYAE6OF01EL48L.30.25.C03.1.454.CMB.1.raw
  modified_base (230)..(233): a, c, t, g, unknown or other
  misc_feature (230)..(233): n is a, c, g, or t

SEQ ID NO: 205329 - DNA, 156 bp, Homo sapiens; identical to SEQ ID NO: 205094
  misc_feature: GYAE6OF01DBZMH.30.25.C03.1.454.CMB.1.raw
  modified_base (155)..(156): a, c, t, g, unknown or other
  misc_feature (155)..(156): n is a, c, g, or t

SEQ ID NO: 205330 - DNA, 505 bp, Homo sapiens
  misc_feature: GYAE6OF01AMAE4.30.25.C03.1.454.CMB.1.raw
  modified_base (181)..(181): a, c, t, g, unknown or other
  misc_feature (181)..(181): n is a, c, g, or t
  modified_base (183)..(183): a, c, t, g, unknown or other
  misc_feature (183)..(183): n is a, c, g, or t
  modified_base (186)..(188): a, c, t, g, unknown or other
  misc_feature (186)..(188): n is a, c, g, or t
  modified_base (190)..(190): a, c, t, g, unknown or other
  misc_feature (190)..(190): n is a, c, g, or t
  modified_base (192)..(194): a, c, t, g, unknown or other
  misc_feature (192)..(194): n is a, c, g, or t
  modified_base (196)..(197): a, c, t, g, unknown or other
  misc_feature (196)..(197): n is a, c, g, or t
  modified_base (202)..(202): a, c, t, g, unknown or other
  misc_feature (202)..(202): n is a, c, g, or t
  modified_base (205)..(205): a, c, t, g, unknown or other
  misc_feature (205)..(205): n is a, c, g, or t
  modified_base (209)..(209): a, c, t, g, unknown or other
  misc_feature (209)..(209): n is a, c, g, or t
  modified_base (212)..(213): a, c, t, g, unknown or other
  misc_feature (212)..(213): n is a, c, g, or t
  modified_base (215)..(215): a, c, t, g, unknown or other
  misc_feature (215)..(215): n is a, c, g, or t
  modified_base (217)..(220): a, c, t, g, unknown or other
  misc_feature (217)..(220): n is a, c, g, or t
  modified_base (222)..(222): a, c, t, g, unknown or other
  misc_feature (222)..(222): n is a, c, g, or t
  modified_base (224)..(224): a, c, t, g, unknown or other
  misc_feature (224)..(224): n is a, c, g, or t
  modified_base (227)..(227): a, c, t, g, unknown or other
  misc_feature (227)..(227): n is a, c, g, or t
  modified_base (232)..(232): a, c, t, g, unknown or other
  misc_feature (232)..(232): n is a, c, g, or t
  modified_base (234)..(234): a, c, t, g, unknown or other
  misc_feature (234)..(234): n is a, c, g, or t
  modified_base (236)..(236): a, c, t, g, unknown or other
  misc_feature (236)..(236): n is a, c, g, or t
  modified_base (239)..(239): a, c, t, g, unknown or other
  misc_feature (239)..(239): n is a, c, g, or t
  modified_base (245)..(246): a, c, t, g, unknown or other
  misc_feature (245)..(246): n is a, c, g, or t
  modified_base (254)..(254): a, c, t, g, unknown or other
  misc_feature (254)..(254): n is a, c, g, or t
  modified_base (256)..(256): a, c, t, g, unknown or other
  misc_feature (256)..(256): n is a, c, g, or t
  modified_base (266)..(266): a, c, t, g, unknown or other
  misc_feature (266)..(266): n is a, c, g, or t
tcagcacgctacgtcacgaccggtgctcgatttagtagtgtagatttgggtttgggggaagaggaagactgacggtcccccgaggaggttcaggtgactgggcgactagcggccctcgggctgcctggttcaaggacttacttccacgtacgtgctgagcgggctgggcaaggcgcatagncntcnnncngnnncnngcagngcncatnacnnancnnnntntntcncacananantantgacannagagagancncactactctntatacgtgtctcgtcgctcgtcgtactactactctctcgcgcgcggtcgtcgacgtactctctctacacactcacgcacgcgcgcgacgacgtacgtagtagtgtagtactagttagtactcgtacgtacgactaactacttacttacttcgttcgtacttacgtcggtacggtacgacgaggtacgagtactaacgtacgtacgtacgtcgacgtacactactactatctcgtcgtac

SEQ ID NO: 205331 - DNA, 173 bp, Homo sapiens
  misc_feature: GYAE6OF01BBPVY.30.25.C03.1.454.CMB.1.raw
  modified_base (172)..(173): a, c, t, g, unknown or other
  misc_feature (172)..(173): n is a, c, g, or t
tcagcacgctacgtcacgaccggtgctcgatttagtagtgtagatttgggtttgggggaagaggaagactgacggtcccccaggagttcaggtgctgggcacagcggccctgggctgcctggtcaaggacacttccacgtagcgtgctgagcgggctggcaaggcgcatagnn

SEQ ID NO: 205332 - DNA, 236 bp, Homo sapiens
  misc_feature: GYAE6OF01BFT5X.30.25.C03.1.454.CMB.1.raw
  modified_base (229)..(236): a, c, t, g, unknown or other
  misc_feature (229)..(236): n is a, c, g, or t
tcagcacgctacgtcacgaccggtgctcgatttagtagtgtagatttgggtttgggtgcccaagctgctggagggcacggtcaccgtctcctcagcctccaccaagggcccatcggtcttccccctggcaccctcctccaagagcacctctggggcacagcggccctgggctgcctggtcaaggactacttccacgtagcgtgctgagcgggctggcaaggcgcatagnnnnnnnn

SEQ ID NO: 205333 - DNA, 274 bp, Homo sapiens
  misc_feature: GYAE6OF01CH2AK.30.25.C03.1.454.CMB.1.raw
  modified_base (230)..(231): a, c, t, g, unknown or other
  misc_feature (230)..(231): n is a, c, g, or t
  modified_base (233)..(244): a, c, t, g, unknown or other
  misc_feature (233)..(244): n is a, c, g, or t
  modified_base (246)..(248): a, c, t, g, unknown or other
  misc_feature (246)..(248): n is a, c, g, or t
  modified_base (250)..(274): a, c, t, g, unknown or other
  misc_feature (250)..(274): n is a, c, g, or t
tcagcacgctacgtcacgaccggtgctcgatttagtagtgtagatttgggtttgggtgcccaagctgctggagggcacggtcaccgtctcctcagcctccaccaagggcccatcggtcttccccctggcaccctcctccaagagcacctctgggggcacagcggccctgggctgcctggtcaaggactacttccacgtagcgtgctgagcgggctggcaaggcgcatagnngnnnnnnnnnnnngnnntnnnnnnnnnnnnnnnnnnnnnnnnn

SEQ ID NO: 205334 - DNA, 272 bp, Homo sapiens
  misc_feature: GYAE6OF01A9ZAG.30.25.C03.1.454.CMB.1.raw
  modified_base (237)..(238): a, c, t, g, unknown or other
  misc_feature (237)..(238): n is a, c, g, or t
  modified_base (240)..(272): a, c, t, g, unknown or other
  misc_feature (240)..(272): n is a, c, g, or t
tcagcacgctacgtcacgaccggtgctcgatttagtagtgtagatttgggtttgggtgcccaagctgctggagggcacggtcaccgtctcctccagcctccaccaagggcccatccggtcttccccctggcaccctcctccaacgagcacctctgggggcacagtcggccctgggctgccctggtcaaggactacttccacgtagcgtggctgagcgggcctggcaaggcgcatagnngnnnnnnnnnnnnnnnnnnnnnnnnnnnnnnnnn

SEQ ID NO: 205335 - DNA, 260 bp, Homo sapiens
  misc_feature: GYAE6OF01CDU7Y.30.25.C03.1.454.CMB.1.raw
  modified_base (230)..(260): a, c, t, g, unknown or other
  misc_feature (230)..(260): n is a, c, g, or t
tcagcacgctacgtcacgaccggtgctcgatttagtagtgtagatttgggtttgggtgcccaagctcgctggagggcacggtcaccgtctcctcagcctccaccaagggcccatcggtcttccccctggcaccctcctccaagagcacctctggggcacagcggccctgggctgcctggtcaaggactacttccacgtagcgtgctgagcgggctggcaaggcgcatagnnnnnnnnnnnnnnnnnnnnnnnnnnnnnnn

SEQ ID NO: 205336 - DNA, 231 bp, Homo sapiens; identical to SEQ ID NO: 205129
  misc_feature: GYAE6OF01CTD0H.30.25.C03.1.454.CMB.1.raw
  modified_base (229)..(231): a, c, t, g, unknown or other
  misc_feature (229)..(231): n is a, c, g, or t

SEQ ID NO: 205337 - DNA, 184 bp, Homo sapiens
  misc_feature: GYAE6OF01DIZNJ.30.25.C03.1.454.CMB.1.raw
  modified_base (173)..(184): a, c, t, g, unknown or other
  misc_feature (173)..(184): n is a, c, g, or t
tcagcacgctacgtcacgaccggtgctcgatttagtagtgtagatttgggtttgggggaagaggaagactgacggtcccccaggagttcaggtgctgggcacagcggccctgggctgcctggtaaaggactacttccacgtagcgtgctgagcgggctggcaaggcgcatagnnnnnnnnnnnn

SEQ ID NO: 205338 - DNA, 234 bp, Homo sapiens
  misc_feature: GYAE6OF01BPTNT.30.25.C03.1.454.CMB.1.raw
  modified_base (230)..(234): a, c, t, g, unknown or other
  misc_feature (230)..(234): n is a, c, g, or t
tcagcacgctacgtcacgaccggtgctcgatttagtagtgtagatttgggtttgggtgcccaagctgctggagggcacggtcaccgtctcctcagcctccaccaagggcccatcggtcttccccctggcaccctcctccaagagtacctcgtggggcacagcggccctgggctgcctggtcaaggactacttccacgtagcgtgctgagcgggctggcaaggcgcatagnnnnn

SEQ ID NO: 205339 - DNA, 157 bp, Homo sapiens; identical to SEQ ID NO: 205114
  misc_feature: GYAE6OF01CKBDU.30.25.C03.1.454.CMB.1.raw
  modified_base (155)..(157): a, c, t, g, unknown or other
  misc_feature (155)..(157): n is a, c, g, or t

SEQ ID NO: 205340 - DNA, 159 bp, Homo sapiens
  misc_feature: GYAE6OF01CCO6I.30.25.C03.1.454.CMB.1.raw
  modified_base (155)..(159): a, c, t, g, unknown or other
  misc_feature (155)..(159): n is a, c, g, or t
tcagcacgctacgtcacgaccggtgctcgatttagtagtgtagatttgggtttgggggaagaggaagactgacggtcctgccacagcggccctgggctgcctggtcaaggactacttccacgtagcgtgctgagcgggctggcaaggcgcatagnnnnn

SEQ ID NO: 205341 - DNA, 173 bp, Homo sapiens; identical to SEQ ID NO: 205084
  misc_feature: GYAE6OF01AC7Y5.30.25.C03.1.454.CMB.1.raw
  modified_base (173)..(173): a, c, t, g, unknown or other
  misc_feature (173)..(173): n is a, c, g, or t

SEQ ID NO: 205342 - DNA, 183 bp, Homo sapiens
  misc_feature: GYAE6OF01CVJQZ.30.25.C03.1.454.CMB.1.raw
  modified_base (174)..(183): a, c, t, g, unknown or other
  misc_feature (174)..(183): n is a, c, g, or t
tcagcacgctacgtcacgaccggtgctcgatttagtagtgtagatttgggtttgggggaagaggaagactgaccggtcccccaggagttcaggtgctgggcacagcggccctgggctgcctggtcaaggactacttccacgtagcgtgctgagcgggctggcaaggcgcatagnnnnnnnnnn

SEQ ID NO: 205343 - DNA, 176 bp, Homo sapiens; identical to SEQ ID NO: 205124
  misc_feature: GYAE6OF01EIVXK.30.25.C03.1.454.CMB.1.raw
  modified_base (173)..(176): a, c, t, g, unknown or other
  misc_feature (173)..(176): n is a, c, g, or t

SEQ ID NO: 205344 - DNA, 231 bp, Homo sapiens; identical to SEQ ID NO: 205120
  misc_feature: GYAE6OF01A4DFG.30.25.C03.1.454.CMB.1.raw
  modified_base (230)..(231): a, c, t, g, unknown or other
  misc_feature (230)..(231): n is a, c, g, or t

SEQ ID NO: 205345 - DNA, 184 bp, Homo sapiens
  misc_feature: GYAE6OF01DYPVI.30.25.C03.1.454.CMB.1.raw
  modified_base (171)..(184): a, c, t, g, unknown or other
  misc_feature (171)..(184): n is a, c, g, or t
tcagcacgctacgtcacgaccggtgctcgatttagtagtgtagatttgggtttgggggaagaggaagactgacggtccccaggagttcaggtgctgggcacagcggccctggctgcctggtcaaggactacttccacgtagcgtgctgagcgggctggcaaggcgcatagnnnnnnnnnnnnnn

SEQ ID NO: 205346 - DNA, 231 bp, Homo sapiens; identical to SEQ ID NO: 205120
  misc_feature: GYAE6OF01BFJNY.30.25.C03.1.454.CMB.1.raw
  modified_base (230)..(231): a, c, t, g, unknown or other
  misc_feature (230)..(231): n is a, c, g, or t

SEQ ID NO: 205347 - DNA, 173 bp, Homo sapiens; identical to SEQ ID NO: 205084
  misc_feature: GYAE6OF01CC34W.30.25.C03.1.454.CMB.1.raw
  modified_base (173)..(173): a, c, t, g, unknown or other
  misc_feature (173)..(173): n is a, c, g, or t

SEQ ID NO: 205348 - DNA, 156 bp, Homo sapiens; identical to SEQ ID NO: 205094
  misc_feature: GYAE6OF01EVG9E.30.25.C03.1.454.CMB.1.raw
  modified_base (155)..(156): a, c, t, g, unknown or other
  misc_feature (155)..(156): n is a, c, g, or t

SEQ ID NO: 205349 - DNA, 165 bp, Homo sapiens
  misc_feature: GYAE6OF01CKO0N.30.25.C03.1.454.CMB.1.raw
  modified_base (159)..(165): a, c, t, g, unknown or other
  misc_feature (159)..(165): n is a, c, g, or t
tcagcacgctacgtcacgaccggtgctcgatttagtagtgtagatttgggtttgggggggaaaggaggaagactgacggtcctgccacagcggccctgggctgcctggtcaaggactacttccacgtagcgtgctgagcgggctggcaaggcgcatagnnnnnnn

SEQ ID NO: 205350 - DNA, 155 bp, Homo sapiens; identical to SEQ ID NO: 205076
  misc_feature: GYAE6OF01BUO1X.30.25.C03.1.454.CMB.1.raw
  modified_base (155)..(155): a, c, t, g, unknown or other
  misc_feature (155)..(155): n is a, c, g, or t

SEQ ID NO: 205351 - DNA, 232 bp, Homo sapiens
  misc_feature: GYAE6OF01CC0A9.30.25.C03.1.454.CMB.1.raw
  modified_base (226)..(232): a, c, t, g, unknown or other
  misc_feature (226)..(232): n is a, c, g, or t
tcagcacgctacgtcacgaccggtgctcgatttagtagtgtagatttgggtttgggtgcccaaggctgctggagggcacggtcaccgtctcctcagcctccaccaagggcccatcggtcttcccctggcaccctctccaagagcactctggggcacagcggcctgggctgcctggtcaaggactacttccacgtagcgtgctgagcgggctggcaaggcgcatagnnnnnnn

SEQ ID NO: 205352 - DNA, 237 bp, Homo sapiens; identical to SEQ ID NO: 205230
  misc_feature: GYAE6OF01BPMSU.30.25.C03.1.454.CMB.1.raw
  modified_base (230)..(237): a, c, t, g, unknown or other
  misc_feature (230)..(237): n is a, c, g, or t

SEQ ID NO: 205353 - DNA, 173 bp, Homo sapiens; identical to SEQ ID NO: 205084
  misc_feature: GYAE6OF01A5CL0.30.25.C03.1.454.CMB.1.raw
  modified_base (173)..(173): a, c, t, g, unknown or other
  misc_feature (173)..(173): n is a, c, g, or t

SEQ ID NO: 205354 - DNA, 190 bp, Homo sapiens; identical to SEQ ID NO: 205216
  misc_feature: GYAE6OF01A6IS1.30.25.C03.1.454.CMB.1.raw
  modified_base (173)..(190): a, c, t, g, unknown or other
  misc_feature (173)..(190): n is a, c, g, or t

SEQ ID NO: 205355 - DNA, 232 bp, Homo sapiens; identical to SEQ ID NO: 205063
  misc_feature: GYAE6OF01A34RW.30.25.C03.1.454.CMB.1.raw
  modified_base (230)..(232): a, c, t, g, unknown or other
  misc_feature (230)..(232): n is a, c, g, or t

SEQ ID NO: 205356 - DNA, 218 bp, Homo sapiens
  misc_feature: GYAE6OF01BO90L.30.25.C03.1.454.CMB.1.raw
  modified_base (171)..(171): a, c, t, g, unknown or other
  misc_feature (171)..(171): n is a, c, g, or t
  modified_base (177)..(218): a, c, t, g, unknown or other
  misc_feature (177)..(218): n is a, c, g, or t
tcagcacgctacgtcacgaccggtgctcgatttagtagtgtagatttgggtttgggggggaagaggaagactgacggtcccccaggagttcaggtgctgggcacgagcggccctgggctgcctggtccaaggactacttccacgtagcgtgctgagcgggctggcaaggcncatagnnnnnnnnnnnnnnnnnnnnnnnnnnnnnnnnnnnnnnnnnn

SEQ ID NO: 205357 - DNA, 235 bp, Homo sapiens; identical to SEQ ID NO: 205318
  misc_feature: GYAE6OF01A47TE.30.25.C03.1.454.CMB.1.raw
  modified_base (230)..(235): a, c, t, g, unknown or other
  misc_feature (230)..(235): n is a, c, g, or t

SEQ ID NO: 205358 - DNA, 174 bp, Homo sapiens; identical to SEQ ID NO: 205077
  misc_feature: GYAE6OF01EFNJ6.30.25.C03.1.454.CMB.1.raw
  modified_base (173)..(174): a, c, t, g, unknown or other
  misc_feature (173)..(174): n is a, c, g, or t

SEQ ID NO: 205359 - DNA, 173 bp, Homo sapiens
  misc_feature: GYAE6OF01CYD1W.30.25.C03.1.454.CMB.1.raw
  modified_base (172)..(173): a, c, t, g, unknown or other
  misc_feature (172)..(173): n is a, c, g, or t
tcagcacgctacgtcacgaccggtgctcgatttagtagtgtagatttgggtttgggggaagaggaagactgacggtcccccaggagttcaggtgctgggcacagcggccctgggctgcctggtcaagactacttccacgtagcgtgctgagcgggctggcaaggcgcatagnn

SEQ ID NO: 205360 - DNA, 202 bp, Homo sapiens
  misc_feature: GYAE6OF01BMZK1.30.25.C03.1.454.CMB.1.raw
  modified_base (177)..(202): a, c, t, g, unknown or other
  misc_feature (177)..(202): n is a, c, g, or t
tcagcacgctacgtcacgaccggtgctcgatttagtagtgtagatttgggtttggggggaagaaggaagacctgacggtcccccaggacgttcaggtgctgggcacagcggccctgggctgcctggtcaaggactacttccacgtagcgtgctgagcgggctggcaaggcgcatagnnnnnnnnnnnnnnnnnnnnnnnnnn

SEQ ID NO: 205361 - DNA, 188 bp, Homo sapiens
  misc_feature: GYAE6OF01CSS8G.30.25.C03.1.454.CMB.1.raw
  modified_base (174)..(188): a, c, t, g, unknown or other
  misc_feature (174)..(188): n is a, c, g, or t
tcagcacgctacgtcacgaccggtgctcgatttagtagtgtagatttgggttgggggaagagggaagactgacggtcccccaggagttcaggtgctgggcacagcggccctgggctggcctggtcaaggactacttccacgtagcgtgctgagcgggctggcaaggcgcatagnnnnnnnnnnnnnnn

SEQ ID NO: 205362 - DNA, 288 bp, Homo sapiens
  misc_feature: GYAE6OF01BKHZP.30.25.C03.1.454.CMB.1.raw
  modified_base (136)..(136): a, c, t, g, unknown or other
  misc_feature (136)..(136): n is a, c, g, or t
  modified_base (233)..(233): a, c, t, g, unknown or other
  misc_feature (233)..(233): n is a, c, g, or t
  modified_base (238)..(288): a, c, t, g, unknown or other
  misc_feature (238)..(288): n is a, c, g, or t
tcagcacgctacgtcacgaccggtgctcgattttagtagtgtagatttgggtttggggtaggcccgaagctggctgggaagggcacgggtcaccgtctcctcagcctcaccaacggcccatcgtccttcccctgcnccctcctcaagagcacctctgggggcaccagcggccctgggctgcctggtcaaggacctacttccacgtagcgtcgctgagcgggctgggcaaggcnatagnnnnnnnnnnnnnnnnnnnnnnnnnnnnnnnnnnnnnnnnnnnnnnnnnnn

SEQ ID NO: 205363 - DNA, 215 bp, Homo sapiens
  misc_feature: GYAE6OF01DD5G6.30.25.C03.1.454.CMB.1.raw
  modified_base (158)..(158): a, c, t, g, unknown or other
  misc_feature (158)..(158): n is a, c, g, or t
  modified_base (184)..(215): a, c, t, g, unknown or other
  misc_feature (184)..(215): n is a, c, g, or t
tcagcacgctacgtcacgaccggtgctcgatttagtagtgtagatttgggtttgggggaagaggaagacctgacggtccccccaggagttcaggtgctgggcacagccggccctgggctgccctgggtccaaggctacttccacgtagcgtgcctgancgggactgggcaaaggcgcaatagcnnnnnnnnnnnnnnnnnnnnnnnnnnnnnnnn

SEQ ID NO: 205364 - DNA, 232 bp, Homo sapiens; identical to SEQ ID NO: 205063
  misc_feature: GYAE6OF01DTCO4.30.25.C03.1.454.CMB.1.raw
  modified_base (230)..(232): a, c, t, g, unknown or other
  misc_feature (230)..(232): n is a, c, g, or t

SEQ ID NO: 205365 - DNA, 202 bp, Homo sapiens
  misc_feature: GYAE6OF01A9NUI.30.25.C03.1.454.CMB.1.raw
  modified_base (136)..(136): a, c, t, g, unknown or other
  misc_feature (136)..(136): n is a, c, g, or t
  modified_base (159)..(202): a, c, t, g, unknown or other
  misc_feature (159)..(202): n is a, c, g, or t
tcagcacgctacgtcacgaccggtgctcgatttagtagtgtagatttgggtttggggggaagaggaagactgacggtcctgccacagcggccctgggctgcctggtcaaggactattccacgtagcgtgcctggancgggctgggcaaggcgcataggnnnnnnnnnnnnnnnnnnnnnnnnnnnnnnnnnnnnnnnnnnnn

SEQ ID NO: 205366 - DNA, 195 bp, Homo sapiens
  misc_feature: GYAE6OF01BZ4D8.30.25.C03.1.454.CMB.1.raw
  modified_base (172)..(195): a, c, t, g, unknown or other
  misc_feature (172)..(195): n is a, c, g, or t
tcagcacgctacgtcacgaccggtgctcgatttagtagtgtagatttgggtttgggggaagaggaagactgacggtccccaggagttcaggtgctgggcacagcggccctgggctgcctggtcaaggactacttccacgtagcgtgctgagcgggctggcaaggcgcatagnnnnnnnnnnnnnnnnnnnnnnnn

SEQ ID NO: 205367 - DNA, 212 bp, Homo sapiens
  misc_feature: GYAE6OF01DNRXT.30.25.C03.1.454.CMB.1.raw
  modified_base (184)..(212): a, c, t, g, unknown or other
  misc_feature (184)..(212): n is a, c, g, or t
tcagcacgctacgtcacgaccggtgctcgatttagtagtgtagatttgggtttggggggaaggaggaagactgacggtccccccaggagttcgaggtgctcgggcgacagcggccctgggctgcctgggtcaagggactacgttccacggtagcgtgctggagcgggctggcaaggcgcatagnnnnnnnnnnnnnnnnnnnnnnnnnnnnn

SEQ ID NO: 205368 - DNA, 233 bp, Homo sapiens; identical to SEQ ID NO: 205189
  misc_feature: GYAE6OF01ED46X.30.25.C03.1.454.CMB.1.raw
  modified_base (230)..(233): a, c, t, g, unknown or other
  misc_feature (230)..(233): n is a, c, g, or t

SEQ ID NO: 205369 - DNA, 232 bp, Homo sapiens; identical to SEQ ID NO: 205085
  misc_feature: GYAE6OF01ERBFB.30.25.C03.1.454.CMB.1.raw
  modified_base (229)..(232): a, c, t, g, unknown or other
  misc_feature (229)..(232): n is a, c, g, or t

SEQ ID NO: 205370 - DNA, 165 bp, Homo sapiens
  misc_feature: GYAE6OF01AYHZR.30.25.C03.1.454.CMB.1.raw
  modified_base (155)..(165): a, c, t, g, unknown or other
  misc_feature (155)..(165): n is a, c, g, or t
tcagcacgctacgtcacgaccggtgctcgatttagtagtgtagatttgggtttgggggaagaggaagactgacggtcctgccacagcggccctgggctgcctggtcaaggactacttccacgtagcgtgctgagcgggctggcaaggcgcatagnnnnnnnnnnn

SEQ ID NO: 205371 - DNA, 174 bp, Homo sapiens; identical to SEQ ID NO: 205077
  misc_feature: GYAE6OF01AXSXC.30.25.C03.1.454.CMB.1.raw
  modified_base (173)..(174): a, c, t, g, unknown or other
  misc_feature (173)..(174): n is a, c, g, or t

SEQ ID NO: 205372 - DNA, 207 bp, Homo sapiens
  misc_feature: GYAE6OF01A20UZ.30.25.C03.1.454.CMB.1.raw
  modified_base (176)..(207): a, c, t, g, unknown or other
  misc_feature (176)..(207): n is a, c, g, or t
tcagcacgctacgtcacgaccggtgctcgatttagtagtgtagatttgggtttgggggaagagggaagactgacggtcccccaggagttcaggtgctgggcacagtcggccctgggctgcctggtcaaggactacttccacgtaggcgtgctgagcgggctggcaaggcgcatagnnnnnnnnnnnnnnnnnnnnnnnnnnnnnnnn

SEQ ID NO: 205373 - DNA, 233 bp, Homo sapiens
  misc_feature: GYAE6OF01C8DM4.30.25.C03.1.454.CMB.1.raw
  modified_base (228)..(233): a, c, t, g, unknown or other
  misc_feature (228)..(233): n is a, c, g, or t
tcagcacgctacgtcacgaccggtgctcgatttagtagtgtagatttgggtttgggtgcccaagctgctggagggcacggtcaccgtctcctcagcctccaccaagggcccatcggtcttccccctggcaccctcctccaagagcacctctggggcacagcggccctgggctgcctggtcaaggactacttccacgtagcgtgctgagcggctggcaaggcgcatagnnnnnn

SEQ ID NO: 205374 - DNA, 256 bp, Homo sapiens
  misc_feature: GYAE6OF01D6HN3.30.25.C03.1.454.CMB.1.raw
  modified_base (231)..(256): a, c, t, g, unknown or other
  misc_feature (231)..(256): n is a, c, g, or t
tcagcacgctacgtcacgaccggtgctcgatttagtagtgtagatttgggtttggtgcccaagcgtgctggagggcacggtcaccgtctcctcagcctccaaccaagggcccatcggtcttcccctggcaccctcctccaagagcacctctgggggcacagcggccctgggctgcctggtcaaggactacgttccacgtagcgtgctgagcgggctggcaaggcgcatagnnnnnnnnnnnnnnnnnnnnnnnnnn

SEQ ID NO: 205375 - DNA, 232 bp, Homo sapiens; identical to SEQ ID NO: 205063
  misc_feature: GYAE6OF01EOZXQ.30.25.C03.1.454.CMB.1.raw
  modified_base (230)..(232): a, c, t, g, unknown or other
  misc_feature (230)..(232): n is a, c, g, or t

SEQ ID NO: 205376 - DNA, 230 bp, Homo sapiens; identical to SEQ ID NO: 205095
  misc_feature: GYAE6OF01EVZ6Z.30.25.C03.1.454.CMB.1.raw
  modified_base (230)..(230): a, c, t, g, unknown or other
  misc_feature (230)..(230): n is a, c, g, or t

SEQ ID NO: 205377 - DNA, 222 bp, Homo sapiens
  misc_feature: GYAE6OF01CUOHV.30.25.C03.1.454.CMB.1.raw
  modified_base (173)..(222): a, c, t, g, unknown or other
  misc_feature (173)..(222): n is a, c, g, or t
tcagcacgctacgtcacgaccggtgctcgatttagtagtgtagatttgggtttgggggaagaggaagactgacggtccccctaggagttcaggtgctgggcacagcggccctgggctgacctggtcaaggctacttccacgtagcgtgctgagcggctggcaaggcgcatagnnnnnnnnnnnnnnnnnnnnnnnnnnnnnnnnnnnnnnnnnnnnnnnnnn

SEQ ID NO: 205378 - DNA, 194 bp, Homo sapiens
  misc_feature: GYAE6OF01ELB5W.30.25.C03.1.454.CMB.1.raw
  modified_base (176)..(194): a, c, t, g, unknown or other
  misc_feature (176)..(194): n is a, c, g, or t
tcagcacgctacgtcacgaccggtgctcgatttagtagtgtagatttgggtttgggggggaagaggaagactgacggtccccccaggagttcaggtgctgggcacagccggcctgggctgcctggtcaaggactacttccacgtagcgtgctgagcgggctggcaaggcgcatagnnnnnnnnnnnnnnnnnnn

SEQ ID NO: 205379 - DNA, 231 bp, Homo sapiens; identical to SEQ ID NO: 205120
  misc_feature: GYAE6OF01BJCIC.30.25.C03.1.454.CMB.1.raw
  modified_base (230)..(231): a, c, t, g, unknown or other
  misc_feature (230)..(231): n is a, c, g, or t

SEQ ID NO: 205380 - DNA, 231 bp, Homo sapiens; identical to SEQ ID NO: 205120
  misc_feature: GYAE6OF01DY9SR.30.25.C03.1.454.CMB.1.raw
  modified_base (230)..(231): a, c, t, g, unknown or other
  misc_feature (230)..(231): n is a, c, g, or t

SEQ ID NO: 205381 - DNA, 172 bp, Homo sapiens
  misc_feature: GYAE6OF01CUV1G.30.25.C03.1.454.CMB.1.raw
  modified_base (172)..(172): a, c, t, g, unknown or other
  misc_feature (172)..(172): n is a, c, g, or t
tcagcacgctacgtcacgaccggtgctcgatttagtagtgtagatttgggtttgggggaagaggaagactgacggtcccccaggagttcaggtgctgggcacagcggccctgggctgcctggtcaaggactacttccacgtacgtgctgagcgggctggcaaggcgcatagn

SEQ ID NO: 205382 - DNA, 157 bp, Homo sapiens
  misc_feature: GYAE6OF01A3N3J.30.25.C03.1.454.CMB.1.raw
  modified_base (155)..(157): a, c, t, g, unknown or other
  misc_feature (155)..(157): n is a, c, g, or t
tcagcacgctacgtcacgaccggtgctcgatttagtagtgtagatttgggtttgggggaagaggaagactgacggtcctgccacagtggccctgggctgcctggtcaaggactacttccacgtagcgtgctgagcgggctggcaaggcgcatagnnn

SEQ ID NO: 205383 - DNA, 158 bp, Homo sapiens; identical to SEQ ID NO: 205153
  misc_feature: GYAE6OF01BTZ28.30.25.C03.1.454.CMB.1.raw
  modified_base (155)..(158): a, c, t, g, unknown or other
  misc_feature (155)..(158): n is a, c, g, or t

SEQ ID NO: 205384 - DNA, 174 bp, Homo sapiens
  misc_feature: GYAE6OF01CO3MF.30.25.C03.1.454.CMB.1.raw
  modified_base (156)..(174): a, c, t, g, unknown or other
  misc_feature (156)..(174): n is a, c, g, or t
tcagcacgctacgtcacgaccggtgctcgatttagtagtgtagatttgggtttggggggaagaggaagactgacggtcctgccacagcggccctgggctgcctggtcaaggactacttccacgtagcgtgctgagcgggctggcaaggcgcatagnnnnnnnnnnnnnnnnnnn

SEQ ID NO: 205385 - DNA, 156 bp, Homo sapiens; identical to SEQ ID NO: 205094
  misc_feature: GYAE6OF01DO5J5.30.25.C03.1.454.CMB.1.raw
  modified_base (155)..(156): a, c, t, g, unknown or other
  misc_feature (155)..(156): n is a, c, g, or t

SEQ ID NO: 205386 - DNA, 156 bp, Homo sapiens; identical to SEQ ID NO: 205094
  misc_feature: GYAE6OF01DNQ3B.30.25.C03.1.454.CMB.1.raw
  modified_base (155)..(156): a, c, t, g, unknown or other
  misc_feature (155)..(156): n is a, c, g, or t

SEQ ID NO: 205387 - DNA, 157 bp, Homo sapiens; identical to SEQ ID NO: 205114
  misc_feature: GYAE6OF01BJ2HK.30.25.C03.1.454.CMB.1.raw
  modified_base (155)..(157): a, c, t, g, unknown or other
  misc_feature (155)..(157): n is a, c, g, or t

SEQ ID NO: 205388 - DNA, 230 bp, Homo sapiens; identical to SEQ ID NO: 205071
  misc_feature: GYAE6OF01BX5SA.30.25.C03.1.454.CMB.1.raw
  modified_base (229)..(230): a, c, t, g, unknown or other
  misc_feature (229)..(230): n is a, c, g, or t

SEQ ID NO: 205389 - DNA, 243 bp, Homo sapiens
  misc_feature: GYAE6OF01D7T3V.30.25.C03.1.454.CMB.1.raw
  modified_base (234)..(243): a, c, t, g, unknown or other
  misc_feature (234)..(243): n is a, c, g, or t
tcagcacgctacgtcacgaccggtgctcgatttagtagtgtagatttgggtttgggtgcccaagctgctggagggcacggtcaccgtctcctcagcatccacgaacggcccatcggtccttcccctggccaccctcctccaagagcacctcgtggggcacagccggcccgtgggctgcctggtcaaggactacttccacgtagcgtgctgaggcgggctggcaaggcgcatagnnnnnnnnnn

SEQ ID NO: 205390 - DNA, 182 bp, Homo sapiens
  misc_feature: GYAE6OF01CILRX.30.25.C03.1.454.CMB.1.raw
  modified_base (172)..(182): a, c, t, g, unknown or other
  misc_feature (172)..(182): n is a, c, g, or t
tcagcacgctacgtcacgaccggtgctcgatttagtagtgtagatttgggtttgggggaagaggaagactgacggtcccccaggagttcaggtgctgggcacagcggccctgggctgcctggtcaaggactacttccacgtaggtgctgagcgggctggcaaggcgcatagnnnnnnnnnnn

SEQ ID NO: 205391 - DNA, 234 bp, Homo sapiens; identical to SEQ ID NO: 205218
  misc_feature: GYAE6OF01CMC3F.30.25.C03.1.454.CMB.1.raw
  modified_base (229)..(234): a, c, t, g, unknown or other
  misc_feature (229)..(234): n is a, c, g, or t

SEQ ID NO: 205392 - DNA, 178 bp, Homo sapiens; identical to SEQ ID NO: 205093
  misc_feature: GYAE6OF01AW784.30.25.C03.1.454.CMB.1.raw
  modified_base (173)..(178): a, c, t, g, unknown or other
  misc_feature (173)..(178): n is a, c, g, or t

SEQ ID NO: 205393 - DNA, 174 bp, Homo sapiens; identical to SEQ ID NO: 205077
  misc_feature: GYAE6OF01ECXQF.30.25.C03.1.454.CMB.1.raw
  modified_base (173)..(174): a, c, t, g, unknown or other
  misc_feature (173)..(174): n is a, c, g, or t

SEQ ID NO: 205394 - DNA, 232 bp, Homo sapiens; identical to SEQ ID NO: 205063
  misc_feature: GYAE6OF01ADIED.30.25.C03.1.454.CMB.1.raw
  modified_base (230)..(232): a, c, t, g, unknown or other
  misc_feature (230)..(232): n is a, c, g, or t

SEQ ID NO: 205395 - DNA, 250 bp, Homo sapiens
  misc_feature: GYAE6OF01EQKH6.30.25.C03.1.454.CMB.1.raw
  modified_base (230)..(250): a, c, t, g, unknown or other
  misc_feature (230)..(250): n is a, c, g, or t
tcagcacgctacgtcacgaccggtgctcgatttagtagtgtagatttgggtttgggtgcccaagctgctggagggcacggtcaccgtctcctcagcctccaccaagggcccatcggtcttccccctggcaccctcctccaagagcacctctgggggcacagcggccctgggctgcctggtcaaggactacttccacgtagcgtgctgagcgggctggcaaggcgcatagnnnnnnnnnnnnnnnnnnnnn

SEQ ID NO: 205396 - DNA, 230 bp, Homo sapiens; identical to SEQ ID NO: 205095
  misc_feature: GYAE6OF01EY86N.30.25.C03.1.454.CMB.1.raw
  modified_base (230)..(230): a, c, t, g, unknown or other
  misc_feature (230)..(230): n is a, c, g, or t

SEQ ID NO: 205397 - DNA, 163 bp, Homo sapiens
  misc_feature: GYAE6OF01D2V94.30.25.C03.1.454.CMB.1.raw
  modified_base (156)..(163): a, c, t, g, unknown or other
  misc_feature (156)..(163): n is a, c, g, or t
tcagcacgctacgtcacgaccggtgctcgatttagtagtgtagatttgggtttgggggaaggaggaagactgacggtcctgccacagcggccctgggctgcctggtcaaggactacttccacgtagcgtgctgagcgggctggcaaggcgcatagnnnnnnnn

SEQ ID NO: 205398 - DNA, 249 bp, Homo sapiens
  misc_feature: GYAE6OF01A8NEU.30.25.C03.1.454.CMB.1.raw
  modified_base (233)..(249): a, c, t, g, unknown or other
  misc_feature (233)..(249): n is a, c, g, or t
tcagcacgctacgtcacgaccggtgctcgatttagtagtgtagatttggggtttgggtgcccaagctgctggagggcacggtcaccgtctcctcagcctccaccaagggcccatcggtcttccccctggcaccctcctccaagagcacctctgggggctacagcggccctgggctgcctggtcaaggactacttccacgtagcgtgctgagcgggctggcaaggcgcataggnnnnnnnnnnnnnnnnn

SEQ ID NO: 205399 - DNA, 236 bp, Homo sapiens
  misc_feature: GYAE6OF01BQELF.30.25.C03.1.454.CMB.1.raw
  modified_base (230)..(236): a, c, t, g, unknown or other
  misc_feature (230)..(236): n is a, c, g, or t
tcagcacgctacgtcacgaccggtgctcgatttagtagtgtagatttgggtttgggtgcccaagctgctggagggcacggtcaccgtctcctcagcctccaccaagggcccatcggtcttccccctggcaccctcctccaagagcacctctgggggcacagcggccctgggctgcctggtcaaggactacttccacgtagcgtgctgagcgggctggcaaggcgcatagnnnnnnn

SEQ ID NO: 205400 - DNA, 155 bp, Homo sapiens; identical to SEQ ID NO: 205076
  misc_feature: GYAE6OF01COG1T.30.25.C03.1.454.CMB.1.raw
  modified_base (155)..(155): a, c, t, g, unknown or other
  misc_feature (155)..(155): n is a, c, g, or t

SEQ ID NO: 205401 - DNA, 261 bp, Homo sapiens
  misc_feature: GYAE6OF01C8NVT.30.25.C03.1.454.CMB.1.raw
  modified_base (234)..(261): a, c, t, g, unknown or other
  misc_feature (234)..(261): n is a, c, g, or t
tcagcacgctacgtcacgaccggtgctcgatttagtagtgtagatttgggtttgggtgcccaagtctgctggagggcacggtcaccgtctcctcagcctccaccaagggcccatcggtcttcccctggcaccctcctccaagagcacctcgtggggcacagcggccctagggctcgcctggtcaaggtactacttccacgtagcgtgctgacgcgggctggcaaggcgcatagnnnnnnnnnnnnnnnnnnnnnnnnnnnn

SEQ ID NO: 205402 - DNA, 173 bp, Homo sapiens; identical to SEQ ID NO: 205084
  misc_feature: GYAE6OF01E3GU3.30.25.C03.1.454.CMB.1.raw
  modified_base (173)..(173): a, c, t, g, unknown or other
  misc_feature (173)..(173): n is a, c, g, or t

SEQ ID NO: 205403 - DNA, 230 bp, Homo sapiens; identical to SEQ ID NO: 205071
  misc_feature: GYAE6OF01EJVVL.30.25.C03.1.454.CMB.1.raw
  modified_base (229)..(230): a, c, t, g, unknown or other
  misc_feature (229)..(230): n is a, c, g, or t

SEQ ID NO: 205404 - DNA, 234 bp, Homo sapiens; identical to SEQ ID NO: 205242
  misc_feature: GYAE6OF01A53CJ.30.25.C03.1.454.CMB.1.raw
  modified_base (230)..(234): a, c, t, g, unknown or other
  misc_feature (230)..(234): n is a, c, g, or t

SEQ ID NO: 205405 - DNA, 230 bp, Homo sapiens; identical to SEQ ID NO: 205095
  misc_feature: GYAE6OF01EBQMU.30.25.C03.1.454.CMB.1.raw
  modified_base (230)..(230): a, c, t, g, unknown or other
  misc_feature (230)..(230): n is a, c, g, or t

SEQ ID NO: 205406 - DNA, 235 bp, Homo sapiens; identical to SEQ ID NO: 205318
  misc_feature: GYAE6OF01ECVLN.30.25.C03.1.454.CMB.1.raw
  modified_base (230)..(235): a, c, t, g, unknown or other
  misc_feature (230)..(235): n is a, c, g, or t

SEQ ID NO: 205407 - DNA, 233 bp, Homo sapiens; identical to SEQ ID NO: 205189
  misc_feature: GYAE6OF01AFYKD.30.25.C03.1.454.CMB.1.raw
  modified_base (230)..(233): a, c, t, g, unknown or other
  misc_feature (230)..(233): n is a, c, g, or t

SEQ ID NO: 205408 - DNA, 157 bp, Homo sapiens; identical to SEQ ID NO: 205114
  misc_feature: GYAE6OF01AHV1P.30.25.C03.1.454.CMB.1.raw
  modified_base (155)..(157): a, c, t, g, unknown or other
  misc_feature (155)..(157): n is a, c, g, or t

SEQ ID NO: 205409 - DNA, 156 bp, Homo sapiens; identical to SEQ ID NO: 205094
  misc_feature: GYAE6OF01A55BN.30.25.C03.1.454.CMB.1.raw
  modified_base (155)..(156): a, c, t, g, unknown or other
  misc_feature (155)..(156): n is a, c, g, or t

SEQ ID NO: 205410 - DNA, 233 bp, Homo sapiens
  misc_feature: GYAE6OF01C1J4Y.30.25.C03.1.454.CMB.1.raw
  modified_base (231)..(233): a, c, t, g, unknown or other
  misc_feature (231)..(233): n is a, c, g, or t
tcagcacgctacgtcacgaccggtgctcgatttagtagtgtagatttgggtttgggtgcccaagctgctggagggcacggtcaccgtctcctcagcctccaccaagggcccatcggtcttccccctggccaccctcctccaagagcacctctgggggcacagcggccctgggctgcctggtcaaggactacttccacgtagcgtgctgagcgggctggcaaggcgcatagnnn

SEQ ID NO: 205411 - DNA, 176 bp, Homo sapiens; identical to SEQ ID NO: 205124
  misc_feature: GYAE6OF01C3HOZ.30.25.C03.1.454.CMB.1.raw
  modified_base (173)..(176): a, c, t, g, unknown or other
  misc_feature (173)..(176): n is a, c, g, or t

SEQ ID NO: 205412 - DNA, 231 bp, Homo sapiens; identical to SEQ ID NO: 205120
  misc_feature: GYAE6OF01EQK1V.30.25.C03.1.454.CMB.1.raw
  modified_base (230)..(231): a, c, t, g, unknown or other
  misc_feature (230)..(231): n is a, c, g, or t

SEQ ID NO: 205413 - DNA, 242 bp, Homo sapiens
  misc_feature: GYAE6OF01BVQAC.30.25.C03.1.454.CMB.1.raw
  modified_base (177)..(177): a, c, t, g, unknown or other
  misc_feature (177)..(177): n is a, c, g, or t
  modified_base (181)..(242): a, c, t, g, unknown or other
  misc_feature (181)..(242): n is a, c, g, or t
tcagcacgctacgtcacgaccggtgctcgatttagtagtgtagatttggggtttggggggaagaggaagactgacggtcccccaggagttcaggtgctgggcacagcggccctgggactgcctggtcaaggactacttccacgtagcggtgctgagcgggctggcaaggcgcatagnaggnnnnnnnnnnnnnnnnnnnnnnnnnnnnnnnnnnnnnnnnnnnnnnnnnnnnnnnnnnnnnn

SEQ ID NO: 205414 - DNA, 173 bp, Homo sapiens
  misc_feature: GYAE6OF01C9WWL.30.25.C03.1.454.CMB.1.raw
  modified_base (155)..(173): a, c, t, g, unknown or other
  misc_feature (155)..(173): n is a, c, g, or t
tcagcacgctacgtcacgaccggtgctcgatttagtagtgtagatttgggtttgggggaagaggaagactgacggtcctgccacagcggccctgggctgcctggtcaaggactacttccacgtagcgtgctgagcgggctggcaaggcgcatagnnnnnnnnnnnnnnnnnnn

SEQ ID NO: 205415 - DNA, 281 bp, Homo sapiens
  misc_feature: GYAE6OF01DANS2.30.25.C03.1.454.CMB.1.raw
  modified_base (240)..(281): a, c, t, g, unknown or other
  misc_feature (240)..(281): n is a, c, g, or t
tcagcacgctacgtcacgaccggtgctcgatttagtagtgtagatttgggtttgggggtgcccaagctgctggagggcacgggtcaccgtctcctcagcctccgaccaaggcccatcggtcttccccctgccaccctcctccaagagcaccgtcgtgggggccacagcggcccctgggctgcctggtcaaggactacttccacggtgccgtgctggagcgggctggcaaggcgcatagcnnnnnnnnnnnnnnnnnnnnnnnnnnnnnnnnnnnnnnnnnn

SEQ ID NO: 205416 - DNA, 175 bp, Homo sapiens
  misc_feature: GYAE6OF01A1FF8.30.25.C03.1.454.CMB.1.raw
  modified_base (173)..(175): a, c, t, g, unknown or other
  misc_feature (173)..(175): n is a, c, g, or t
tcagcacgctacgtcacgaccggtgctcgatttagtagtgtagatttgggtttgggggaagaggaagactgacggtcccccaggagttcaggtgctgggcacagcggccctgggctgcttggtcaaggactacttccacgtagcgtgctgagcgggctggcaaggcgcatagnnn

SEQ ID NO: 205417 - DNA, 239 bp, Homo sapiens
  misc_feature: GYAE6OF01BXYDM.30.25.C03.1.454.CMB.1.raw
  modified_base (231)..(239): a, c, t, g, unknown or other
  misc_feature (231)..(239): n is a, c, g, or t
tcagcacgctacgtcacgaccggtgctcgatttagtagtgtagatttgggtttgggtgcccaagctgctggagggcacggtcaccgtctcctcagcctccaccaagggcccatcggtcttccccctggcaccctcctccaagagcacctctgggggcacagcggccctgggctgcctggtcaaggactacttccacgtagcgtgctgagcgggctgggcaaggcgcatagnnnnnnnnn

SEQ ID NO: 205418 - DNA, 232 bp, Homo sapiens; identical to SEQ ID NO: 205085
  misc_feature: GYAE6OF01B78BK.30.25.C03.1.454.CMB.1.raw
  modified_base (229)..(232): a, c, t, g, unknown or other
  misc_feature (229)..(232): n is a, c, g, or t

SEQ ID NO: 205419 - DNA, 176 bp, Homo sapiens
  misc_feature: GYAE6OF01DVSE2.30.25.C03.1.454.CMB.1.raw
  modified_base (162)..(176): a, c, t, g, unknown or other
  misc_feature (162)..(176): n is a, c, g, or t
tcagcacgctacgtcacgaccggtgctcgatttagtagtgtagatttgggtttgggggggtaagggaggaagactgacggtcctgccacaggcggccctgggctgcctggtcaaggactacttccacgttagcgtgctgagcgggctggcaaggcgcatagnnnnnnnnnnnnnnn

SEQ ID NO: 205420 - DNA, 235 bp, Homo sapiens; identical to SEQ ID NO: 205318
  misc_feature: GYAE6OF01BQDR8.30.25.C03.1.454.CMB.1.raw
  modified_base (230)..(235): a, c, t, g, unknown or other
  misc_feature (230)..(235): n is a, c, g, or t

SEQ ID NO: 205421 - DNA, 234 bp, Homo sapiens; identical to SEQ ID NO: 205242
  misc_feature: GYAE6OF01B9U6H.30.25.C03.1.454.CMB.1.raw
  modified_base (230)..(234): a, c, t, g, unknown or other
  misc_feature (230)..(234): n is a, c, g, or t

SEQ ID NO: 205422 - DNA, 233 bp, Homo sapiens
  misc_feature: GYAE6OF01DLW8F.30.25.C03.1.454.CMB.1.raw
  modified_base (230)..(233): a, c, t, g, unknown or other
  misc_feature (230)..(233): n is a, c, g, or t
tcagcacgctacgtcacgaccggtgctcgatttagtagtgtagatttgggtttgggtgcccaaagctgctggagggcacggtcaccgtctcctcagcctccaccaagggcccatcggtcttccccctggcaccctcctccaagagcacctctggggcacagcggccctgggctgcctggtcaaggactacttccacgtagcgtgctgagcgggctggcaaggcgcatagnnnn

SEQ ID NO: 205423 - DNA, 175 bp, Homo sapiens; identical to SEQ ID NO: 205102
  misc_feature: GYAE6OF01AR5Z6.30.25.C03.1.454.CMB.1.raw
  modified_base (173)..(175): a, c, t, g, unknown or other
  misc_feature (173)..(175): n is a, c, g, or t

SEQ ID NO: 205424 - DNA, 173 bp, Homo sapiens; identical to SEQ ID NO: 205084
  misc_feature: GYAE6OF01DD7EF.30.25.C03.1.454.CMB.1.raw
  modified_base (173)..(173): a, c, t, g, unknown or other
  misc_feature (173)..(173): n is a, c, g, or t

SEQ ID NO: 205425 - DNA, 232 bp, Homo sapiens; identical to SEQ ID NO: 205063
  misc_feature: GYAE6OF01A3J1L.30.25.C03.1.454.CMB.1.raw
  modified_base (230)..(232): a, c, t, g, unknown or other
  misc_feature (230)..(232): n is a, c, g, or t

SEQ ID NO: 205426 - DNA, 235 bp, Homo sapiens; identical to SEQ ID NO: 205318
  misc_feature: GYAE6OF01A4L53.30.25.C03.1.454.CMB.1.raw
  modified_base (230)..(235): a, c, t, g, unknown or other
  misc_feature (230)..(235): n is a, c, g, or t

SEQ ID NO: 205427 - DNA, 232 bp, Homo sapiens; identical to SEQ ID NO: 205063
  misc_feature: GYAE6OF01DK1JS.30.25.C03.1.454.CMB.1.raw
  modified_base (230)..(232): a, c, t, g, unknown or other
  misc_feature (230)..(232): n is a, c, g, or t

SEQ ID NO: 205428 - DNA, 231 bp, Homo sapiens; identical to SEQ ID NO: 205120
  misc_feature: GYAE6OF01ARA5N.30.25.C03.1.454.CMB.1.raw
  modified_base (230)..(231): a, c, t, g, unknown or other
  misc_feature (230)..(231): n is a, c, g, or t

SEQ ID NO: 205429 - DNA, 153 bp, Homo sapiens
  misc_feature: GYAE6OF01C9VG5.30.25.C03.1.454.CMB.1.raw
tcagcacgctacgtcacgaccggtgctcgatttagtagtgtagatttgggttgggggaagaggaagactgacggtcctgccacagcggccctgggctgcctggtcaaggactacttccacgtagcgtgctgagcgggctggcaaggcgcatag

SEQ ID NO: 205430 - DNA, 157 bp, Homo sapiens; identical to SEQ ID NO: 205114
  misc_feature: GYAE6OF01DLPNG.30.25.C03.1.454.CMB.1.raw
  modified_base (155)..(157): a, c, t, g, unknown or other
  misc_feature (155)..(157): n is a, c, g, or t

SEQ ID NO: 205431 - DNA, 233 bp, Homo sapiens; identical to SEQ ID NO: 205189
  misc_feature: GYAE6OF01DEYY3.30.25.C03.1.454.CMB.1.raw
  modified_base (230)..(233): a, c, t, g, unknown or other
  misc_feature (230)..(233): n is a, c, g, or t

SEQ ID NO: 205432 - DNA, 162 bp, Homo sapiens
  misc_feature: GYAE6OF01BWZOY.30.25.C03.1.454.CMB.1.raw
  modified_base (155)..(162): a, c, t, g, unknown or other
  misc_feature (155)..(162): n is a, c, g, or t
tcagcacgctacgtcacgaccggtgctcgatttagtagtgtagatttgggtttgggggaagaggaagactgacggtcctgccacagcggccctgggctgcctggtcaaggactacttccacgtagcgtgctgagcgggctggcaaggcgcatagnnnnnnnn

SEQ ID NO: 205433 - DNA, 235 bp, Homo sapiens; identical to SEQ ID NO: 205318
  misc_feature: GYAE6OF01EF2Z5.30.25.C03.1.454.CMB.1.raw
  modified_base (230)..(235): a, c, t, g, unknown or other
  misc_feature (230)..(235): n is a, c, g, or t

SEQ ID NO: 205434 - DNA, 154 bp, Homo sapiens; identical to SEQ ID NO: 205195
  misc_feature: GYAE6OF01D45IC.30.25.C03.1.454.CMB.1.raw

SEQ ID NO: 205435 - DNA, 229 bp, Homo sapiens; identical to SEQ ID NO: 205049
  misc_feature: GYAE6OF01BTX2X.30.25.C03.1.454.CMB.1.raw
  modified_base (228)..(229): a, c, t, g, unknown or other
  misc_feature (228)..(229): n is a, c, g, or t

SEQ ID NO: 205436 - DNA, 241 bp, Homo sapiens
  misc_feature: GYAE6OF01ER8J1.30.25.C03.1.454.CMB.1.raw
  modified_base (230)..(234): a, c, t, g, unknown or other
  misc_feature (230)..(234): n is a, c, g, or t
tcagcacgctacgtcacgaccggtgctcgatttagtagtgtagatttgggtttgggtgcccaagctgctggagggcacggtcaccgtctcctcagcctccaccaagggcccatcggtcttccccctggcaccctcctccaagagcacctctgggggcacagcggccctgggctgcctggtcaaggactacttccacgtagcgtgctgagcgggctggcaaggcgcatagnnnnnaaaaaaa

SEQ ID NO: 205437 - DNA, 254 bp, Homo sapiens
  misc_feature: GYAE6OF01DOMYO.30.25.C03.1.454.CMB.1.raw
  modified_base (231)..(254): a, c, t, g, unknown or other
  misc_feature (231)..(254): n is a, c, g, or t
tcagcacgctacgtcacgaccggtgctcgatttagtagtgtagatttgggtttgggtgccaagctgctggagggcacggtcaccgtctcctcagcctccaccaagggcccatcggtcttccccctggccaccctcctccaagagcacctctgggggcacagcggccctgggctgcctggtcaaggactacttccacgtagcgtgctgagcgggctggcaaggcgcatacgnnnnnnnnnnnnnnnnnnnnnnnn

SEQ ID NO: 205438 - DNA, 236 bp, Homo sapiens
  misc_feature: GYAE6OF01DO8JL.30.25.C03.1.454.CMB.1.raw
  modified_base (232)..(236): a, c, t, g, unknown or other
  misc_feature (232)..(236): n is a, c, g, or t
tcagcacgctacgtcacgaccggtgctcgatttagtagtgtagatttgggtttgggtgcccaagctgctggagggcacggtcaccgtctcctcagcctccaccaagggcccatcggtcttccccctggccaccctcctccaagagcacctcgtgggggcacagcggccctgggctgcctggtcaaggactacttcacgtagcgtgctgagcgggctgggcaaggcgcatagnnnnn

SEQ ID NO: 205439 - DNA, 292 bp, Homo sapiens
  misc_feature: GYAE6OF01CM761.30.25.C03.1.454.CMB.1.raw
  modified_base (239)..(240): a, c, t, g, unknown or other
  misc_feature (239)..(240): n is a, c, g, or t
  modified_base (242)..(292): a, c, t, g, unknown or other
  misc_feature (242)..(292): n is a, c, g, or t
tcagcacgctacgtcacgaccggtgctcgatttagtagtgtagatttggggtttggggtgcccgaagctgcctggagggcacggtcaccgtctcctcagcctccaccaagggcccatcggtcttccccctggcaccctcctccaagagcacctcgtggggcacagcgggtccctgggctgccttaggtcaaggacctacttccagtagcgtgctgagcgggctggcgaaggcgcatagnngnnnnnnnnnnnnnnnnnnnnnnnnnnnnnnnnnnnnnnnnnnnnnnnnnnn

SEQ ID NO: 205440 - DNA, 235 bp, Homo sapiens; identical to SEQ ID NO: 205318
  misc_feature: GYAE6OF01B0H6C.30.25.C03.1.454.CMB.1.raw
  modified_base (230)..(235): a, c, t, g, unknown or other
  misc_feature (230)..(235): n is a, c, g, or t

SEQ ID NO: 205441 - DNA, 233 bp, Homo sapiens; identical to SEQ ID NO: 205189
  misc_feature: GYAE6OF01EPKPX.30.25.C03.1.454.CMB.1.raw
  modified_base (230)..(233): a, c, t, g, unknown or other
  misc_feature (230)..(233): n is a, c, g, or t

SEQ ID NO: 205442 - DNA, 176 bp, Homo sapiens
  misc_feature: GYAE6OF01EEZUD.30.25.C03.1.454.CMB.1.raw
  modified_base (172)..(176): a, c, t, g, unknown or other
  misc_feature (172)..(176): n is a, c, g, or t
tcagcacgctacgtcacgaccggtgctcgatttagtagtgtagatttgggtttgggggaagaggaagactgacggtcccccaggagttcaggtgctgggcacagcggccctgggctgcctggtcaaggactacttccacgtagcgtctgagcgggctggcaaggcgcatagnnnnn

SEQ ID NO: 205443 - DNA, 234 bp, Homo sapiens
  misc_feature: GYAE6OF01CDJNP.30.25.C03.1.454.CMB.1.raw
  modified_base (230)..(234): a, c, t, g, unknown or other
  misc_feature (230)..(234): n is a, c, g, or t
tcagcacgctacgtcacgaccggtgctcgatttagtagtgtagatttgggtttgggtgcccaagctgctggagggcacggtcaccgtctcctcagcctccaccaagggcccatcggtcttccccctggccaccctcctccaagagcacctctggggcacagcggccctgggctgcctggtcaaggactacttccacgtagcgtgctgagcgggctggcaaggcgcatagnnnnn

SEQ ID NO: 205444 - DNA, 275 bp, Homo sapiens
  misc_feature: GYAE6OF01DZYL3.30.25.C03.1.454.CMB.1.raw
  modified_base (238)..(238): a, c, t, g, unknown or other
  misc_feature (238)..(238): n is a, c, g, or t
  modified_base (240)..(275): a, c, t, g, unknown or other
  misc_feature (240)..(275): n is a, c, g, or t
tcagcacgctacgtcacgaccggtgctcgatttagtagtgtagatttgggtttgggtgcccaagctgcctggaggggcacggtcaccgtctcctcagcctccaccaagggcccatcggtcttccccctggcaccctcctccaagagtacctctgggggcacagcggtcccttgggctgccttaggtcaaggactacttccacgtagcgtgctggagcgggctgggcaaggcgcatagngnnnnnnnnnnnnnnnnnnnnnnnnnnnnnnnnnnnn

SEQ ID NO: 205445 - DNA, 251 bp, Homo sapiens
  misc_feature: GYAE6OF01DYSRL.30.25.C03.1.454.CMB.1.raw
  modified_base (233)..(251): a, c, t, g, unknown or other
  misc_feature (233)..(251): n is a, c, g, or t
tcagcacgctacgtcacgaccggtgctcgatttagtagtgtagatttgggtttgggtggcccaagctcgctggagggcacggtcaccgtctcctcagcctccaccaagggcccatcggtcttccccctggcaccctcctccaagagcacctctgggggcacagccggccctgggctgcctggtcaaggactacttccacgtagcgtgctggagcgggctggcaaggcgcatgnnnnnnnnnnnnnnnnnnn

SEQ ID NO: 205446 - DNA, 176 bp, Homo sapiens
  misc_feature: GYAE6OF01DWA4B.30.25.C03.1.454.CMB.1.raw
  modified_base (176)..(176): a, c, t, g, unknown or other
  misc_feature (176)..(176): n is a, c, g, or t
tcagcacgctacgtcacgaccggtgctcgatttagtagtgtagatttgggtttgggggtaaggaggaagactgacggtcccccacggagttcaggtgctgggcacagcggccctgggctgcttggtcaaggactacttccacgtagcgtgctgagcgggctggcaaggcgcatagn

SEQ ID NO: 205447 - DNA, 170 bp, Homo sapiens
  misc_feature: GYAE6OF01D737H.30.25.C03.1.454.CMB.1.raw
  modified_base (157)..(170): a, c, t, g, unknown or other
  misc_feature (157)..(170): n is a, c, g, or t
tcagcacgctacgtcacgaccggtgctcgatttagtagtgtagatttgggtttggggggaagaggaagactgacggtcctgccacagcggccctgggctgcctggtcaaggactacttccacgtagcgtgctgagcgggctggcaaggcgcattagnnnnnnnnnnnnnn

SEQ ID NO: 205448 - DNA, 265 bp, Homo sapiens
  misc_feature: GYAE6OF01A2VP5.30.25.C03.1.454.CMB.1.raw
  modified_base (234)..(234): a, c, t, g, unknown or other
  misc_feature (234)..(234): n is a, c, g, or t
  modified_base (236)..(265): a, c, t, g, unknown or other
  misc_feature (236)..(265): n is a, c, g, or t
tcagcacgctacgtcacgaccggtgctcgatttagtagtgtagatttgggtttggggtgcccaagctgctggagggcacggtcaccgtctcctctagccttccaccaagggcccatcggtcttccccctggcaccctcctccaagagcaccgtctgggggctacagcggccctgggtctgcctggtcaaggctacttcagtagcgtgctgagcgggctggcgaaggcgcatagngnnnnnnnnnnnnnnnnnnnnnnnnnnnnnn

SEQ ID NO: 205449 - DNA, 236 bp, Homo sapiens; identical to SEQ ID NO: 205399
  misc_feature: GYAE6OF01ASK8S.30.25.C03.1.454.CMB.1.raw
  modified_base (230)..(236): a, c, t, g, unknown or other
  misc_feature (230)..(236): n is a, c, g, or t

SEQ ID NO: 205450 - DNA, 181 bp, Homo sapiens
  misc_feature: GYAE6OF01BG716.30.25.C03.1.454.CMB.1.raw
  modified_base (173)..(181): a, c, t, g, unknown or other
  misc_feature (173)..(181): n is a, c, g, or t
tcagcacgctacgtcacgaccggtgctcgatttagtagtgtagatttgggtttgggggaagaggaagactgacggtcccccaggagttcaggtgctgggcacagcggccctgggctgcctggtcaaggactacttccacgtagcgtgctgagcgggctggcaaggcgcatagnnnnnnnnn

SEQ ID NO: 205451 - DNA, 160 bp, Homo sapiens
  misc_feature: GYAE6OF01DGQPE.30.25.C03.1.454.CMB.1.raw
  modified_base (156)..(160): a, c, t, g, unknown or other
  misc_feature (156)..(160): n is a, c, g, or t
tcagcacgctacgtcacgaccggtgctcgatttagtagtgtagatttgggtttggggggaagaggaagactgacggtcctgccacagcggccctgggctgcctggtcaaggactacttccacgtagcgtgctgagcgggctggcaaggcgcatagnnnnn

SEQ ID NO: 205452 - DNA, 159 bp, Homo sapiens; identical to SEQ ID NO: 205340
  misc_feature: GYAE6OF01BXNWT.30.25.C03.1.454.CMB.1.raw
  modified_base (155)..(159): a, c, t, g, unknown or other
  misc_feature (155)..(159): n is a, c, g, or t

SEQ ID NO: 205453 - DNA, 171 bp, Homo sapiens
  misc_feature: GYAE6OF01EQ93G.30.25.C03.1.454.CMB.1.raw
  modified_base (155)..(171): a, c, t, g, unknown or other
  misc_feature (155)..(171): n is a, c, g, or t
tcagcacgctacgtcacgaccggtgctcgatttagtagtgtagatttgggtttgggggaagaggaagactgacggtcctgccacagcggccctgggctgcctggtcaaggactacttccacgtagcgtgctgagcgggctggcaaggcgcatagnnnnnnnnnnnnnnnnn

SEQ ID NO: 205454 - DNA, 292 bp, Homo sapiens
  misc_feature: GYAE6OF01CX2N1.30.25.C03.1.454.CMB.1.raw
  modified_base (248)..(292): a, c, t, g, unknown or other
  misc_feature (248)..(292): n is a, c, g, or t
tcagcacgctacgtcacgaccggtgctcgatttagtagtgtagatttgggtttgggtggcccaagctgctggggagggcacggtcaccgtctcctcagccctccaaccgaacgggcccagtccggtcttcccccgtggccaccccttcctccaagagccacctcgtggggcacagcggcctgggctgccgtggtcaaggactactccgacgtagcgtgctgcgcgggctggcgaaagggcactaatgnnnnnnnnnnnnnnnnnnnnnnnnnnnnnnnnnnnnnnnnnnnnn

SEQ ID NO: 205455 - DNA, 577 bp, Homo sapiens
  misc_feature: GYAE6OF01BZ5N1.30.25.C03.1.454.CMB.1.raw
  modified_base (171)..(171): a, c, t, g, unknown or other
  misc_feature (171)..(171): n is a, c, g, or t
  modified_base (177)..(180): a, c, t, g, unknown or other
  misc_feature (177)..(180): n is a, c, g, or t
  modified_base (182)..(182): a, c, t, g, unknown or other
  misc_feature (182)..(182): n is a, c, g, or t
  modified_base (184)..(184): a, c, t, g, unknown or other
  misc_feature (184)..(184): n is a, c, g, or t
  modified_base (187)..(189): a, c, t, g, unknown or other
  misc_feature (187)..(189): n is a, c, g, or t
  modified_base (192)..(193): a, c, t, g, unknown or other
  misc_feature (192)..(193): n is a, c, g, or t
  modified_base (195)..(196): a, c, t, g, unknown or other
  misc_feature (195)..(196): n is a, c, g, or t
  modified_base (202)..(203): a, c, t, g, unknown or other
  misc_feature (202)..(203): n is a, c, g, or t
  modified_base (205)..(205): a, c, t, g, unknown or other
  misc_feature (205)..(205): n is a, c, g, or t
  modified_base (207)..(208): a, c, t, g, unknown or other
  misc_feature (207)..(208): n is a, c, g, or t
  modified_base (212)..(212): a, c, t, g, unknown or other
  misc_feature (212)..(212): n is a, c, g, or t
  modified_base (215)..(215): a, c, t, g, unknown or other
  misc_feature (215)..(215): n is a, c, g, or t
  modified_base (224)..(224): a, c, t, g, unknown or other
  misc_feature (224)..(224): n is a, c, g, or t
  modified_base (238)..(238): a, c, t, g, unknown or other
  misc_feature (238)..(238): n is a, c, g, or t
  modified_base (267)..(267): a, c, t, g, unknown or other
  misc_feature (267)..(267): n is a, c, g, or t
  modified_base (275)..(275): a, c, t, g, unknown or other
  misc_feature (275)..(275): n is a, c, g, or t
  modified_base (294)..(294): a, c, t, g, unknown or other
  misc_feature (294)..(294): n is a, c, g, or t
  modified_base (306)..(306): a, c, t, g, unknown or other
  misc_feature (306)..(306): n is a, c, g, or t
  modified_base (329)..(329): a, c, t, g, unknown or other
  misc_feature (329)..(329): n is a, c, g, or t
  modified_base (376)..(376): a, c, t, g, unknown or other
  misc_feature (376)..(376): n is a, c, g, or t
  modified_base (409)..(409): a, c, t, g, unknown or other
  misc_feature (409)..(409): n is a, c, g, or t
tcagcacgctacgtcacgaccggtgctcgatttagtagtgtagatttggggtttgggggaaggagggaagactgacggtcccccaggagttcaggtgctagggcacagcggccctgggcctgcctggtcaaggctacttccacgtagcgtgctgagcgggctggcaaggcncatagnnnncncncannnacnncnncgatcnntnanncagnacngatcatgantgacataagatctnctgcatagcgattaacgcactcgtacgcncgactcgntttacgctaaactggctcnccgaatacggcnccgagagtcggatcggatacggngtcgtacgtacgacagtacctacgacgtcctaacgggactttaacgngtacggtacgttaccgtacgcgaattacggtanaaccgtggtcacggtacttacgtacgtctaacgtcgtagacggttacctacgttcgtacccgtacgtactaccggcggttaacgcggtaacggaccggtcgtaaaggtccgtaacggtaaccggtttttacgaacccgggtgacccggttaatcgtccgtaccgtacg

SEQ ID NO: 205456 - DNA, 233 bp, Homo sapiens
  misc_feature: GYAE6OF01CGU70.30.25.C03.1.454.CMB.1.raw
  modified_base (228)..(233): a, c, t, g, unknown or other
  misc_feature (228)..(233): n is a, c, g, or t
tcagcacgctacgtcacgaccggtgctcgatttagtagtgtagatttgggtttgggtgcccaagctgctggagggcacggtcaccgtctcctcagcctccaccaagggcccatcggtcttcccctggcaccctcctccaagagcacctctggggcacagcggccctgggctgcctggtcaaggactacttccacgtagcgtgctgagcgggctggcaaggcgcatagnnnnnn

SEQ ID NO: 205457 - DNA, 235 bp, Homo sapiens; identical to SEQ ID NO: 205318
  misc_feature: GYAE6OF01A6NTH.30.25.C03.1.454.CMB.1.raw
  modified_base (230)..(235): a, c, t, g, unknown or other
  misc_feature (230)..(235): n is a, c, g, or t

SEQ ID NO: 205458 - DNA, 232 bp, Homo sapiens; identical to SEQ ID NO: 205063
  misc_feature: GYAE6OF01EWN75.30.25.C03.1.454.CMB.1.raw
  modified_base (230)..(232): a, c, t, g, unknown or other
  misc_feature (230)..(232): n is a, c, g, or t

SEQ ID NO: 205459 - DNA, 231 bp, Homo sapiens; identical to SEQ ID NO: 205129
  misc_feature: GYAE6OF01CGZ25.30.25.C03.1.454.CMB.1.raw
  modified_base (229)..(231): a, c, t, g, unknown or other
  misc_feature (229)..(231): n is a, c, g, or t

SEQ ID NO: 205460 - DNA, 156 bp, Homo sapiens
  misc_feature: GYAE6OF01B4IYR.30.25.C03.1.454.CMB.1.raw
  modified_base (156)..(156): a, c, t, g, unknown or other
  misc_feature (156)..(156): n is a, c, g, or t
tcagcacgctacgtcacgaccggtgctcgatttagtagtgtagatttgggtttggggggaagaggaagactgacggtcctgccacagcggccctgggctgcctggtcaaggactacttccacgtagcgtgctgagcgggctggcaaggcgcatagn

SEQ ID NO: 205461 - DNA, 236 bp, Homo sapiens; identical to SEQ ID NO: 205399
  misc_feature: GYAE6OF01B13FR.30.25.C03.1.454.CMB.1.raw
  modified_base (230)..(236): a, c, t, g, unknown or other
  misc_feature (230)..(236): n is a, c, g, or t

SEQ ID NO: 205462 - DNA, 238 bp, Homo sapiens
  misc_feature: GYAE6OF01DCRJC.30.25.C03.1.454.CMB.1.raw
  modified_base (231)..(238): a, c, t, g, unknown or other
  misc_feature (231)..(238): n is a, c, g, or t
tcagcacgctacgtcacgaccggtgctcgatttagtagtgtagatttgggtttgggtgcccaagctgctggagggcacggtcaccgtctcctcagcctccaccaagggcccatcggtcttccccctggcaccctcctccaagagcacctcgtgggggcacagcggccctgggctgcctggtcaaggactacttccacgtagcgtgctgagcgggctggcaaggcgcatagnnnnnnnn

SEQ ID NO: 205463 - DNA, 248 bp, Homo sapiens
  misc_feature: GYAE6OF01EZ3LX.30.25.C03.1.454.CMB.1.raw
  modified_base (230)..(248): a, c, t, g, unknown or other
  misc_feature (230)..(248): n is a, c, g, or t
tcagcacgctacgtcacgaccggtgctcgatttagtagtgtagatttgggtttgggtgcccaagctgctggagggcacggtcaccgtctcctcagcctccaccaagggcccatcggtcttccccctggcaccctcctccaagagcacctctgggggcacagcggccctgggctgcctggtcaaggactacttccacgtagcgtgctgagcgggctggcaaggcgcatagnnnnnnnnnnnnnnnnnnn

SEQ ID NO: 205464 - DNA, 234 bp, Homo sapiens
  misc_feature: GYAE6OF01C4K3O.30.25.C03.1.454.CMB.1.raw
  modified_base (228)..(234): a, c, t, g, unknown or other
  misc_feature (228)..(234): n is a, c, g, or t
tcagcacgctacgtcacgaccggtgctcgatttagtagtgtagatttgggtttgggtgcccaagctgctggagggcacggtcaccgtctcctcagcctccaccaagggcccatcggtcttcccctggcaccctcctccaagagcacctctgggggcacagcggccctgggctgcctggtcaaggactacttccacgtagcgtgctgagcggctggcaaggcgcatagnnnnnnn

SEQ ID NO: 205465 - DNA, 505 bp, Homo sapiens
  misc_feature: GYAE6OF01E3X79.30.25.C03.1.454.CMB.1.raw
  modified_base (174)..(177): a, c, t, g, unknown or other
  misc_feature (174)..(177): n is a, c, g, or t
  modified_base (179)..(182): a, c, t, g, unknown or other
  misc_feature (179)..(182): n is a, c, g, or t
  modified_base (184)..(184): a, c, t, g, unknown or other
  misc_feature (184)..(184): n is a, c, g, or t
  modified_base (187)..(188): a, c, t, g, unknown or other
  misc_feature (187)..(188): n is a, c, g, or t
  modified_base (190)..(190): a, c, t, g, unknown or other
  misc_feature (190)..(190): n is a, c, g, or t
  modified_base (196)..(197): a, c, t, g, unknown or other
  misc_feature (196)..(197): n is a, c, g, or t
  modified_base (199)..(199): a, c, t, g, unknown or other
  misc_feature (199)..(199): n is a, c, g, or t
  modified_base (201)..(202): a, c, t, g, unknown or other
  misc_feature (201)..(202): n is a, c, g, or t
  modified_base (205)..(205): a, c, t, g, unknown or other
  misc_feature (205)..(205): n is a, c, g, or t
  modified_base (208)..(208): a, c, t, g, unknown or other
  misc_feature (208)..(208): n is a, c, g, or t
  modified_base (210)..(210): a, c, t, g, unknown or other
  misc_feature (210)..(210): n is a, c, g, or t
  modified_base (212)..(213): a, c, t, g, unknown or other
  misc_feature (212)..(213): n is a, c, g, or t
  modified_base (215)..(215): a, c, t, g, unknown or other
  misc_feature (215)..(215): n is a, c, g, or t
  modified_base (217)..(218): a, c, t, g, unknown or other
  misc_feature (217)..(218): n is a, c, g, or t
  modified_base (220)..(220): a, c, t, g, unknown or other
  misc_feature (220)..(220): n is a, c, g, or t
  modified_base (224)..(224): a, c, t, g, unknown or other
  misc_feature (224)..(224): n is a, c, g, or t
  modified_base (227)..(228): a, c, t, g, unknown or other
  misc_feature (227)..(228): n is a, c, g, or t
  modified_base (234)..(234): a, c, t, g, unknown or other
  misc_feature (234)..(234): n is a, c, g, or t
  modified_base (238)..(238): a, c, t, g, unknown or other
  misc_feature (238)..(238): n is a, c, g, or t
  modified_base (248)..(248): a, c, t, g, unknown or other
  misc_feature (248)..(248): n is a, c, g, or t
  modified_base (250)..(250): a, c, t, g, unknown or other
  misc_feature (250)..(250): n is a, c, g, or t
  modified_base (261)..(261): a, c, t, g, unknown or other
  misc_feature (261)..(261): n is a, c, g, or t
  modified_base (275)..(275): a, c, t, g, unknown or other
  misc_feature (275)..(275): n is a, c, g, or t
  modified_base (283)..(283): a, c, t, g, unknown or other
  misc_feature (283)..(283): n is a, c, g, or t
  modified_base (304)..(304): a, c, t, g, unknown or other
  misc_feature (304)..(304): n is a, c, g, or t
  modified_base (310)..(310): a, c, t, g, unknown or other
  misc_feature (310)..(310): n is a, c, g, or t
  modified_base (312)..(312): a, c, t, g, unknown or other
  misc_feature (312)..(312): n is a, c, g, or t
tcagcacgctacgtcacgaccggtgctcgatttagtagtgtagatttggggtttggggggaaggaggaagacgtgacggtcccaccgaggagttcaggtgctgggcacagccgcctggctgccttggtcaaggctactccacgtagcgtgctgagcggctggcaaggcgcatgnnnnannnntnagnncnagtcanntnannctngtntngnnantnntngcancgnnactagnagtntactgaactnancttcgcatctncgaatcaagtgcgnaagtcgancgaagcgtttgctcaacgccnctctcncncgacgacgcgtcgtcgtacgtacgtcgtcgtacgtactacgtacgtcgtacgtacgtcgtacgtacgtacgtacgtacgtacgtacgtcgtacgtaccgtacgtacgtacgtacgtacgtacgtacgtacgtacgtacggtacgtacggtacgtcgtacgtacggtacgtacgtacgtacgtcgtcgtcgtcg

SEQ ID NO: 205466 - DNA, 178 bp, Homo sapiens
  misc_feature: GYAE6OF01D9T17.30.25.C03.1.454.CMB.1.raw
  modified_base (171)..(178): a, c, t, g, unknown or other
  misc_feature (171)..(178): n is a, c, g, or t
tcagcacgctacgtcacgaccggtgctcgatttagtagtgtagatttgggtttgggggaagaggaagactgacggtcccccaggagttcaggtgctgggcacagcggccctgggctgcctggtcaaggctacttccacgtagcgtgctgagcggctggcaaggcgcatagnnnnnnnn

SEQ ID NO: 205467 - DNA, 517 bp, Homo sapiens
  misc_feature: GYAE6OF01BJZVZ.30.25.C03.1.454.CMB.1.raw
  modified_base (227)..(227): a, c, t, g, unknown or other
  misc_feature (227)..(227): n is a, c, g, or t
  modified_base (253)..(256): a, c, t, g, unknown or other
  misc_feature (253)..(256): n is a, c, g, or t
  modified_base (258)..(258): a, c, t, g, unknown or other
  misc_feature (258)..(258): n is a, c, g, or t
  modified_base (260)..(260): a, c, t, g, unknown or other
  misc_feature (260)..(260): n is a, c, g, or t
  modified_base (263)..(263): a, c, t, g, unknown or other
  misc_feature (263)..(263): n is a, c, g, or t
  modified_base (267)..(267): a, c, t, g, unknown or other
  misc_feature (267)..(267): n is a, c, g, or t
  modified_base (270)..(272): a, c, t, g, unknown or other
  misc_feature (270)..(272): n is a, c, g, or t
  modified_base (277)..(277): a, c, t, g, unknown or other
  misc_feature (277)..(277): n is a, c, g, or t
  modified_base (280)..(282): a, c, t, g, unknown or other
  misc_feature (280)..(282): n is a, c, g, or t
  modified_base (284)..(286): a, c, t, g, unknown or other
  misc_feature (284)..(286): n is a, c, g, or t
  modified_base (292)..(292): a, c, t, g, unknown or other
  misc_feature (292)..(292): n is a, c, g, or t
  modified_base (297)..(297): a, c, t, g, unknown or other
  misc_feature (297)..(297): n is a, c, g, or t
  modified_base (299)..(299): a, c, t, g, unknown or other
  misc_feature (299)..(299): n is a, c, g, or t
  modified_base (301)..(301): a, c, t, g, unknown or other
  misc_feature (301)..(301): n is a, c, g, or t
  modified_base (303)..(303): a, c, t, g, unknown or other
  misc_feature (303)..(303): n is a, c, g, or t
  modified_base (305)..(305): a, c, t, g, unknown or other
  misc_feature (305)..(305): n is a, c, g, or t
  modified_base (307)..(307): a, c, t, g, unknown or other
  misc_feature (307)..(307): n is a, c, g, or t
  modified_base (309)..(309): a, c, t, g, unknown or other
  misc_feature (309)..(309): n is a, c, g, or t
  modified_base (317)..(318): a, c, t, g, unknown or other
  misc_feature (317)..(318): n is a, c, g, or t
  modified_base (320)..(320): a, c, t, g, unknown or other
  misc_feature (320)..(320): n is a, c, g, or t
  modified_base (322)..(322): a, c, t, g, unknown or other
  misc_feature (322)..(322): n is a, c, g, or t
  modified_base (324)..(325): a, c, t, g, unknown or other
  misc_feature (324)..(325): n is a, c, g, or t
  modified_base (333)..(333): a, c, t, g, unknown or other
  misc_feature (333)..(333): n is a, c, g, or t
  modified_base (337)..(337): a, c, t, g, unknown or other
  misc_feature (337)..(337): n is a, c, g, or t
  modified_base (353)..(353): a, c, t, g, unknown or other
  misc_feature (353)..(353): n is a, c, g, or t
tcagcacgctacgtcacgaccggtgctcgatttagtagtgtagattttgggtttggggtgcccaagcctgctggagggcacggtcaccgtacctcctcagcctccaccaagggccccatccggtctttcccccgtggcgacccctcgtccaagacgctaccttcgtgggggcacgagcggccctgggactggccctggtccaagggctacttccacgtgcgtgctgnggcggcgtggcgaaggcgcagtacgnnnngncngcngctntgnnntctcnatnnngnnncgcgcngacancngngngngngngcgcgacnngngncnngtctctcnctcncgacgacactactacncacgacactactacctacaactaacacacgtactacgtagtacgtgtgacgcgcgctactcgtcacgaccgacgtaccgtcgttacttacgtacgtacgtacgacgacgtaccgtaccgtacgtcgtcgtcgccgcgcgcgtcgtcgtcgtcgtcgtcggtcgg

SEQ ID NO: 205468 - DNA, 167 bp, Homo sapiens
  misc_feature: GYAE6OF01EYIV3.30.25.C03.1.454.CMB.1.raw
  modified_base (157)..(167): a, c, t, g, unknown or other
  misc_feature (157)..(167): n is a, c, g, or t
tcagcacgctacgtcacgaccggtgctcgatttagtagtgtagatttgggtttggggggaagaggaagactgacggtcctgccacagcggccctgggctgcctggtccaaggactacttccacgtagcgtgctgagcgggctggcaaggcgcatagnnnnnnnnnnn

SEQ ID NO: 205469 - DNA, 233 bp, Homo sapiens; identical to SEQ ID NO: 205189
  misc_feature: GYAE6OF01BWDQN.30.25.C03.1.454.CMB.1.raw
  modified_base (230)..(233): a, c, t, g, unknown or other
  misc_feature (230)..(233): n is a, c, g, or t

SEQ ID NO: 205470 - DNA, 276 bp, Homo sapiens
  misc_feature: GYAE6OF01BP35Q.30.25.C03.1.454.CMB.1.raw
  modified_base (210)..(210): a, c, t, g, unknown or other
  misc_feature (210)..(210): n is a, c, g, or t
  modified_base (237)..(238): a, c, t, g, unknown or other
  misc_feature (237)..(238): n is a, c, g, or t
  modified_base (240)..(244): a, c, t, g, unknown or other
  misc_feature (240)..(244): n is a, c, g, or t
  modified_base (246)..(276): a, c, t, g, unknown or other
  misc_feature (246)..(276): n is a, c, g, or t
tcagcacgctacgtcacgaccggtgctcgatttagtagtgtagattttgggttttgggtgcccaagctgcctggagggcacggtcaccgtctcctcagcctccacaagggcccatcggtcttccccctggcaccctcctccaaagagcacctcgtgggggcacagcggtccctggggctgccttggtcaaggctacttccacgtagcgtnctgagcgggctggcgaaggcgcatagnngnnnnncnnnnnnnnnnnnnnnnnnnnnnnnnnnnnnn

SEQ ID NO: 205471 - DNA, 173 bp, Homo sapiens
  misc_feature: GYAE6OF01E4COY.30.25.C03.1.454.CMB.1.raw
tcagcacgctacgtcacgaccggtgctcgatttagtagtgtagatttgggtttgggggaagaggaagactgacggtccccccaggagttcaggtgctgggcacagcggccctgggctgcctggtcaaggactacttccacgtagcgtgctgagcgggctggcaaggcgcatag

SEQ ID NO: 205472 - DNA, 235 bp, Homo sapiens; identical to SEQ ID NO: 205318
  misc_feature: GYAE6OF01ACK9B.30.25.C03.1.454.CMB.1.raw
  modified_base (230)..(235): a, c, t, g, unknown or other
  misc_feature (230)..(235): n is a, c, g, or t

SEQ ID NO: 205473 - DNA, 136 bp, Homo sapiens
  misc_feature: GYAE6OF01A26UF.30.25.C03.1.454.CMB.1.raw
  modified_base (135)..(136): a, c, t, g, unknown or other
  misc_feature (135)..(136): n is a, c, g, or t
tcagcacgctacgtcacgaccggtgctcgatttagtagtgtagatttgggtttggggggaagaggaagactgacggtcctgccacagcggccctgggctgcctggtcaaggactacttccacgtagcgtgctgann

SEQ ID NO: 205474 - DNA, 235 bp, Homo sapiens
  misc_feature: GYAE6OF01DQ8P1.30.25.C03.1.454.CMB.1.raw
  modified_base (230)..(235): a, c, t, g, unknown or other
  misc_feature (230)..(235): n is a, c, g, or t
tcagcacgctacgtcacgaccggtgctcgatttagtagtgtagatttgggtttgggtgcccaagctgctggagggcacggtcaccgtctcctcagcctccaccaagggcccatcggtcttccccctggcaccctcctccaagagcacctcgtgggggcacagcggccctgggctgcctggtcaaggactacttccagtagcgtgctgagcgggctggcaaggcgcatagnnnnnn

SEQ ID NO: 205475 - DNA, 243 bp, Homo sapiens
  misc_feature: GYAE6OF01AT5YZ.30.25.C03.1.454.CMB.1.raw
  modified_base (223)..(223): a, c, t, g, unknown or other
  misc_feature (223)..(223): n is a, c, g, or t
  modified_base (228)..(243): a, c, t, g, unknown or other
  misc_feature (228)..(243): n is a, c, g, or t
tcagcacgctacgtcacgaccggtgctcgatttagtagtgtagatttgggtttgggtgcccaagctgctggagggcacggtcaccgtctcctcagcctccaccaaggcccatcggtcttccccctggcaccctcctcaagagcacctctgggggcacagcggccctgggctgcctggtcaaggactacttccacgtagcgtgctgagcggctggcgaaggcgnatagnnnnnnnnnnnnnnnn

SEQ ID NO: 205476 - DNA, 235 bp, Homo sapiens
  misc_feature: GYAE6OF01BYIUL.30.25.C03.1.454.CMB.1.raw
  modified_base (229)..(235): a, c, t, g, unknown or other
  misc_feature (229)..(235): n is a, c, g, or t
tcagcacgctacgtcacgaccggtgctcgatttagtagtgtagatttgggtttgggtgcccaagctgctggagggcacggtcaccgtctcctcagcctccaccaagggcccatcggtcttcccctggcactctcctccaagagcacctcgtggggcacagcggccctgggctgcctggtcaaggactacttccacgtagcgtgctgagcgggctggcaaggcgcatagnnnnnnn

SEQ ID NO: 205477 - DNA, 175 bp, Homo sapiens
  misc_feature: GYAE6OF01EGPMA.30.25.C03.1.454.CMB.1.raw
  modified_base (174)..(175): a, c, t, g, unknown or other
  misc_feature (174)..(175): n is a, c, g, or t
tcagcacgctacgtcacgaccggtgctcgatttagtagtgtagatttgggtttgggggaagaggaagactgacggtccccccaggagttcaggtgctgggcacagcggccctgggctgcctggtcaaggactacttccacgtagcgtgctgagcgggctggcaaggcgcatagnn

SEQ ID NO: 205478 - DNA, 195 bp, Homo sapiens
  misc_feature: GYAE6OF01B9BR2.30.25.C03.1.454.CMB.1.raw
  modified_base (168)..(168): a, c, t, g, unknown or other
  misc_feature (168)..(168): n is a, c, g, or t
  modified_base (174)..(195): a, c, t, g, unknown or other
  misc_feature (174)..(195): n is a, c, g, or t
tcagcacgctacgtcacgaccggtgctcgatttagtagtgtagatttgggtttggggggaagaggaagactgacggtcccccaggagttcaggtgctgggcacagcggccctgggctgcctggtcaaggactacttccacgtagcgtgctgagcgggctggcaaggcncatagnnnnnnnnnnnnnnnnnnnnnn

SEQ ID NO: 205479 - DNA, 179 bp, Homo sapiens
  misc_feature: GYAE6OF01D8U1G.30.25.C03.1.454.CMB.1.raw
  modified_base (174)..(179): a, c, t, g, unknown or other
  misc_feature (174)..(179): n is a, c, g, or t
tcagcacgctacgtcacgaccggtgctcgatttagtagtgtagatttgggtttgggggaagaggaagactgacggtccccccaggagttcaggtgctgggcacagcggccctgggctgcctggtcaaggactacttccacgtagcgtgctgagcgggctggcaaggcgcatagnnnnnn

SEQ ID NO: 205480 - DNA, 232 bp, Homo sapiens; identical to SEQ ID NO: 205063
  misc_feature: GYAE6OF01CHK4O.30.25.C03.1.454.CMB.1.raw
  modified_base (230)..(232): a, c, t, g, unknown or other
  misc_feature (230)..(232): n is a, c, g, or t

SEQ ID NO: 205481 - DNA, 237 bp, Homo sapiens; identical to SEQ ID NO: 205230
  misc_feature: GYAE6OF01BGBH4.30.25.C03.1.454.CMB.1.raw
  modified_base (230)..(237): a, c, t, g, unknown or other
  misc_feature (230)..(237): n is a, c, g, or t

SEQ ID NO: 205482 - DNA, 237 bp, Homo sapiens
  misc_feature: GYAE6OF01DM2KB.30.25.C03.1.454.CMB.1.raw
  modified_base (229)..(237): a, c, t, g, unknown or other
  misc_feature (229)..(237): n is a, c, g, or t
tcagcacgctacgtcacgaccggtgctcgatttagtagtgtagatttgggtttgggtgcccaagctgctggagggcacggtcaccgtctcctcagcctccaccaagggcccatcggtcttccccctggcaccctcctccaagagcacctctggggcacagcggccctgggctgcctggtcaaggactacttccacgtagcgtgctgagcgggctggcaaggcgcatagnnnnnnnnn

SEQ ID NO: 205483 - DNA, 237 bp, Homo sapiens
  misc_feature: GYAE6OF01CYUL0.30.25.C03.1.454.CMB.1.raw
  modified_base (228)..(237): a, c, t, g, unknown or other
  misc_feature (228)..(237): n is a, c, g, or t
tcagcacgctacgtcacgaccggtgctcgatttagtagtgtagatttgggtttgggtgcccaagctgctggagggcacggtcaccgtctcctcagcctccaccaagggcccatcggtcttccccctggcaccctcctccaagagcacctctggggcacagcggccctgggctgcctggtcaaggactacttcacgtagcgtgctgagcgggctggcaaggcgcatagnnnnnnnnnn

SEQ ID NO: 205484 - DNA, 184 bp, Homo sapiens
  misc_feature: GYAE6OF01A9TZQ.30.25.C03.1.454.CMB.1.raw
  modified_base (155)..(184): a, c, t, g, unknown or other
  misc_feature (155)..(184): n is a, c, g, or t
tcagcacgctacgtcacgaccggtgctcgatttagtagtgtagatttgggtttgggggaagaggaagactgacggtcctgccacagcggccctgggctgcctggtcaaggactacttccacgtagcgtgctgagcgggctggcaaggcgcatagnnnnnnnnnnnnnnnnnnnnnnnnnnnnnn

SEQ ID NO: 205485 - DNA, 231 bp, Homo sapiens; identical to SEQ ID NO: 205120
  misc_feature: GYAE6OF01BM6H2.30.25.C03.1.454.CMB.1.raw
  modified_base (230)..(231): a, c, t, g, unknown or other
  misc_feature (230)..(231): n is a, c, g, or t

SEQ ID NO: 205486 - DNA, 182 bp, Homo sapiens
  misc_feature: GYAE6OF01BLTQE.30.25.C03.1.454.CMB.1.raw
  modified_base (174)..(182): a, c, t, g, unknown or other
  misc_feature (174)..(182): n is a, c, g, or t
tcagcacgctacgtcacgaccggtgctcgatttagtagtgtagatttgggtttggggggaagaggaagactgacggtcccccaggagttcaggtgctgggcacagcggccctgggctgcctggtcaaggactacttccacgtagcgtgctgagcgggctggcaaggcgcatagnnnnnnnnn

SEQ ID NO: 205487 - DNA, 263 bp, Homo sapiens
  misc_feature: GYAE6OF01DW3JW.30.25.C03.1.454.CMB.1.raw
  modified_base (233)..(263): a, c, t, g, unknown or other
  misc_feature (233)..(263): n is a, c, g, or t
tcagcacgctacgtcacgaccggtgctcgatttagtagtgtagatttgggtttgggtgcccaagctgctggagggcacggtcaccgtctcctcagcctccaccaagggcccatcggtcttccccctggccaccctcctccaagagccacctctgggggcacagcggccctgggctgcctggtcaaggactacttccacgtagcgtgctggagcgggctggcaaggcgcatagnnnnnnnnnnnnnnnnnnnnnnnnnnnnnnn

SEQ ID NO: 205488 - DNA, 235 bp, Homo sapiens; identical to SEQ ID NO: 205318
  misc_feature: GYAE6OF01C6LB8.30.25.C03.1.454.CMB.1.raw
  modified_base (230)..(235): a, c, t, g, unknown or other
  misc_feature (230)..(235): n is a, c, g, or t

SEQ ID NO: 205489 - DNA, 162 bp, Homo sapiens; identical to SEQ ID NO: 205432
  misc_feature: GYAE6OF01C35V4.30.25.C03.1.454.CMB.1.raw
  modified_base (155)..(162): a, c, t, g, unknown or other
  misc_feature (155)..(162): n is a, c, g, or t

SEQ ID NO: 205490 - DNA, 157 bp, Homo sapiens
  misc_feature: GYAE6OF01BN5NN.30.25.C03.1.454.CMB.1.raw
  modified_base (149)..(149): a, c, t, g, unknown or other
  misc_feature (149)..(149): n is a, c, g, or t
  modified_base (155)..(157): a, c, t, g, unknown or other
  misc_feature (155)..(157): n is a, c, g, or t
tcagcacgctacgtcacgaccggtgctcgatttagtagtgtagatttgggtttgggggaagaggaagactgacggtcctgccacagcggccctgggctgcctggtcaaggactacttccacgtagcgtgctgagcgggctggcaaggcncatagnnn

SEQ ID NO: 205491 - DNA, 155 bp, Homo sapiens; identical to SEQ ID NO: 205076
  misc_feature: GYAE6OF01BN4IB.30.25.C03.1.454.CMB.1.raw
  modified_base (155)..(155): a, c, t, g, unknown or other
  misc_feature (155)..(155): n is a, c, g, or t

SEQ ID NO: 205492 - DNA, 156 bp, Homo sapiens; identical to SEQ ID NO: 205094
  misc_feature: GYAE6OF01E5PZF.30.25.C03.1.454.CMB.1.raw
  modified_base (155)..(156): a, c, t, g, unknown or other
  misc_feature (155)..(156): n is a, c, g, or t

SEQ ID NO: 205493 - DNA, 172 bp, Homo sapiens; identical to SEQ ID NO: 205167
  misc_feature: GYAE6OF01AYKR4.30.25.C03.1.454.CMB.1.raw

SEQ ID NO: 205494 - DNA, 177 bp, Homo sapiens
  misc_feature: GYAE6OF01DOXWS.30.25.C03.1.454.CMB.1.raw
  modified_base (174)..(177): a, c, t, g, unknown or other
  misc_feature (174)..(177): n is a, c, g, or t
tcagcacgctacgtcacgaccggtgctcgatttagtagtgtagatttgggtttggggggaagaggaagactgacggtcccccaggagttcaggtgctgggcacagcggccctgggctgcctggtcaaggactacttccacgtagcgtgctgagcgggctggcaaggcgcatagnnnn

SEQ ID NO: 205495 - DNA, 178 bp, Homo sapiens; identical to SEQ ID NO: 205093
  misc_feature: GYAE6OF01A4WN4.30.25.C03.1.454.CMB.1.raw
  modified_base (173)..(178): a, c, t, g, unknown or other
  misc_feature (173)..(178): n is a, c, g, or t

SEQ ID NO: 205496 - DNA, 239 bp, Homo sapiens
  misc_feature: GYAE6OF01CCRJK.30.25.C03.1.454.CMB.1.raw
  modified_base (231)..(239): a, c, t, g, unknown or other
  misc_feature (231)..(239): n is a, c, g, or t
tcagcacgctacgtcacgaccggtgctcgatttagtagtgtagatttgggtttgggtgcccaagctgctggagggcacggtcaccgtctcctcagcctccaccaagggcccatcggtcttcccctggccaccctcctccaagagcacctcgtgggggcacagcggccctgggctgcctggtcaaggactacttccacgtagcgtgctgagcgggctggcaaggcgcatagnnnnnnnnn

SEQ ID NO: 205497 - DNA, 179 bp, Homo sapiens
  misc_feature: GYAE6OF01EJORD.30.25.C03.1.454.CMB.1.raw
  modified_base (175)..(179): a, c, t, g, unknown or other
  misc_feature (175)..(179): n is a, c, g, or t
tcagcacgctacgtcacgaccggtgctcgatttagtagtgtagatttgggtttggggggaagaggaagactgacggtccccccaggagttcaggtgctgggcacagcggccctgggctgcctggtcaaggactacttccacgtagcgtgctgagcgggctggcaaggcgcatagnnnnn

SEQ ID NO: 205498 - DNA, 243 bp, Homo sapiens
  misc_feature: GYAE6OF01BKDYJ.30.25.C03.1.454.CMB.1.raw
  modified_base (228)..(243): a, c, t, g, unknown or other
  misc_feature (228)..(243): n is a, c, g, or t
tcagcacgctacgtcacgaccggtgctcgatttagtagtgtagatttgggtttgggtgcccaagctgctggagggcacggtcaccgtctcctcagcctccaccaagggcccatcggtcttcccctggcaccctcctccaagagcacctctggggcacagcggccctgggctgcctggtcaaggactacttccacgtagcgtgctgagcgggctggcaaggcgcatagnnnnnnnnnnnnnnnn

SEQ ID NO: 205499 - DNA, 177 bp, Homo sapiens; identical to SEQ ID NO: 205494
  misc_feature: GYAE6OF01BX336.30.25.C03.1.454.CMB.1.raw
  modified_base (174)..(177): a, c, t, g, unknown or other
  misc_feature (174)..(177): n is a, c, g, or t

SEQ ID NO: 205500 - DNA, 237 bp, Homo sapiens
  misc_feature: GYAE6OF01DY05P.30.25.C03.1.454.CMB.1.raw
  modified_base (230)..(237): a, c, t, g, unknown or other
  misc_feature (230)..(237): n is a, c, g, or t
tcagcacgctacgtcacgaccggtgctcgatttagtagtgtagatttgggtttgggtgcccaagctgctggagggcacggtcaccgtctcctcagcctccaccaagggcccatcggtcttcccctggcaccctcctccaagagcacctcgtgggggcacagcggccctgggctgcctggtcaaggactacttccacgtagcgtgctgagcgggctggcaaggcgcatagnnnnnnnn

SEQ ID NO: 205501 - DNA, 234 bp, Homo sapiens; identical to SEQ ID NO: 205242
  misc_feature: GYAE6OF01E41T3.30.25.C03.1.454.CMB.1.raw
  modified_base (230)..(234): a, c, t, g, unknown or other
  misc_feature (230)..(234): n is a, c, g, or t

SEQ ID NO: 205502 - DNA, 239 bp, Homo sapiens
  misc_feature: GYAE6OF01BXL5I.30.25.C03.1.454.CMB.1.raw
  modified_base (230)..(239): a, c, t, g, unknown or other
  misc_feature (230)..(239): n is a, c, g, or t
tcagcacgctacgtcacgaccggtgctcgatttagtagtgtagatttgggtttgggtgcccaagctgctggagggcacggtcaccgtctcctcagcctccaccaagggcccatcggtcttccccctggcaccctcctccaagagcacctctgggggcacagcggccctgggctgcctggtcaaggactacttccacgtagcgtgctgagcgggctggcaaggcgcatagnnnnnnnnnn

SEQ ID NO: 205503 - DNA, 194 bp, Homo sapiens
  misc_feature: GYAE6OF01A08F9.30.25.C03.1.454.CMB.1.raw
  modified_base (174)..(194): a, c, t, g, unknown or other
  misc_feature (174)..(194): n is a, c, g, or t
tcagcacgctacgtcacgaccggtgctcgatttagtagtgtagatttgggtttgggggaagaggaagactgacggtccccccaggagttcaggtgctgggcacagcggccctgggctgcctggtcaaggactacttccacgtagcgtgctgagcgggctggcaaggcgcatagnnnnnnnnnnnnnnnnnnnnn

SEQ ID NO: 205504 - DNA, 182 bp, Homo sapiens
  misc_feature: GYAE6OF01D6JWY.30.25.C03.1.454.CMB.1.raw
  modified_base (173)..(182): a, c, t, g, unknown or other
  misc_feature (173)..(182): n is a, c, g, or t
tcagcacgctacgtcacgaccggtgctcgatttagtagtgtagatttgggtttgggggaagaggaagactgacggtcccccaggagttcaggtgctgggcacagcggccctgggctgcctggtcaaggactacttccacgtagcgtgctgagcgggctggcaaggcgcatagnnnnnnnnnn

SEQ ID NO: 205505 - DNA, 243 bp, Homo sapiens
  misc_feature: GYAE6OF01CO581.30.25.C03.1.454.CMB.1.raw
  modified_base (232)..(243): a, c, t, g, unknown or other
  misc_feature (232)..(243): n is a, c, g, or t
tcagcacgctacgtcacgaccggtgctcgatttagtagtgtagatttgggtttgggtgcccaagctgctggagggcacggtcaccgtctcctcagcctccaccaagggcccatcggtcttccccctggccaccctcctccaagagcacctcgtgggggcacagcggccctgggctgcctggtcaaggactacttccacgtagcgtgctgagcgggctggcaaggcgcatagnnnnnnnnnnnn

SEQ ID NO: 205506 - DNA, 237 bp, Homo sapiens
  misc_feature: GYAE6OF01BF3J6.30.25.C03.1.454.CMB.1.raw
  modified_base (231)..(237): a, c, t, g, unknown or other
  misc_feature (231)..(237): n is a, c, g, or t
tcagcacgctacgtcacgaccggtgctcgatttagtagtgtagatttgggtttgggtgcccaagctgctggagggcacggtcaccgtctcctcagcctccaccaagggcccatcggtcttccccctggcaccctcctccaagagcacctctgggggcacagcggccctgggctgcctggtcaaggactacttccacgtagcgtgctgagcgggctgggcaaggcgcatagnnnnnnn

SEQ ID NO: 205507 - DNA, 179 bp, Homo sapiens; identical to SEQ ID NO: 205264
  misc_feature: GYAE6OF01CINND.30.25.C03.1.454.CMB.1.raw
  modified_base (173)..(179): a, c, t, g, unknown or other
  misc_feature (173)..(179): n is a, c, g, or t

SEQ ID NO: 205508 - DNA, 235 bp, Homo sapiens; identical to SEQ ID NO: 205318
  misc_feature: GYAE6OF01DY0OF.30.25.C03.1.454.CMB.1.raw
  modified_base (230)..(235): a, c, t, g, unknown or other
  misc_feature (230)..(235): n is a, c, g, or t

SEQ ID NO: 205509 - DNA, 231 bp, Homo sapiens
  misc_feature: GYAE6OF01AJTX5.30.25.C03.1.454.CMB.1.raw
  modified_base (224)..(231): a, c, t, g, unknown or other
  misc_feature (224)..(231): n is a, c, g, or t
tcagcacgctacgtcacgaccggtgctcgatttagtagtgtagatttgggtttgggtgcccaagctgctggagggcacggtcaccgtctcctcagcctccaccaaggcccatcggtcttcccctggcacctcctcaagagcactctggggcacagcggccctgggctgcctggtcaaggactacttccacgtagcgtgctgagcgggctggcaaggcgcatagnnnnnnnn

SEQ ID NO: 205510 - DNA, 158 bp, Homo sapiens; identical to SEQ ID NO: 205153
  misc_feature: GYAE6OF01DNNUM.30.25.C03.1.454.CMB.1.raw
  modified_base (155)..(158): a, c, t, g, unknown or other
  misc_feature (155)..(158): n is a, c, g, or t

SEQ ID NO: 205511 - DNA, 232 bp, Homo sapiens
  misc_feature: GYAE6OF01BMC9D.30.25.C03.1.454.CMB.1.raw
  modified_base (231)..(232): a, c, t, g, unknown or other
  misc_feature (231)..(232): n is a, c, g, or t
tcagcacgctacgtcacgaccggtgctcgatttagtagtgtagatttgggtttgggtgcccaagctgctggagggcacggtcaccgttctcctcagcctccaccaagggcccatcggtcttccccctggcaccctcctccaagagcacctctgggggcacagcggccctgggctgcctggtcaaggactacttccacgtagcgtgctgagcgggctggcaaggcgcatagnn

SEQ ID NO: 205512 - DNA, 268 bp, Homo sapiens
  misc_feature: GYAE6OF01DWILD.30.25.C03.1.454.CMB.1.raw
  modified_base (221)..(221): a, c, t, g, unknown or other
  misc_feature (221)..(221): n is a, c, g, or t
  modified_base (226)..(268): a, c, t, g, unknown or other
  misc_feature (226)..(268): n is a, c, g, or t
tcagcacgctacgtcacgaccggtgctcgatttagtagtgtagatttgggtttgggtgcccaagctgctggagggcacggtcaccgtctcctcagcctccacaagggcccatcggtcttccccctggccaccctcctccaagagcacctcgtggggctacagcggcctgggctgcctgcaaggactactcacgtagcgtgctggagcgggctggcaggcgnatagnnnnnnnnnnnnnnnnnnnnnnnnnnnnnnnnnnnnnnnnnnn

SEQ ID NO: 205513 - DNA, 235 bp, Homo sapiens; identical to SEQ ID NO: 205318
  misc_feature: GYAE6OF01AG0O9.30.25.C03.1.454.CMB.1.raw
  modified_base (230)..(235): a, c, t, g, unknown or other
  misc_feature (230)..(235): n is a, c, g, or t

SEQ ID NO: 205514 - DNA, 245 bp, Homo sapiens
  misc_feature: GYAE6OF01C1C6G.30.25.C03.1.454.CMB.1.raw
  modified_base (211)..(211): a, c, t, g, unknown or other
  misc_feature (211)..(211): n is a, c, g, or t
  modified_base (231)..(245): a, c, t, g, unknown or other
  misc_feature (231)..(245): n is a, c, g, or t
tcagcacgctacgtcacgaccggtgctcgatttagtagtgtagatttgggtttgggtgcccaagctgctggagggcacggtcaccgtctcctcagcctccaccaagggcccatcggtcttccccctggcaccctcctccaagagcacctcgtgggggcacgagccggccctgggctgcctggtcaaggactacttccacgtagcgtgctgngcggctggcgagcgcatagnnnnnnnnnnnnnnn

SEQ ID NO: 205515 - DNA, 232 bp, Homo sapiens
  misc_feature: GYAE6OF01D0EO2.30.25.C03.1.454.CMB.1.raw
  modified_base (231)..(232): a, c, t, g, unknown or other
  misc_feature (231)..(232): n is a, c, g, or t
tcagcacgctacgtcacgaccggtgctcgatttagtagtgtagatttgggtttgggtgcccaagctgctggagggcacggtcaccgtctcctcagcctccaccaagggcccatcggtcttccccctggcaccctcctccaagagcacctcgtgggggcacagcggccctgggctgcctggtcaaggactacttccacgtagcgtgctgagcgggctggcaaggcgcatagnn

SEQ ID NO: 205516 - DNA, 219 bp, Homo sapiens
  misc_feature: GYAE6OF01AIUWF.30.25.C03.1.454.CMB.1.raw
  modified_base (173)..(219): a, c, t, g, unknown or other
  misc_feature (173)..(219): n is a, c, g, or t
tcagcacgctacgtcacgaccggtgctcgatttagtagtgtagatttgggttggggggaagaggaagactgacggtcccccaggagttcaggtgctgggcacagcggccctgggctgcctggtcaaggactacttccacgtagcgtgctgagcgggctggcaaggcgcatagnnnnnnnnnnnnnnnnnnnnnnnnnnnnnnnnnnnnnnnnnnnnnnn

SEQ ID NO: 205517 - DNA, 235 bp, Homo sapiens; identical to SEQ ID NO: 205318
  misc_feature: GYAE6OF01BVU2U.30.25.C03.1.454.CMB.1.raw
  modified_base (230)..(235): a, c, t, g, unknown or other
  misc_feature (230)..(235): n is a, c, g, or t

SEQ ID NO: 205518 - DNA, 235 bp, Homo sapiens
  misc_feature: GYAE6OF01EW1XB.30.25.C03.1.454.CMB.1.raw
  modified_base (231)..(235): a, c, t, g, unknown or other
  misc_feature (231)..(235): n is a, c, g, or t
tcagcacgctacgtcacgaccggtgctcgatttagtagtgtagatttgggtttgggtgcccaagctgctggagggcacggtcaccgtctcctcagcctccaccaagggcccatcggtcttccccctggcacccctcctccaagagcacctctgggggcacagcggccctgggctgcctggtcaaggactacttccacgtagcgtgctgagcgggctggcaaggcgcatagnnnnn

SEQ ID NO: 205519 - DNA, 155 bp, Homo sapiens; identical to SEQ ID NO: 205076
  misc_feature: GYAE6OF01EUVPG.30.25.C03.1.454.CMB.1.raw
  modified_base (155)..(155): a, c, t, g, unknown or other
  misc_feature (155)..(155): n is a, c, g, or t

SEQ ID NO: 205520 - DNA, 236 bp, Homo sapiens
  misc_feature: GYAE6OF01BOO0Y.30.25.C03.1.454.CMB.1.raw
  modified_base (228)..(236): a, c, t, g, unknown or other
  misc_feature (228)..(236): n is a, c, g, or t
tcagcacgctacgtcacgaccggtgctcgatttagtagtgtagatttgggtttgggtgcccaagctgctggagggcacggtcaccgtctcctcagcctccaccaagggcccatcggtcttcccctggcaccctcctccaagagcacctctgggggcacagcggccctgggctgcctggtcaaggactacttccacgtagcgtgctgagcggctggcaaggcgcatagnnnnnnnnn

SEQ ID NO: 205521 - DNA, 167 bp, Homo sapiens
  misc_feature: GYAE6OF01C0PSD.30.25.C03.1.454.CMB.1.raw
  modified_base (150)..(150): a, c, t, g, unknown or other
  misc_feature (150)..(150): n is a, c, g, or t
  modified_base (156)..(167): a, c, t, g, unknown or other
  misc_feature (156)..(167): n is a, c, g, or t
tcagcacgctacgtcacgaccggtgctcgatttagtagtgtagatttgggtttggggggaagaggaagactgacggtcctgccacagcggccctgggctgcctggtcaaggactacttccacgtagcgtgctgagcgggctggcaaggcncatagnnnnnnnnnnnn

SEQ ID NO: 205522 - DNA, 179 bp, Homo sapiens; identical to SEQ ID NO: 205264
  misc_feature: GYAE6OF01EULJI.30.25.C03.1.454.CMB.1.raw
  modified_base (173)..(179): a, c, t, g, unknown or other
  misc_feature (173)..(179): n is a, c, g, or t

SEQ ID NO: 205523 - DNA, 156 bp, Homo sapiens; identical to SEQ ID NO: 205460
  misc_feature: GYAE6OF01AM9SK.30.25.C03.1.454.CMB.1.raw
  modified_base (156)..(156): a, c, t, g, unknown or other
  misc_feature (156)..(156): n is a, c, g, or t

SEQ ID NO: 205524 - DNA, 246 bp, Homo sapiens
  misc_feature: GYAE6OF01CT935.30.25.C03.1.454.CMB.1.raw
  modified_base (233)..(246): a, c, t, g, unknown or other
  misc_feature (233)..(246): n is a, c, g, or t
tcagcacgctacgtcacgaccggtgctcgatttagtagtgtagatttgggtttgggtgcccaagctgctggagggcacggtcaccgtctcctcagcctccaccaagggcccatcggtcttccccctggccaccctcctccaagagcaccgtcgtgggggcacagcggccctgggctgcctggtcaaggactacttccacgtagcgtgctgagcgggctggcaaggcgcatagnnnnnnnnnnnnnn

SEQ ID NO: 205525 - DNA, 184 bp, Homo sapiens
  misc_feature: GYAE6OF01C3WSS.30.25.C03.1.454.CMB.1.raw
  modified_base (173)..(184): a, c, t, g, unknown or other
  misc_feature (173)..(184): n is a, c, g, or t
tcagcacgctacgtcacgaccggtgctcgatttagtagtgtagatttgggtttggggggaagaggaagactgacggtcccccaggagttcaggtgctgggcacagcggccctgggctgcctggtcaaggactactccacgtagcgtgctgagcgggctggcaaggcgcatagnnnnnnnnnnnn

SEQ ID NO: 205526 - DNA, 181 bp, Homo sapiens
  misc_feature: GYAE6OF01CUIUD.30.25.C03.1.454.CMB.1.raw
  modified_base (173)..(181): a, c, t, g, unknown or other
  misc_feature (173)..(181): n is a, c, g, or t
tcagcacgctacgtcacgaccggtgctcgatttagtagtgtagatttgggtttggggggaagaggaagactgacggtccccccaggagttcaggtgctgggcacagcggccctgggctgcctggtcaaggctacttccacgtagcgtgctgagcgggctggcaaggcgcatgnnnnnnnnn

SEQ ID NO: 205527 - DNA, 237 bp, Homo sapiens
  misc_feature: GYAE6OF01BXEI8.30.25.C03.1.454.CMB.1.raw
  modified_base (231)..(237): a, c, t, g, unknown or other
  misc_feature (231)..(237): n is a, c, g, or t
tcagcacgctacgtcacgaccggtgctcgatttagtagtgtagatttgggtttgggtgcccaagctgctggagggcacggtcaccgtctcctcagcctccaccaagggcccatcggtcttcccctggcaccctcctccaagagcacctcgtgggggcacagcggccctgggctgcctggtcaaggactacttccacgtagcgtgctgagcgggctggcaaggcgcagtagnnnnnnn

SEQ ID NO: 205528 - DNA, 259 bp, Homo sapiens
  misc_feature: GYAE6OF01CMGHY.30.25.C03.1.454.CMB.1.raw
  modified_base (237)..(239): a, c, t, g, unknown or other
  misc_feature (237)..(239): n is a, c, g, or t
  modified_base (241)..(259): a, c, t, g, unknown or other
  misc_feature (241)..(259): n is a, c, g, or t
tcagcacgctacgtcacgaccggtgctcgatttagtagtgtagatttgggtttgggtgcccaagctgctggaggcacggtcaccgtctcctcagcctccaccgaagggcccatcggtccttccccctggccaccctcctccaagagccacctcgtggggcacaggcggcccgtgggctgcctggtacaaggactactccacgtagcgtgctgacgcgggctggacaaggcgcatagnnngnnnnnnnnnnnnnnnnnnn

SEQ ID NO: 205529 - DNA, 246 bp, Homo sapiens
  misc_feature: GYAE6OF01ADAQL.30.25.C03.1.454.CMB.1.raw
  modified_base (230)..(246): a, c, t, g, unknown or other
  misc_feature (230)..(246): n is a, c, g, or t
tcagcacgctacgtcacgaccggtgctcgatttagtagtgtagatttgggtttgggtgcccaagctgctggagggcacggtcaccgtctcctcagcctccaccaagggcccatcggtcttccccctggcaccctcctccaagagcacctctgggggcacagcggccctgggctgcctggtcaaggactacttccacgtagcgtgctgagcgggctggcaaggcgcatagnnnnnnnnnnnnnnnnn

SEQ ID NO: 205530 - DNA, 246 bp, Homo sapiens
  misc_feature: GYAE6OF01EOSUV.30.25.C03.1.454.CMB.1.raw
  modified_base (234)..(246): a, c, t, g, unknown or other
  misc_feature (234)..(246): n is a, c, g, or t
tcagcacgctacgtcacgaccggtgctcgatttagtagtgtagatttgggtttgggtgcccaagctgctggagggcacggtcaccgtctcctcagcctccaccaagggcccatcggtcttccccctggcaccctcctccaagagcacctcgtgggggcacagcggccctgggctgcctggtcaaggactacttccagtagcgtgctgagcgggctgggacaagggcgcagtagnnnnnnnnnnnnn

SEQ ID NO: 205531 - DNA, 240 bp, Homo sapiens
  misc_feature: GYAE6OF01AUL40.30.25.C03.1.454.CMB.1.raw
  modified_base (234)..(240): a, c, t, g, unknown or other
  misc_feature (234)..(240): n is a, c, g, or t
tcagcacgctacgtcacgaccggtgctcgatttagtagtgtagatttgggtttgggtgcccaagctgctggagggcacggtcaccgtctcctcagcctccaccaagggcccatcggtcttccccctggccaccctcctccaagagcacctcgtgggggcacagcggcccgtgggctgcctggtacaaggacctacttccacgtagcgtgctgagcggctggcaaggcgcatagnnnnnnn

SEQ ID NO: 205532 - DNA, 231 bp, Homo sapiens; identical to SEQ ID NO: 205120
  misc_feature: GYAE6OF01B9D00.30.25.C03.1.454.CMB.1.raw
  modified_base (230)..(231): a, c, t, g, unknown or other
  misc_feature (230)..(231): n is a, c, g, or t

SEQ ID NO: 205533 - DNA, 177 bp, Homo sapiens; identical to SEQ ID NO: 205232
  misc_feature: GYAE6OF01BDPY6.30.25.C03.1.454.CMB.1.raw
  modified_base (173)..(177): a, c, t, g, unknown or other
  misc_feature (173)..(177): n is a, c, g, or t

SEQ ID NO: 205534 - DNA, 286 bp, Homo sapiens
  misc_feature: GYAE6OF01BQYTV.30.25.C03.1.454.CMB.1.raw
  modified_base (264)..(286): a, c, t, g, unknown or other
  misc_feature (264)..(286): n is a, c, g, or t
tcagcacgctacgtcacgaccggtgctcgatttagtagtgtagatttgggtttgggtgcccaagctgctggagggcacggtcaccgtctcctcagcctccaccaaggcccatccggtccttcccctggccaccctcctccaagacgcacctcgtgggggcacgacggccggtcccgtgggctcgcccgttggtacaaacggtaccttaccttaccgacggtagcggtcgcgtggacggcgggcgtggacgaaggcgactagagnnnnnnnnnnnnnnnnnnnnnnn

SEQ ID NO: 205535 - DNA, 175 bp, Homo sapiens; identical to SEQ ID NO: 205102
  misc_feature: GYAE6OF01BBQ05.30.25.C03.1.454.CMB.1.raw
  modified_base (173)..(175): a, c, t, g, unknown or other
  misc_feature (173)..(175): n is a, c, g, or t

SEQ ID NO: 205536 - DNA, 245 bp, Homo sapiens
  misc_feature: GYAE6OF01EMMUT.30.25.C03.1.454.CMB.1.raw
  modified_base (208)..(208): a, c, t, g, unknown or other
  misc_feature (208)..(208): n is a, c, g, or t
  modified_base (217)..(217): a, c, t, g, unknown or other
  misc_feature (217)..(217): n is a, c, g, or t
  modified_base (230)..(245): a, c, t, g, unknown or other
  misc_feature (230)..(245): n is a, c, g, or t
tcagcacgctacgtcacgaccggtgctcgatttagtagtgtagatttgggtttgggtgcccaagctgctggagggcacggtcaccgtctcctcagcctccaccaagggcccatcggtcttccccctggcaccctcctccaagagcacctctgggggcacagccggcctgggctgcctggtcaaggactacttccacgtagcgtgctgngcggctggnaacggcgcatagnnnnnnnnnnnnnnnn

SEQ ID NO: 205537 - DNA, 177 bp, Homo sapiens
  misc_feature: GYAE6OF01AK30G.30.25.C03.1.454.CMB.1.raw
  modified_base (173)..(177): a, c, t, g, unknown or other
  misc_feature (173)..(177): n is a, c, g, or t
tcagcacgctacgtcacgaccggtgctcgatttagtagtgtagatttgggtttgggggaagaggaagactgaccggtcccccaggagttcaggtgctgggcacagcggccctgggctgcctggtcaaggactacttccacgtagcgtctgagcgggctggcaaggcgcatagnnnnn

SEQ ID NO: 205538 - DNA, 241 bp, Homo sapiens
  misc_feature: GYAE6OF01DSA3B.30.25.C03.1.454.CMB.1.raw
  modified_base (226)..(226): a, c, t, g, unknown or other
  misc_feature (226)..(226): n is a, c, g, or t
  modified_base (232)..(241): a, c, t, g, unknown or other
  misc_feature (232)..(241): n is a, c, g, or t
tcagcacgctacgtcacgaccggtgctcgatttagtagtgtagatttgggtttgggtgcccaagctgctggagggcacggtcaccgtctcctcagcctccaccaagggcccatcggtcttccccctggccaccctcctccaagagcacctcgtgggggcacagcggccctgggctgcctggtcaaggactacttccacgtagcgtgctgagcgggctggcaaggcncatagnnnnnnnnnn

SEQ ID NO: 205539 - DNA, 263 bp, Homo sapiens
  misc_feature: GYAE6OF01CSKPK.30.25.C03.1.454.CMB.1.raw
  modified_base (93)..(93): a, c, t, g, unknown or other
  misc_feature (93)..(93): n is a, c, g, or t
  modified_base (245)..(263): a, c, t, g, unknown or other
  misc_feature (245)..(263): n is a, c, g, or t
tcagcacgctacgtcacgaccggtgctcgatttagtagtgtagatttgggtttgggtgcccaagctgctggagggcacggtcaccgtctcctnagcctccaccaaggcccatcggtccttcccctggccaccctcctccaagagccacctcgtggggcacgagccggcccgtgggctcgcctggtacaaggtactacttccgaagtagcgtgctggacggcgggcgtggacgaaggcgcagtagnnnnnnnnnnnnnnnnnnn

SEQ ID NO: 205540 - DNA, 183 bp, Homo sapiens
  misc_feature: GYAE6OF01B8DXW.30.25.C03.1.454.CMB.1.raw
  modified_base (173)..(183): a, c, t, g, unknown or other
  misc_feature (173)..(183): n is a, c, g, or t
tcagcacgctacgtcacgaccggtgctcgatttagtagtgtagatttgggtttggggggaagaggaagactgacggtcccccaggagttcaggtgctgggcacagcggccctgggctgcctggtcaaggactacttcccgtagcgtgctgagcgggctggcaaggcgcatagnnnnnnnnnnn

SEQ ID NO: 205541 - DNA, 258 bp, Homo sapiens
  misc_feature: GYAE6OF01BRB50.30.25.C03.1.454.CMB.1.raw
  modified_base (235)..(258): a, c, t, g, unknown or other
  misc_feature (235)..(258): n is a, c, g, or t
tcagcacgctacgtcacgaccggtgctcgatttagtagtgtagatttgggtttgggtgcccaagctgctggagggcacggtcaccgtctcctcagcctccaccaagggcccatcggtctttccccctggccaccctcctccaagagcacctctgggggcacagcggtccctgggctggcctggtacaaggactacttccacgtagcgtgctgaggcgggctgcaaggcgcagtannnnnnnnnnnnnnnnnnnnnnnn

SEQ ID NO: 205542 - DNA, 260 bp, Homo sapiens
  misc_feature: GYAE6OF01D1NCU.30.25.C03.1.454.CMB.1.raw
  modified_base (231)..(260): a, c, t, g, unknown or other
  misc_feature (231)..(260): n is a, c, g, or t
tcagcacgctacgtcacgaccggtgctcgatttagtagtgtagatttgggtttgggtgcccaagctgctggagggcacggtcaccgtctcctcagcctccaccaagggcccatcggtcttccccctggccaccctcctccaagagcacctcgtgggggcacagcggccctgggctgcctggtcaaggactacttccagtagcgtgctgagcgggctggcaaggcgcatagnnnnnnnnnnnnnnnnnnnnnnnnnnnnnn

SEQ ID NO: 205543 - DNA, 158 bp, Homo sapiens
  misc_feature: GYAE6OF01C5YWK.30.25.C03.1.454.CMB.1.raw
  modified_base (151)..(151): a, c, t, g, unknown or other
  misc_feature (151)..(151): n is a, c, g, or t
  modified_base (157)..(158): a, c, t, g, unknown or other
  misc_feature (157)..(158): n is a, c, g, or t
tcagcacgctacgtcacgaccggtgctcgatttagtagtgtagatttgggtttgggggaagaggaagactgacggtcctgccacagcggccctgggctgcctggtcaaaggacctacttccacgtagcgtgctgagcgggctggcaaggcncatagnn

SEQ ID NO: 205544 - DNA, 488 bp, Homo sapiens
  misc_feature: GYAE6OF01CA4VY.30.25.C03.1.454.CMB.1.raw
  modified_base (131)..(131): a, c, t, g, unknown or other
  misc_feature (131)..(131): n is a, c, g, or t
  modified_base (144)..(144): a, c, t, g, unknown or other
  misc_feature (144)..(144): n is a, c, g, or t
  modified_base (233)..(233): a, c, t, g, unknown or other
  misc_feature (233)..(233): n is a, c, g, or t
  modified_base (239)..(242): a, c, t, g, unknown or other
  misc_feature (239)..(242): n is a, c, g, or t
  modified_base (245)..(245): a, c, t, g, unknown or other
  misc_feature (245)..(245): n is a, c, g, or t
  modified_base (248)..(248): a, c, t, g, unknown or other
  misc_feature (248)..(248): n is a, c, g, or t
  modified_base (252)..(252): a, c, t, g, unknown or other
  misc_feature (252)..(252): n is a, c, g, or t
  modified_base (256)..(256): a, c, t, g, unknown or other
  misc_feature (256)..(256): n is a, c, g, or t
  modified_base (261)..(261): a, c, t, g, unknown or other
  misc_feature (261)..(261): n is a, c, g, or t
  modified_base (265)..(266): a, c, t, g, unknown or other
  misc_feature (265)..(266): n is a, c, g, or t
  modified_base (268)..(268): a, c, t, g, unknown or other
  misc_feature (268)..(268): n is a, c, g, or t
  modified_base (271)..(271): a, c, t, g, unknown or other
  misc_feature (271)..(271): n is a, c, g, or t
  modified_base (274)..(274): a, c, t, g, unknown or other
  misc_feature (274)..(274): n is a, c, g, or t
  modified_base (277)..(278): a, c, t, g, unknown or other
  misc_feature (277)..(278): n is a, c, g, or t
  modified_base (283)..(283): a, c, t, g, unknown or other
  misc_feature (283)..(283): n is a, c, g, or t
  modified_base (291)..(291): a, c, t, g, unknown or other
  misc_feature (291)..(291): n is a, c, g, or t
  modified_base (296)..(296): a, c, t, g, unknown or other
  misc_feature (296)..(296): n is a, c, g, or t
  modified_base (299)..(299): a, c, t, g, unknown or other
  misc_feature (299)..(299): n is a, c, g, or t
  modified_base (310)..(310): a, c, t, g, unknown or other
  misc_feature (310)..(310): n is a, c, g, or t
  modified_base (316)..(316): a, c, t, g, unknown or other
  misc_feature (316)..(316): n is a, c, g, or t
  modified_base (321)..(321): a, c, t, g, unknown or other
  misc_feature (321)..(321): n is a, c, g, or t
  modified_base (345)..(345): a, c, t, g, unknown or other
  misc_feature (345)..(345): n is a, c, g, or t
  modified_base (351)..(351): a, c, t, g, unknown or other
  misc_feature (351)..(351): n is a, c, g, or t
  modified_base (357)..(357): a, c, t, g, unknown or other
  misc_feature (357)..(357): n is a, c, g, or t
  modified_base (367)..(367): a, c, t, g, unknown or other
  misc_feature (367)..(367): n is a, c, g, or t
  modified_base (394)..(394): a, c, t, g, unknown or other
  misc_feature (394)..(394): n is a, c, g, or t
  modified_base (409)..(409): a, c, t, g, unknown or other
  misc_feature (409)..(409): n is a, c, g, or t
  modified_base (431)..(431): a, c, t, g, unknown or other
  misc_feature (431)..(431): n is a, c, g, or t
  modified_base (459)..(459): a, c, t, g, unknown or other
  misc_feature (459)..(459): n is a, c, g, or t
tcagcacgctacgtcacgaccggtgctcgatttagtagtgtagatttgggtttgggtggcccaagctgcgtggaggcacggtcaccgtctcctcagcctccaccaagggcccatcggtcttccccctggcnccctcctccaagngctacctcgtgggggcacagccggccctgggcctgcctaggtcaaggtctaccttccacgtacgcgtgctgagcgggctggacaaggcncatagnnnngantangtgnacgntagtntgtnnanatntancgnngcagnagtctgantacgntanactgccgtacngtacgnaggtntacatggcaggcagcgcaggaccngcacgnttcgcnatctgaatcncgtgttagcaggcatccggatgaaccntgtagtcgtacgagntaaccgttcgtgtgacgttcgngcgtacgtctcgtaagcgtacgcgtccncggtaacgctaccgtcgccgtccgtaacg

SEQ ID NO: 205545 - DNA, 261 bp, Homo sapiens
  misc_feature: GYAE6OF01BPFBZ.30.25.C03.1.454.CMB.1.raw
  modified_base (232)..(261): a, c, t, g, unknown or other
  misc_feature (232)..(261): n is a, c, g, or t
tcagcacgctacgtcacgaccggtgctcgatttagtagtgtagatttgggtttgggtgcccaagctgctggagggcacggtcaccgtctcctcagcctccaccaagggcccatcggtcttccccctggcaccctcctccaagagcacctcgtgggggcacaggcggccctgggctgcctaggtcaaggactacttccacgtagcgtgctgaggcggctggcaggcgcatagnnnnnnnnnnnnnnnnnnnnnnnnnnnnnn

SEQ ID NO: 205546 - DNA, 235 bp, Homo sapiens
  misc_feature: GYAE6OF01BEOFL.30.25.C03.1.454.CMB.1.raw
  modified_base (228)..(235): a, c, t, g, unknown or other
  misc_feature (228)..(235): n is a, c, g, or t
tcagcacgctacgtcacgaccggtgctcgatttagtagtgtagatttgggtttgggtgcccaagctgctggagggcacggtcaccgtctcctcagcctccaccaagggcccatcggtcttccccctggcaccctcctccaagagtacctctggggcacagcggccctgggctgcctggtcaaggactacttccacgtagcgtgctgagcggctggcaaggcgcatagnnnnnnnn

SEQ ID NO: 205547 - DNA, 213 bp, Homo sapiens
  misc_feature: GYAE6OF01E1YIP.30.25.C03.1.454.CMB.1.raw
  modified_base (177)..(213): a, c, t, g, unknown or other
  misc_feature (177)..(213): n is a, c, g, or t
tcagcacgctacgtcacgaccggtgctcgatttagtagtgtagatttgggtttgggggggaagaggaagactgacggtccccccaggagttcaggtgctgggcacagcggccctgggctgcctggtcaaggactacttccacgtagcgtgctgagcgggctggcaaggtcgcatagnnnnnnnnnnnnnnnnnnnnnnnnnnnnnnnnnnnnn

SEQ ID NO: 205548 - DNA, 268 bp, Homo sapiens
  misc_feature: GYAE6OF01CLCUC.30.25.C03.1.454.CMB.1.raw
  modified_base (146)..(146): a, c, t, g, unknown or other
  misc_feature (146)..(146): n is a, c, g, or t
  modified_base (251)..(268): a, c, t, g, unknown or other
  misc_feature (251)..(268): n is a, c, g, or t
tcagcacgctacgtcacgaccggtgctcgatttagtagtgtagatttgggtttgggtgcccaagctgctggagggcacggtcaccgtctcctcagcctccaccaagggcccatcggtccttccccctggccaccctcctccaaagngccacctcggtgggggccacgacggccggcccgtgggctcgccgtggtacaacggctaccttccaacggtcgcgtgctggcggcggctggacgacgcgatgagcnnnnnnnnnnnnnnnnnn

SEQ ID NO: 205549 - DNA, 209 bp, Homo sapiens
  misc_feature: GYAE6OF01A9KOB.30.25.C03.1.454.CMB.1.raw
  modified_base (175)..(209): a, c, t, g, unknown or other
  misc_feature (175)..(209): n is a, c, g, or t
tcagcacgctacgtcacgaccggtgctcgatttagtagtgtagatttgggtttggggggaagaggaagactgacggtccccccaggagttcaggtgctgggcacagcggccctgggctgcctggtcaaggactacttccacgtagcgtgactgagcgggctggcaggcgcatagnnnnnnnnnnnnnnnnnnnnnnnnnnnnnnnnnnn

SEQ ID NO: 205550 - DNA, 178 bp, Homo sapiens
  misc_feature: GYAE6OF01EFJU0.30.25.C03.1.454.CMB.1.raw
  modified_base (174)..(178): a, c, t, g, unknown or other
  misc_feature (174)..(178): n is a, c, g, or t
tcagcacgctacgtcacgaccggtgctcgatttagtagtgtagatttgggtttgggggaagaggaagactgacggtccccccaggagttcaggtgctgggcacagcggccctgggctgcctggtcaaggactacttccacgtagcgtgctgagcgggctggcaaggcgcatagnnnnn

SEQ ID NO: 205551 - DNA, 297 bp, Homo sapiens
  misc_feature: GYAE6OF01BBKG9.30.25.C03.1.454.CMB.1.raw
  modified_base (246)..(246): a, c, t, g, unknown or other
  misc_feature (246)..(246): n is a, c, g, or t
  modified_base (248)..(297): a, c, t, g, unknown or other
  misc_feature (248)..(297): n is a, c, g, or t
tcagcacgctacgtcacgaccggtgctcgatttagtagtgtagatttgggtttgggtgcccaagctgctggagggcacggtcaccgtctcctcagcctccaccaagggccccatcggtcttcccccctgggccacccctcctccaaagagccacctcgtgggggcacagcggtccctgggctgcctggtcaaggcctacttccacgtagccgtgctggacgcgggctggcgaaagggcgcaatagntnnnnnnnnnnnnnnnnnnnnnnnnnnnnnnnnnnnnnnnnnnnnnnnnnn

SEQ ID NO: 205552 - DNA, 242 bp, Homo sapiens
  misc_feature: GYAE6OF01AY6LH.30.25.C03.1.454.CMB.1.raw
  modified_base (233)..(242): a, c, t, g, unknown or other
  misc_feature (233)..(242): n is a, c, g, or t
tcagcacgctacgtcacgaccggtgctcgatttagtagtgtagatttgggtttgggtgcccaagctgctggagggcacggtcaccgtctcctcagcctccaccaagggcccatcggtcttccccctggcaccctcctccaagagcacctcgtggggcacagcggccctgggctgcctggtcaaggactacttccacgtagcgtgctggagtcgggctggcgaaggcgcatagnnnnnnnnnn

SEQ ID NO: 205553 - DNA, 169 bp, Homo sapiens
  misc_feature: GYAE6OF01DONML.30.25.C03.1.454.CMB.1.raw
  modified_base (158)..(169): a, c, t, g, unknown or other
  misc_feature (158)..(169): n is a, c, g, or t
tcagcacgctacgtcacgaccggtgctcgatttagtagtgtagatttgggtttggggggaagaggaagactgacggtcctgccacagcggccctgggctgcctggtcaaggactacttccacgtagcgtgctggaggcgggctggcaaggcgcatagnnnnnnnnnnnn

SEQ ID NO: 205554 - DNA, 343 bp, Homo sapiens
  misc_feature: GYAE6OF01BIJQG.30.25.C03.1.454.CMB.1.raw
  modified_base (143)..(143): a, c, t, g, unknown or other
  misc_feature (143)..(143): n is a, c, g, or t
  modified_base (228)..(231): a, c, t, g, unknown or other
  misc_feature (228)..(231): n is a, c, g, or t
  modified_base (233)..(235): a, c, t, g, unknown or other
  misc_feature (233)..(235): n is a, c, g, or t
  modified_base (237)..(238): a, c, t, g, unknown or other
  misc_feature (237)..(238): n is a, c, g, or t
  modified_base (240)..(240): a, c, t, g, unknown or other
  misc_feature (240)..(240): n is a, c, g, or t
  modified_base (246)..(246): a, c, t, g, unknown or other
  misc_feature (246)..(246): n is a, c, g, or t
  modified_base (248)..(248): a, c, t, g, unknown or other
  misc_feature (248)..(248): n is a, c, g, or t
  modified_base (254)..(254): a, c, t, g, unknown or other
  misc_feature (254)..(254): n is a, c, g, or t
  modified_base (258)..(261): a, c, t, g, unknown or other
  misc_feature (258)..(261): n is a, c, g, or t
  modified_base (264)..(343): a, c, t, g, unknown or other
  misc_feature (264)..(343): n is a, c, g, or t
tcagcacgctacgtcacgaccggtgctcgattttagtagtgtagatttgggtttgggtgcccaagctgctggagggcacggtcaccgtctcctcagcctccaccaagggcccatcggtcttccccctggcaccctctccaagngcacctctgggggcacagccggcctgggctgcctggtcaaggctacttccagtagcgtgctgagcgggctggcaaggcgcatagnnnngnnnannangatcgntntgctgnctgnnnntannnnnnnnnnnnnnnnnnnnnnnnnnnnnnnnnnnnnnnnnnnnnnnnnnnnnnnnnnnnnnnnnnnnnnnnnnnnnnnn

SEQ ID NO: 205555 - DNA, 201 bp, Homo sapiens
  misc_feature: GYAE6OF01BX9UI.30.25.C03.1.454.CMB.1.raw
  modified_base (159)..(201): a, c, t, g, unknown or other
  misc_feature (159)..(201): n is a, c, g, or t
tcagcacgctacgtcacgaccggtgctcgatttagtagtgtagatttgggtttgggggggaaggaggaagactgacggtcctgccacagcggccctgggctgcctggtcaaggactacttccacgtagcgtgctgagtcgggctggcaaggcgcatagnnnnnnnnnnnnnnnnnnnnnnnnnnnnnnnnnnnnnnnnnnn

SEQ ID NO: 205556 - DNA, 187 bp, Homo sapiens
  misc_feature: GYAE6OF01EGFZG.30.25.C03.1.454.CMB.1.raw
  modified_base (169)..(169): a, c, t, g, unknown or other
  misc_feature (169)..(169): n is a, c, g, or t
  modified_base (175)..(187): a, c, t, g, unknown or other
  misc_feature (175)..(187): n is a, c, g, or t
tcagcacgctacgtcacgaccggtgctcgatttagtagtgtagatttgggtttggggggaagaggaagactgacggtccccccaggagttcaggtgctgggcacagcggccctgggctgcctggtcaaggactacttccacgtagcgtgctgagcgggctggcaaggcncatagnnnnnnnnnnnnn

SEQ ID NO: 205557 - DNA, 278 bp, Homo sapiens
  misc_feature: GYAE6OF01EJIQW.30.25.C03.1.454.CMB.1.raw
  modified_base (246)..(246): a, c, t, g, unknown or other
  misc_feature (246)..(246): n is a, c, g, or t
  modified_base (254)..(278): a, c, t, g, unknown or other
  misc_feature (254)..(278): n is a, c, g, or t
tcagcacgctacgtcacgaccggtgctcgatttagtagtgtagatttggggtttgggtgcccaagctgctggagggcacggtcaccgtctcctcagcctccaccaaggcccatcggtccttcccctggcaccctcctccaagagccacctcggtgggggcacgacgcggcccgtgggctcgccgtggtacaaggacttacttccgacgtagcgtgacgtggacggcggggctgggaccgaagggcnctaatagnnnnnnnnnnnnnnnnnnnnnnnnn

SEQ ID NO: 205558 - DNA, 287 bp, Homo sapiens
  misc_feature: GYAE6OF01E1YPG.30.25.C03.1.454.CMB.1.raw
  modified_base (253)..(287): a, c, t, g, unknown or other
  misc_feature (253)..(287): n is a, c, g, or t
tcagcacgctacgtcacgaccggtgctcgatttagtagtgtagatttgggtttgggtgcccaagctgctggagggcacggtcaccgtctcctcagcctccaccaaggcccatcggtccttccccctggccaccctcctccaagacgcacctccgtgggggcacgagccggcccgtggggctcgccgtggtacaaaggtacctacgttccaacggtagtcgtgctggacggcggcgtggcgaaggccgcagtannnnnnnnnnnnnnnnnnnnnnnnnnnnnnnnnnn

SEQ ID NO: 205559 - DNA, 198 bp, Homo sapiens
  misc_feature: GYAE6OF01C0F33.30.25.C03.1.454.CMB.1.raw
  modified_base (180)..(198): a, c, t, g, unknown or other
  misc_feature (180)..(198): n is a, c, g, or t
tcagcacgctacgtcacgaccggtgctcgatttagtagtgtagatttggggtttggggggaagaggaagactgaccggtcccccaggagttcaggtgctgggcacagcggccctgggctgcctggtcaaggactacttcacgtagcgtgctgaggcgggctgggacaaggcgacagtagnnnnnnnnnnnnnnnnnnn

SEQ ID NO: 205560 - DNA, 247 bp, Homo sapiens
  misc_feature: GYAE6OF01CCFN9.30.25.C03.1.454.CMB.1.raw
  modified_base (231)..(247): a, c, t, g, unknown or other
  misc_feature (231)..(247): n is a, c, g, or t
tcagcacgctacgtcacgaccggtgctcgatttagtagtgtagatttgggtttgggtgcccaagctgctggagggcacggtcaccgtctcctcagcctccaccaagggcccatcggtcttccccctggcaccctcctccaagagcacctcgtgggggcacagcggccctgggctgcctggtcaaggactacttccagtagcgtgctggagcgggctggcaaggcgcatagnnnnnnnnnnnnnnnnn

SEQ ID NO: 205561 - DNA, 254 bp, Homo sapiens
  misc_feature: GYAE6OF01C3VWM.30.25.C03.1.454.CMB.1.raw
  modified_base (236)..(254): a, c, t, g, unknown or other
  misc_feature (236)..(254): n is a, c, g, or t
tcagcacgctacgtcacgaccggtgctcgatttagtagtgtagatttgggtttgggtgcccaagctgctggaggaacggtcaccgtctcctcagcctccaccaaggccatcggtcttcccctgcaccctcctccaagagcacctcgtgggggcacgacgccggccgtgggctgccgtggtacaaggtactactcacgtagcgtgctggagcgggctgggagaacggcgcgaatagnnnnnnnnnnnnnnnnnnn

SEQ ID NO: 205562 - DNA, 247 bp, Homo sapiens
  misc_feature: GYAE6OF01EECKZ.30.25.C03.1.454.CMB.1.raw
  modified_base (237)..(247): a, c, t, g, unknown or other
  misc_feature (237)..(247): n is a, c, g, or t
tcagcacgctacgtcacgaccggtgctcgatttagtagtgtagatttgggtttgggtgcccaagctgctggagggcacggtcaccgtctcctcagcctccaccaagggcccatcggtcttccccctggcaccctcctccaagagcacctcgtgggggcacagccggccctggggctgcctggtcaaggacctacttccacgtagcgtgctggaggcgggctgggcaaggcgcatagnnnnnnnnnnn

SEQ ID NO: 205563 - DNA, 175 bp, Homo sapiens
  misc_feature: GYAE6OF01B8FLG.30.25.C03.1.454.CMB.1.raw
  modified_base (172)..(175): a, c, t, g, unknown or other
  misc_feature (172)..(175): n is a, c, g, or t
tcagcacgctacgtcacgaccggtgctcgatttagtagtgtagatttgggtttgggggaagaggaagactgacggtcccccaggagttcaggtgctgggcacagcggccctgggctgcctggtcaaggactactccacgtagcgtgctgagcgggctggcaaggcgcatagnnnn

SEQ ID NO: 205564 - DNA, 272 bp, Homo sapiens
  misc_feature: GYAE6OF01CZ15P.30.25.C03.1.454.CMB.1.raw
  modified_base (138)..(138): a, c, t, g, unknown or other
  misc_feature (138)..(138): n is a, c, g, or t
  modified_base (247)..(272): a, c, t, g, unknown or other
  misc_feature (247)..(272): n is a, c, g, or t
tcagcacgctacgtcacgaccggtgctcgatttagtagtgtagatttgggtttgggtgcccaagctgcgtggggggcacggtcaccgtctcctcagcctccaccaaggcccatcggtccttccccgtgccaccctccncaagagcacctcgtgggggcacagccggcccgtgggctcgccgtggtacaaggctacttcccagtagcgtgacgtggacggcgggacgtggcgaacggccgactatagnnnnnnnnnnnnnnnnnnnnnnnnnn

SEQ ID NO: 205565 - DNA, 233 bp, Homo sapiens
  misc_feature: GYAE6OF01CG241.30.25.C03.1.454.CMB.1.raw
  modified_base (214)..(214): a, c, t, g, unknown or other
  misc_feature (214)..(214): n is a, c, g, or t
  modified_base (225)..(225): a, c, t, g, unknown or other
  misc_feature (225)..(225): n is a, c, g, or t
  modified_base (229)..(233): a, c, t, g, unknown or other
  misc_feature (229)..(233): n is a, c, g, or t
tcagcacgctacgtcacgaccggtgctcgatttagtagtgtagatttgggtttgggtgcccaagctgctggagggcacggtcaccgtctcctcagcctccaccaagggcccatcggtcttcccctggcaccctcctccaagagcaccgtcgtggggcacagcgccctgggctgcctggtcaaggactacttccacgtagcgtgactgagcgggntggcaaggcgnatgnnnnn

SEQ ID NO: 205566 - DNA, 263 bp, Homo sapiens
  misc_feature: GYAE6OF01CEMDV.30.25.C03.1.454.CMB.1.raw
  modified_base (145)..(145): a, c, t, g, unknown or other
  misc_feature (145)..(145): n is a, c, g, or t
  modified_base (154)..(154): a, c, t, g, unknown or other
  misc_feature (154)..(154): n is a, c, g, or t
  modified_base (238)..(240): a, c, t, g, unknown or other
  misc_feature (238)..(240): n is a, c, g, or t
  modified_base (242)..(263): a, c, t, g, unknown or other
  misc_feature (242)..(263): n is a, c, g, or t
tcagcacgctacgtcacgaccggtgctcgatttagtagtgtagatttgggtttgggtgcccaagctgctggagggcacggtcaccgtctcctcagcctccaccaagggcccatccggtcttccccctggccaccctcctccaagngccactcgnggggcacagcgccctggctgccttggcaaggtacctactccaggttacgcgtgcgtggacggcgggctggacgaggcgacatgnnnannnnnnnnnnnnnnnnnnnnnn

SEQ ID NO: 205567 - DNA, 199 bp, Homo sapiens
  misc_feature: GYAE6OF01EV184.30.25.C03.1.454.CMB.1.raw
  modified_base (157)..(157): a, c, t, g, unknown or other
  misc_feature (157)..(157): n is a, c, g, or t
  modified_base (159)..(159): a, c, t, g, unknown or other
  misc_feature (159)..(159): n is a, c, g, or t
  modified_base (162)..(199): a, c, t, g, unknown or other
  misc_feature (162)..(199): n is a, c, g, or t
tcagcacgctacgtcacgaccggtgctcgatttagtagtgtagatttggggtttgggggggaagaggaagactgacggtcctgccacagcggccctgggctgcctggtcaaggctacttccagtagcgtgctgaggcgggctggcaaggcacatagnanctnnnnnnnnnnnnnnnnnnnnnnnnnnnnnnnnnnnnnn

SEQ ID NO: 205568 - DNA, 246 bp, Homo sapiens
  misc_feature: GYAE6OF01B4GBX.30.25.C03.1.454.CMB.1.raw
  modified_base (232)..(246): a, c, t, g, unknown or other
  misc_feature (232)..(246): n is a, c, g, or t
tcagcacgctacgtcacgaccggtgctcgatttagtagtgtagatttgggtttgggtgcccaagctgctgggagggcacggtcaccgtctcctcagcctccaccaagggcccatcggtcttccccctggcacccctcctccaagagcacctcgtgggggcacagcggccctgggctgcctggtcaaggacttactccacgtagcgtgctgagcgggctggcaggcgcatagnnnnnnnnnnnnnnn

SEQ ID NO: 205569 - DNA, 241 bp, Homo sapiens
  misc_feature: GYAE6OF01DHNOQ.30.25.C03.1.454.CMB.1.raw
  modified_base (229)..(241): a, c, t, g, unknown or other
  misc_feature (229)..(241): n is a, c, g, or t
tcagcacgctacgtcacgaccggtgctcgatttagtagtgtagatttgggtttgggtgcccaagctgctggagggcacggtcaccgtctcctcagcctccaccaaggcccatcggtcttccccctggcaccctcctccaagagcacctcgtggggcacagcggccctgggctgcctggtcaaggactacttccacgtagcgtgctgagcgggctggcaaggcgcatagnnnnnnnnnnnnn

SEQ ID NO: 205570 - DNA, 153 bp, Homo sapiens
  misc_feature: GYAE6OF02IZ0SJ.30.25.C03.1.454.CMB.1.raw
  modified_base (153)..(153): a, c, t, g, unknown or other
  misc_feature (153)..(153): n is a, c, g, or t
tcagcacgctacgtcacgaccggtgctcgatttagtagtgtagatttgggtttggggaagaggaagactgacggtcctgccacagcggcctgggctgcctggtcaaggactacttccacgtagcgtgctgagcgggctggcaaggcgcatagn

SEQ ID NO: 205571 - DNA, 171 bp, Homo sapiens
  misc_feature: GYAE6OF02I40GP.30.25.C03.1.454.CMB.1.raw
  modified_base (170)..(171): a, c, t, g, unknown or other
  misc_feature (170)..(171): n is a, c, g, or t
tcagcacgctacgtcacgaccggtgctcgatttagtagtgtagatttgggttggggaagaggaagactgacggtccccaggagttcaggtgctgggcacagcggccctgggctgcctggtcaaggactacttccacgtagcgtgctgagcgggctggcaaggcgcatagnn

SEQ ID NO: 205572 - DNA, 151 bp, Homo sapiens
  misc_feature: GYAE6OF02H6LLT.30.25.C03.1.454.CMB.1.raw
  modified_base (151)..(151): a, c, t, g, unknown or other
  misc_feature (151)..(151): n is a, c, g, or t
tcagcacgctacgtcacgaccggtgctcgatttagtagtgtagatttgggtttgggaagaggaagactgacggtcctgccacagcggcctgggctgcctggtcaaggactacttccacgtagcgtgctgagcggctggcaaggcgcatagn

SEQ ID NO: 205573 - DNA, 151 bp, Homo sapiens
  misc_feature: GYAE6OF02H3RRA.30.25.C03.1.454.CMB.1.raw
  modified_base (151)..(151): a, c, t, g, unknown or other
  misc_feature (151)..(151): n is a, c, g, or t
tcagcacgctacgtcacgaccggtgctcgatttagtagtgtagattggtttgggaagaggaagactgacggtcctgccacagcggccctgggctgcctggtcaaggactacttccacgtagcgtgctgagcgggctggcaaggcgcatagn

SEQ ID NO: 205574 - DNA, 232 bp, Homo sapiens; identical to SEQ ID NO: 205198
  misc_feature: GYAE6OF02I18L5.30.25.C03.1.454.CMB.1.raw
  modified_base (228)..(232): a, c, t, g, unknown or other
  misc_feature (228)..(232): n is a, c, g, or t

SEQ ID NO: 205575 - DNA, 172 bp, Homo sapiens
  misc_feature: GYAE6OF02HTPRJ.30.25.C03.1.454.CMB.1.raw
  modified_base (152)..(172): a, c, t, g, unknown or other
  misc_feature (152)..(172): n is a, c, g, or t
tcagcacgctacgtcacgaccggtgctcgatttagtagtgtagattgggttggggaagaggaagactgacggtcctgccacagcggccctgggctgcctggtcaaggactacttccacgtagcgtgctgagcgggctggcaaggcgcatagnnnnnnnnnnnnnnnnnnnnn

SEQ ID NO: 205576 - DNA, 229 bp, Homo sapiens; identical to SEQ ID NO: 205136
  misc_feature: GYAE6OF02GLQPY.30.25.C03.1.454.CMB.1.raw
  modified_base (229)..(229): a, c, t, g, unknown or other
  misc_feature (229)..(229): n is a, c, g, or t

SEQ ID NO: 205577 - DNA, 154 bp, Homo sapiens; identical to SEQ ID NO: 205060
  misc_feature: GYAE6OF02G55WG.30.25.C03.1.454.CMB.1.raw
  modified_base (154)..(154): a, c, t, g, unknown or other
  misc_feature (154)..(154): n is a, c, g, or t

SEQ ID NO: 205578 - DNA, 179 bp, Homo sapiens
  misc_feature: GYAE6OF02HQ37T.30.25.C03.1.454.CMB.1.raw
  modified_base (170)..(179): a, c, t, g, unknown or other
  misc_feature (170)..(179): n is a, c, g, or t
tcagcacgctacgtcacgaccggtgctcgatttagtagtgtagattgggtttggggaagaggaagactgacggtccccaggagttcaggtgctgggcacagcggccctgggctgcctggtcaaggactacttccacgtagcgtgctgagcgggctggcaaggcgcatagnnnnnnnnnn

SEQ ID NO: 205579 - DNA, 154 bp, Homo sapiens; identical to SEQ ID NO: 205060
  misc_feature: GYAE6OF02IFELG.30.25.C03.1.454.CMB.1.raw
  modified_base (154)..(154): a, c, t, g, unknown or other
  misc_feature (154)..(154): n is a, c, g, or t

SEQ ID NO: 205580 - DNA, 185 bp, Homo sapiens
  misc_feature: GYAE6OF02ISZEW.30.25.C03.1.454.CMB.1.raw
  modified_base (169)..(185): a, c, t, g, unknown or other
  misc_feature (169)..(185): n is a, c, g, or t
tcagcacgctacgtcacgaccggtgctcgatttagtagtgtagatttgggttggggaagaggaagactgacggtccccaggagttcaggtgctgggcacagcggcctgggctgcctggtcaaggactacttccacgtagcgtgctgagcgggctggcaaggcgcatagnnnnnnnnnnnnnnnnn

SEQ ID NO: 205581 - DNA, 231 bp, Homo sapiens; identical to SEQ ID NO: 205129
  misc_feature: GYAE6OF02H4R3J.30.25.C03.1.454.CMB.1.raw
  modified_base (229)..(231): a, c, t, g, unknown or other
  misc_feature (229)..(231): n is a, c, g, or t

SEQ ID NO: 205582 - DNA, 186 bp, Homo sapiens
  misc_feature: GYAE6OF02I5QA5.30.25.C03.1.454.CMB.1.raw
  modified_base (159)..(186): a, c, t, g, unknown or other
  misc_feature (159)..(186): n is a, c, g, or t
tcagcacgctacgtcacgaccggtgctcgatttagtagtgtagatttgggtttgggggtaaggaggaagactgacggtcctgccacagcggccctgggctgcctggtcaaggactacttccacgtagcgtgctgagcgggctggcaagggcgcgatagnnnnnnnnnnnnnnnnnnnnnnnnnnnn

SEQ ID NO: 205583 - DNA, 230 bp, Homo sapiens; identical to SEQ ID NO: 205064
  misc_feature: GYAE6OF02HKKNX.30.25.C03.1.454.CMB.1.raw
  modified_base (228)..(230): a, c, t, g, unknown or other
  misc_feature (228)..(230): n is a, c, g, or t

SEQ ID NO: 205584 - DNA, 173 bp, Homo sapiens; identical to SEQ ID NO: 205084
  misc_feature: GYAE6OF02H8234.30.25.C03.1.454.CMB.1.raw
  modified_base (173)..(173): a, c, t, g, unknown or other
  misc_feature (173)..(173): n is a, c, g, or t

SEQ ID NO: 205585 - DNA, 153 bp, Homo sapiens
  misc_feature: GYAE6OF02F16YJ.30.25.C03.1.454.CMB.1.raw
  modified_base (152)..(153): a, c, t, g, unknown or other
  misc_feature (152)..(153): n is a, c, g, or t
tcagcacgctacgtcacgaccggtgctcgatttagtagtgtagatttgggttgggaagaggaagactgacggtcctgccacagcggccctgggctgcctggtcaaggactacttccacgtagcgtgctgagcgggctggcaaggcgcatagnn

SEQ ID NO: 205586 - DNA, 248 bp, Homo sapiens
  misc_feature: GYAE6OF02FXU0W.30.25.C03.1.454.CMB.1.raw
  modified_base (227)..(248): a, c, t, g, unknown or other
  misc_feature (227)..(248): n is a, c, g, or t
tcagcacgctacgtcacgaccggtgctcgatttagtagtgtagattgggtttgggtgcccaagctgctggagggcacggtcaccgtctcctcagcctccaccaagggcccatcggtcttcccctggcaccctcctccaagagcacctctggggcacagcggccctgggctgcctggtcaaggactacttccacgtagcgtgctgagcgggctggcaaggcgcatagnnnnnnnnnnnnnnnnnnnnnn

SEQ ID NO: 205587 - DNA, 248 bp, Homo sapiens
  misc_feature: GYAE6OF02IJ9TD.30.25.C03.1.454.CMB.1.raw
  modified_base (230)..(248): a, c, t, g, unknown or other
  misc_feature (230)..(248): n is a, c, g, or t
tcagcacgctacgtcacgaccggtgctcgatttagtagtgtagatttgggtttgggtgcccaagctgctggagggcacggtcaccgtctcctcagcctccaccaagggcccatcggtcttcccctggcaccctcctccaagagccacctctgggggcacagcggccctgggctgcctggtcaaggactacttccacgtagcgtgctgagcgggctggcaaggcgcatagnnnnnnnnnnnnnnnnnnn

SEQ ID NO: 205588 - DNA, 173 bp, Homo sapiens; identical to SEQ ID NO: 205050
  misc_feature: GYAE6OF02G9R5B.30.25.C03.1.454.CMB.1.raw
  modified_base (170)..(173): a, c, t, g, unknown or other
  misc_feature (170)..(173): n is a, c, g, or t

SEQ ID NO: 205589 - DNA, 155 bp, Homo sapiens; identical to SEQ ID NO: 205076
  misc_feature: GYAE6OF02IIFLH.30.25.C03.1.454.CMB.1.raw
  modified_base (155)..(155): a, c, t, g, unknown or other
  misc_feature (155)..(155): n is a, c, g, or t

SEQ ID NO: 205590 - DNA, 155 bp, Homo sapiens; identical to SEQ ID NO: 205076
  misc_feature: GYAE6OF02INCCH.30.25.C03.1.454.CMB.1.raw
  modified_base (155)..(155): a, c, t, g, unknown or other
  misc_feature (155)..(155): n is a, c, g, or t

SEQ ID NO: 205591 - DNA, 155 bp, Homo sapiens; identical to SEQ ID NO: 205076
  misc_feature: GYAE6OF02IAHJY.30.25.C03.1.454.CMB.1.raw
  modified_base (155)..(155): a, c, t, g, unknown or other
  misc_feature (155)..(155): n is a, c, g, or t

SEQ ID NO: 205592 - DNA, 188 bp, Homo sapiens
  misc_feature: GYAE6OF02GPEYU.30.25.C03.1.454.CMB.1.raw
  modified_base (173)..(188): a, c, t, g, unknown or other
  misc_feature (173)..(188): n is a, c, g, or t
tcagcacgctacgtcacgaccggtgctcgatttagtagtgtagatttgggtttgggggaagaggaagactgacggtcccccaggagttcaggtgctgggcacagcggccctgggctgcctggtcaaggactacttccacgtagcgtgctgagcgggctggcaaggcgcatagnnnnnnnnnnnnnnnn

SEQ ID NO: 205593 - DNA, 199 bp, Homo sapiens
  misc_feature: GYAE6OF02JAZ4I.30.25.C03.1.454.CMB.1.raw
  modified_base (171)..(199): a, c, t, g, unknown or other
  misc_feature (171)..(199): n is a, c, g, or t
tcagcacgctacgtcacgaccggtgctcgatttagtagtgtagatttgggttgggggaagaggaagactgacggtccccaggagttcaggtgctgggcacagcggccctgggctgcctggtaaaggactacttccacgtagcgtgctgagcgggctggcaaggcgcatagnnnnnnnnnnnnnnnnnnnnnnnnnnnnn

SEQ ID NO: 205594 - DNA, 170 bp, Homo sapiens
  misc_feature: GYAE6OF02HC2V1.30.25.C03.1.454.CMB.1.raw
  modified_base (153)..(170): a, c, t, g, unknown or other
  misc_feature (153)..(170): n is a, c, g, or t
tcagcacgctacgtcacgaccggtgctcgatttagtagtgtagatttgggttggggaagaggaagactgacggtcctgccacagcggccctgggctgcctggtcaaggactacttccacgtagcgtgctgagcgggctggcaaggcgcatagnnnnnnnnnnnnnnnnnn

SEQ ID NO: 205595 - DNA, 171 bp, Homo sapiens; identical to SEQ ID NO: 205048
  misc_feature: GYAE6OF02HOX9H.30.25.C03.1.454.CMB.1.raw
  modified_base (171)..(171): a, c, t, g, unknown or other
  misc_feature (171)..(171): n is a, c, g, or t

SEQ ID NO: 205596 - DNA, 152 bp, Homo sapiens
  misc_feature: GYAE6OF02H6K46.30.25.C03.1.454.CMB.1.raw
  modified_base (152)..(152): a, c, t, g, unknown or other
  misc_feature (152)..(152): n is a, c, g, or t
tcagcacgctacgtcacgaccggtgctcgatttagtagtgtagatttggtttgggaagaggaagactgacggtcctgccacagcggccctgggctgcctggtcaaggactacttccacgtagcgtgctgagcgggctggcaaggcgcatagn

SEQ ID NO: 205597 - DNA, 178 bp, Homo sapiens; identical to SEQ ID NO: 205093
  misc_feature: GYAE6OF02HBK8S.30.25.C03.1.454.CMB.1.raw
  modified_base (173)..(178): a, c, t, g, unknown or other
  misc_feature (173)..(178): n is a, c, g, or t

SEQ ID NO: 205598 - DNA, 230 bp, Homo sapiens; identical to SEQ ID NO: 205064
  misc_feature: GYAE6OF02FRL41.30.25.C03.1.454.CMB.1.raw
  modified_base (228)..(230): a, c, t, g, unknown or other
  misc_feature (228)..(230): n is a, c, g, or t

SEQ ID NO: 205599 - DNA, 233 bp, Homo sapiens; identical to SEQ ID NO: 205189
  misc_feature: GYAE6OF02H68M0.30.25.C03.1.454.CMB.1.raw
  modified_base (230)..(233): a, c, t, g, unknown or other
  misc_feature (230)..(233): n is a, c, g, or t

SEQ ID NO: 205600 - DNA, 230 bp, Homo sapiens; identical to SEQ ID NO: 205191
  misc_feature: GYAE6OF02H82Y2.30.25.C03.1.454.CMB.1.raw
  modified_base (229)..(230): a, c, t, g, unknown or other
  misc_feature (229)..(230): n is a, c, g, or t

SEQ ID NO: 205601 - DNA, 191 bp, Homo sapiens
  misc_feature: GYAE6OF02I9H2L.30.25.C03.1.454.CMB.1.raw
  modified_base (155)..(191): a, c, t, g, unknown or other
  misc_feature (155)..(191): n is a, c, g, or t
tcagcacgctacgtcacgaccggtgctcgatttagtagtgtagatttgggtttgggggaagaggaagactgacggtcctgccacagcggccctgggctgcctggtcaaggactacttccacgtagcgtgctgagcgggctggcaaggcgcatagnnnnnnnnnnnnnnnnnnnnnnnnnnnnnnnnnnnnn

SEQ ID NO: 205602 - DNA, 150 bp, Homo sapiens
  misc_feature: GYAE6OF02IOPVR.30.25.C03.1.454.CMB.1.raw
  modified_base (150)..(150): a, c, t, g, unknown or other
  misc_feature (150)..(150): n is a, c, g, or t
tcagcacgctacgtcacgaccggtgctcgatttagtagtgtagattggttgggaagaggaagactgacggtcctgccacagcggccctgggctgcctggtcaaggactacttccacgtagcgtgctgagcgggctggcaaggcgcatagn

SEQ ID NO: 205603 - DNA, 230 bp, Homo sapiens; identical to SEQ ID NO: 205064
  misc_feature: GYAE6OF02F1C27.30.25.C03.1.454.CMB.1.raw
  modified_base (228)..(230): a, c, t, g, unknown or other
  misc_feature (228)..(230): n is a, c, g, or t

SEQ ID NO: 205604 - DNA, 183 bp, Homo sapiens
  misc_feature: GYAE6OF02IU8W6.30.25.C03.1.454.CMB.1.raw
  modified_base (154)..(183): a, c, t, g, unknown or other
  misc_feature (154)..(183): n is a, c, g, or t
tcagcacgctacgtcacgaccggtgctcgatttagtagtgtagatttgggtttggggaagaggaagactgacggtcctgccacagcggccctgggctgcctggtcaaggactacttccacgtagcgtgctgagcgggctggcaaggcgcatagnnnnnnnnnnnnnnnnnnnnnnnnnnnnnn

SEQ ID NO: 205605 - DNA, 244 bp, Homo sapiens
  misc_feature: GYAE6OF02FYOK9.30.25.C03.1.454.CMB.1.raw
  modified_base (234)..(244): a, c, t, g, unknown or other
  misc_feature (234)..(244): n is a, c, g, or t
tcagcacgctacgtcacgaccggtgctcgatttagtagtgtagatttgggtttgggtgcccaagctgctggagggcacggtcaccgtctcctcagcctccaccaagggcccatcggtcttcccctggcaccctcctccaagagcacctctggggcacagcggccctgggctgcctggtcaaggactacttccacgtagcgtgctgaggcggcgtcggacgaggcgactagtagnnnnnnnnnnn

SEQ ID NO: 205606 - DNA, 227 bp, Homo sapiens
  misc_feature: GYAE6OF02IUDFT.30.25.C03.1.454.CMB.1.raw
  modified_base (182)..(227): a, c, t, g, unknown or other
  misc_feature (182)..(227): n is a, c, g, or t
tcagcacgctacgtcacgaccggtgctcgatttagtagtgtagattgggtttgggggtaaggaggaagactgacggtcccccagggacgttcaggtgctgggcacagcggccctgggctgcctggttcaaggtactacttccacgtagcgtgctgagcgggctagggcaagggcgcgatagnnnnnnnnnnnnnnnnnnnnnnnnnnnnnnnnnnnnnnnnnnnnnn

SEQ ID NO: 205607 - DNA, 152 bp, Homo sapiens; identical to SEQ ID NO: 205140
  misc_feature: GYAE6OF02GUDMF.30.25.C03.1.454.CMB.1.raw
  modified_base (152)..(152): a, c, t, g, unknown or other
  misc_feature (152)..(152): n is a, c, g, or t

SEQ ID NO: 205608 - DNA, 157 bp, Homo sapiens
  misc_feature: GYAE6OF02IZWLU.30.25.C03.1.454.CMB.1.raw
  modified_base (156)..(157): a, c, t, g, unknown or other
  misc_feature (156)..(157): n is a, c, g, or t
tcagcacgctacgtcacgaccggtgctcgatttagtagtgtagatttgggtttggtgggaagaggaagactgacggtcctgccacagcggccctgggctgcctggtcaaggactacttccacgtagcgtgctgagcgggctggcaaggcgcatagnn

SEQ ID NO: 205609 - DNA, 187 bp, Homo sapiens
  misc_feature: GYAE6OF02G4D1E.30.25.C03.1.454.CMB.1.raw
  modified_base (173)..(187): a, c, t, g, unknown or other
  misc_feature (173)..(187): n is a, c, g, or t
tcagcacgctacgtcacgaccggtgctcgatttagtagtgtagatttgggtttgggggaagaggaagactgacggtcccccaggagttcaggtgctgggcacagcggccctgggctgcctggtcaaggactacttccacgtagcgtgctgagcgggctggcaaggcgcatagnnnnnnnnnnnnnnn

SEQ ID NO: 205610 - DNA, 157 bp, Homo sapiens; identical to SEQ ID NO: 205114
  misc_feature: GYAE6OF02HCV2F.30.25.C03.1.454.CMB.1.raw
  modified_base (155)..(157): a, c, t, g, unknown or other
  misc_feature (155)..(157): n is a, c, g, or t

SEQ ID NO: 205611 - DNA, 172 bp, Homo sapiens
  misc_feature: GYAE6OF02HNPDA.30.25.C03.1.454.CMB.1.raw
  modified_base (171)..(172): a, c, t, g, unknown or other
  misc_feature (171)..(172): n is a, c, g, or t
tcagcacgctacgtcacgaccggtgctcgatttagtagtgtagatttgggtttggggaagaggaagactgacggtccccaggagttcaggttctgggcacagcggccctgggctgcctggtcaaggactacttccacgtagcgtgctgagcgggctggcaaggcgcatagnn

SEQ ID NO: 205612 - DNA, 155 bp, Homo sapiens
  misc_feature: GYAE6OF02I3KZH.30.25.C03.1.454.CMB.1.raw
  modified_base (154)..(155): a, c, t, g, unknown or other
  misc_feature (154)..(155): n is a, c, g, or t
tcagcacgctacgtcacgaccggtgctcgatttagtagtgtagatttgggtttggggaagaggaagactgacggtcctgccacagcggccctgggctgcctggtcaaggactacttccacgtagcgtgctgagcgggctggcaaggcgcatagnn

SEQ ID NO: 205613 - DNA, 193 bp, Homo sapiens
  misc_feature: GYAE6OF02H3ENE.30.25.C03.1.454.CMB.1.raw
  modified_base (175)..(193): a, c, t, g, unknown or other
  misc_feature (175)..(193): n is a, c, g, or t
tcagcacgctacgtcacgaccggtgctcgatttagtagtgtagatttgggtttgggggtaaggaggaagactgacggtcccccaggagttcaggtgctgggcacagcggccctgggctgcctggtcaaggactacttccacgtagcgtgctgagcgggctggcaaggcgcatagnnnnnnnnnnnnnnnnnnn

SEQ ID NO: 205614 - DNA, 173 bp, Homo sapiens; identical to SEQ ID NO: 205084
  misc_feature: GYAE6OF02IKWVC.30.25.C03.1.454.CMB.1.raw
  modified_base (173)..(173): a, c, t, g, unknown or other
  misc_feature (173)..(173): n is a, c, g, or t

SEQ ID NO: 205615 - DNA, 173 bp, Homo sapiens; identical to SEQ ID NO: 205084
  misc_feature: GYAE6OF02IO4SD.30.25.C03.1.454.CMB.1.raw
  modified_base (173)..(173): a, c, t, g, unknown or other
  misc_feature (173)..(173): n is a, c, g, or t

SEQ ID NO: 205616 - DNA, 232 bp, Homo sapiens; identical to SEQ ID NO: 205123
  misc_feature: GYAE6OF02IJBPZ.30.25.C03.1.454.CMB.1.raw
  modified_base (229)..(232): a, c, t, g, unknown or other
  misc_feature (229)..(232): n is a, c, g, or t

SEQ ID NO: 205617 - DNA, 172 bp, Homo sapiens
  misc_feature: GYAE6OF02HH96X.30.25.C03.1.454.CMB.1.raw
  modified_base (171)..(172): a, c, t, g, unknown or other
  misc_feature (171)..(172): n is a, c, g, or t
tcagcacgctacgtcacgaccggtgctcgatttagtagtgtagatttgggtttggggaagaggaagactgacggtccccaggagttcaggtgctgggcacagcggccctgggctgcctggtcaaggactacttccacgtagcgtgctgagcgggctggcaaggcgcatagnn

SEQ ID NO: 205618 - DNA, 186 bp, Homo sapiens
  misc_feature: GYAE6OF02GXAZK.30.25.C03.1.454.CMB.1.raw
  modified_base (156)..(186): a, c, t, g, unknown or other
  misc_feature (156)..(186): n is a, c, g, or t
tcagcacgctacgtcacgaccggtgctcgatttagtagtgtagatttgggtttgggggaagaggaagactgacggtcctgccacagcggccctgggctgcctggtcaaggactacttccacgtagcgtgctgagcgggctaggcaaggcgcatagnnnnnnnnnnnnnnnnnnnnnnnnnnnnnnn

SEQ ID NO: 205619 - DNA, 233 bp, Homo sapiens; identical to SEQ ID NO: 205207
  misc_feature: GYAE6OF02IZT98.30.25.C03.1.454.CMB.1.raw
  modified_base (229)..(233): a, c, t, g, unknown or other
  misc_feature (229)..(233): n is a, c, g, or t

SEQ ID NO: 205620 - DNA, 232 bp, Homo sapiens; identical to SEQ ID NO: 205063
  misc_feature: GYAE6OF02IOHG0.30.25.C03.1.454.CMB.1.raw
  modified_base (230)..(232): a, c, t, g, unknown or other
  misc_feature (230)..(232): n is a, c, g, or t

SEQ ID NO: 205621 - DNA, 245 bp, Homo sapiens
  misc_feature: GYAE6OF02GJHT2.30.25.C03.1.454.CMB.1.raw
  modified_base (229)..(245): a, c, t, g, unknown or other
  misc_feature (229)..(245): n is a, c, g, or t
tcagcacgctacgtcacgaccggtgctcgatttagtagtgtagatttgggtttgggtgcccgaagctgctggagggcacggtcaccgtctcctcagcctccaccaagggcccatcggtcttcccctggcaccctcctccaagagcacctctggggcacagcggccctgggctgcctggtcaaggactacttccacgtagcgtgctgagcgggctggcaaggcgcatagnnnnnnnnnnnnnnnnn

SEQ ID NO: 205622 - DNA, 229 bp, Homo sapiens
  misc_feature: GYAE6OF02J2ORA.30.25.C03.1.454.CMB.1.raw
  modified_base (225)..(229): a, c, t, g, unknown or other
  misc_feature (225)..(229): n is a, c, g, or t
tcagcacgctacgtcacgaccggtgctcgatttagtagtgtagatttggtttggtgccaagctgctggagggcacggtcaccgtctcctcagcctccaccaagggcccatcggtcttcccctggcaccctcctccaagagcacctctggggcacagcggccctgggctgcctggtcaaggactacttccacgtagcgtgctgagcgggctggcaaggcgcatagnnnnn

SEQ ID NO: 205623 - DNA, 241 bp, Homo sapiens
  misc_feature: GYAE6OF02HQR81.30.25.C03.1.454.CMB.1.raw
  modified_base (228)..(241): a, c, t, g, unknown or other
  misc_feature (228)..(241): n is a, c, g, or t
tcagcacgctacgtcacgaccggtgctcgatttagtagtgtagatttgggtttgggtgcccaagctgctggagggcacggccaccgtctcctcagcctccaccaagggcccatcggtcttcccctggcaccctcctccaagagcacctctggggcacagcggccctgggctgcctggtcaaggactacttccacgtagcgtgctgagcgggctggcaaggcgcatagnnnnnnnnnnnnnn

SEQ ID NO: 205624 - DNA, 172 bp, Homo sapiens; identical to SEQ ID NO: 205617
  misc_feature: GYAE6OF02JE6WZ.30.25.C03.1.454.CMB.1.raw
  modified_base (171)..(172): a, c, t, g, unknown or other
  misc_feature (171)..(172): n is a, c, g, or t

SEQ ID NO: 205625 - DNA, 170 bp, Homo sapiens
  misc_feature: GYAE6OF02GW7CF.30.25.C03.1.454.CMB.1.raw
  modified_base (155)..(170): a, c, t, g, unknown or other
  misc_feature (155)..(170): n is a, c, g, or t
tcagcacgctacgtcacgaccggtgctcgatttagtagtgtagatttgggtttgggggaagaggaagactgacggtcctgccacagcggccctgggctgcctggtcaaggactacttccacgtagcgtgctgagcgggctggcaaggcgcatagnnnnnnnnnnnnnnnn

SEQ ID NO: 205626 - DNA, 155 bp, Homo sapiens; identical to SEQ ID NO: 205076
  misc_feature: GYAE6OF02IW0J6.30.25.C03.1.454.CMB.1.raw
  modified_base (155)..(155): a, c, t, g, unknown or other
  misc_feature (155)..(155): n is a, c, g, or t

SEQ ID NO: 205627 - DNA, 155 bp, Homo sapiens; identical to SEQ ID NO: 205076
  misc_feature: GYAE6OF02I3H5K.30.25.C03.1.454.CMB.1.raw
  modified_base (155)..(155): a, c, t, g, unknown or other
  misc_feature (155)..(155): n is a, c, g, or t

SEQ ID NO: 205628 - DNA, 264 bp, Homo sapiens
  misc_feature: GYAE6OF02GQFMP.30.25.C03.1.454.CMB.1.raw
  modified_base (233)..(264): a, c, t, g, unknown or other
  misc_feature (233)..(264): n is a, c, g, or t
tcagcacgctacgtcacgaccggtgctcgatttagtagtgtagatttgggtttgggtgcccaagctgctggagggcgacggtcaccgtctcctcagcctccaccaagggcccatcggtcttccccctggcaccctcctccaagagcacctctgggggcacgagcggccctgggctgcctggtcaaggactacttccacgtagcgtgctgagcgggctgggcaaggcgcatagnnnnnnnnnnnnnnnnnnnnnnnnnnnnnnnn

SEQ ID NO: 205629 - DNA, 175 bp, Homo sapiens; identical to SEQ ID NO: 205102
  misc_feature: GYAE6OF02HH42R.30.25.C03.1.454.CMB.1.raw
  modified_base (173)..(175): a, c, t, g, unknown or other
  misc_feature (173)..(175): n is a, c, g, or t

SEQ ID NO: 205630 - DNA, 174 bp, Homo sapiens; identical to SEQ ID NO: 205077
  misc_feature: GYAE6OF02HTHGK.30.25.C03.1.454.CMB.1.raw
  modified_base (173)..(174): a, c, t, g, unknown or other
  misc_feature (173)..(174): n is a, c, g, or t

SEQ ID NO: 205631 - DNA, 160 bp, Homo sapiens
  misc_feature: GYAE6OF02GZ99P.30.25.C03.1.454.CMB.1.raw
  modified_base (151)..(160): a, c, t, g, unknown or other
  misc_feature (151)..(160): n is a, c, g, or t
tcagcacgctacgtcacgaccggtgctcgatttagtagtgtagattgggttgggaagaggaagactgacggtcctgccacagcggccctgggctgcctggtcaaggactacttccacgtagcgtgctgagcgggctggcaaggcgcatagnnnnnnnnnn

SEQ ID NO: 205632 - DNA, 196 bp, Homo sapiens; identical to SEQ ID NO: 205051
  misc_feature: GYAE6OF02FY27X.30.25.C03.1.454.CMB.1.raw
  modified_base (173)..(196): a, c, t, g, unknown or other
  misc_feature (173)..(196): n is a, c, g, or t

SEQ ID NO: 205633 - DNA, 195 bp, Homo sapiens; identical to SEQ ID NO: 205366
  misc_feature: GYAE6OF02HAZDU.30.25.C03.1.454.CMB.1.raw
  modified_base (172)..(195): a, c, t, g, unknown or other
  misc_feature (172)..(195): n is a, c, g, or t

SEQ ID NO: 205634 - DNA, 175 bp, Homo sapiens; identical to SEQ ID NO: 205102
  misc_feature: GYAE6OF02IYXOW.30.25.C03.1.454.CMB.1.raw
  modified_base (173)..(175): a, c, t, g, unknown or other
  misc_feature (173)..(175): n is a, c, g, or t

SEQ ID NO: 205635 - DNA, 173 bp, Homo sapiens; identical to SEQ ID NO: 205084
  misc_feature: GYAE6OF02GE18Y.30.25.C03.1.454.CMB.1.raw
  modified_base (173)..(173): a, c, t, g, unknown or other
  misc_feature (173)..(173): n is a, c, g, or t

SEQ ID NO: 205636 - DNA, 230 bp, Homo sapiens; identical to SEQ ID NO: 205064
  misc_feature: GYAE6OF02GDYMQ.30.25.C03.1.454.CMB.1.raw
  modified_base (228)..(230): a, c, t, g, unknown or other
  misc_feature (228)..(230): n is a, c, g, or t

SEQ ID NO: 205637 - DNA, 174 bp, Homo sapiens; identical to SEQ ID NO: 205077
  misc_feature: GYAE6OF02IVCJJ.30.25.C03.1.454.CMB.1.raw
  modified_base (173)..(174): a, c, t, g, unknown or other
  misc_feature (173)..(174): n is a, c, g, or t

SEQ ID NO: 205638 - DNA, 233 bp, Homo sapiens; identical to SEQ ID NO: 205223
  misc_feature: GYAE6OF02I46DL.30.25.C03.1.454.CMB.1.raw
  modified_base (229)..(233): a, c, t, g, unknown or other
  misc_feature (229)..(233): n is a, c, g, or t

SEQ ID NO: 205639 - DNA, 230 bp, Homo sapiens; identical to SEQ ID NO: 205191
  misc_feature: GYAE6OF02IZWH8.30.25.C03.1.454.CMB.1.raw
  modified_base (229)..(230): a, c, t, g, unknown or other
  misc_feature (229)..(230): n is a, c, g, or t

SEQ ID NO: 205640 - DNA, 175 bp, Homo sapiens; identical to SEQ ID NO: 205102
  misc_feature: GYAE6OF02GEMOK.30.25.C03.1.454.CMB.1.raw
  modified_base (173)..(175): a, c, t, g, unknown or other
  misc_feature (173)..(175): n is a, c, g, or t

SEQ ID NO: 205641 - DNA, 156 bp, Homo sapiens
  misc_feature: GYAE6OF02HE0TE.30.25.C03.1.454.CMB.1.raw
tcagcacgctacgtcacgaccggtgctcgatttagtagtgtagatttgggtttggggaagaggaagactgacggtcctgccacagcggccctgggctgcctggtcaaggactacttccacgtagcgtgctgagcgggctggcaaggcgcatgaaaa

SEQ ID NO: 205642 - DNA, 174 bp, Homo sapiens; identical to SEQ ID NO: 205077
  misc_feature: GYAE6OF02HH7GV.30.25.C03.1.454.CMB.1.raw
  modified_base (173)..(174): a, c, t, g, unknown or other
  misc_feature (173)..(174): n is a, c, g, or t

SEQ ID NO: 205643 - DNA, 167 bp, Homo sapiens; identical to SEQ ID NO: 205282
  misc_feature: GYAE6OF02ISSII.30.25.C03.1.454.CMB.1.raw
  modified_base (155)..(167): a, c, t, g, unknown or other
  misc_feature (155)..(167): n is a, c, g, or t

SEQ ID NO: 205644 - DNA, 185 bp, Homo sapiens
  misc_feature: GYAE6OF02G7DT4.30.25.C03.1.454.CMB.1.raw
  modified_base (173)..(185): a, c, t, g, unknown or other
  misc_feature (173)..(185): n is a, c, g, or t
tcagcacgctacgtcacgaccggtgctcgatttagtagtgtagatttgggtttgggggaagaggaagactgacggtcccccaggagttcaggtgctgggcacagcggccctgggctgcctggtcaaggactacttccacgtagcgtgctgagcgggctggcaaggcgcatagnnnnnnnnnnnnn

SEQ ID NO: 205645 - DNA, 240 bp, Homo sapiens; identical to SEQ ID NO: 205109
  misc_feature: GYAE6OF02G0C55.30.25.C03.1.454.CMB.1.raw
  modified_base (230)..(240): a, c, t, g, unknown or other
  misc_feature (230)..(240): n is a, c, g, or t

SEQ ID NO: 205646 - DNA, 173 bp, Homo sapiens
  misc_feature: GYAE6OF02GWYTS.30.25.C03.1.454.CMB.1.raw
  modified_base (172)..(173): a, c, t, g, unknown or other
  misc_feature (172)..(173): n is a, c, g, or t
tcagcacgctacgtcacgaccggtgctcgatttagtagtgtagatttgggtttggggaagaggaagactgacggtcccccaggagttcaggtgctgggcacagcggccctgggctgcctggtcaaggactacttccacgtagcgtgctgagcgggctggcaaggcgcatagnn

SEQ ID NO: 205647 - DNA, 235 bp, Homo sapiens; identical to SEQ ID NO: 205318
  misc_feature: GYAE6OF02ITX6V.30.25.C03.1.454.CMB.1.raw
  modified_base (230)..(235): a, c, t, g, unknown or other
  misc_feature (230)..(235): n is a, c, g, or t

SEQ ID NO: 205648 - DNA, 173 bp, Homo sapiens; identical to SEQ ID NO: 205084
  misc_feature: GYAE6OF02FX9VB.30.25.C03.1.454.CMB.1.raw
  modified_base (173)..(173): a, c, t, g, unknown or other
  misc_feature (173)..(173): n is a, c, g, or t

SEQ ID NO: 205649 - DNA, 233 bp, Homo sapiens; identical to SEQ ID NO: 205189
  misc_feature: GYAE6OF02G5FIV.30.25.C03.1.454.CMB.1.raw
  modified_base (230)..(233): a, c, t, g, unknown or other
  misc_feature (230)..(233): n is a, c, g, or t

SEQ ID NO: 205650 - DNA, 173 bp, Homo sapiens; identical to SEQ ID NO: 205084
  misc_feature: GYAE6OF02IRZ0B.30.25.C03.1.454.CMB.1.raw
  modified_base (173)..(173): a, c, t, g, unknown or other
  misc_feature (173)..(173): n is a, c, g, or t

SEQ ID NO: 205651 - DNA, 170 bp, Homo sapiens
  misc_feature: GYAE6OF02FYU5S.30.25.C03.1.454.CMB.1.raw
  modified_base (168)..(170): a, c, t, g, unknown or other
  misc_feature (168)..(170): n is a, c, g, or t
tcagcacgctacgtcacgaccggtgctcgatttagtagtgtagatttggttggggaagaggagactgacggtccccaggagttcaggtgctgggcacagcggccctgggctgcctggtcaaggactacttccacgtagcgtgctgagcgggctggcaaggcgcatagnnn

SEQ ID NO: 205652 - DNA, 234 bp, Homo sapiens
  misc_feature: GYAE6OF02J0XN1.30.25.C03.1.454.CMB.1.raw
  modified_base (227)..(234): a, c, t, g, unknown or other
  misc_feature (227)..(234): n is a, c, g, or t
tcagcacgctacgtcacgaccggtgctcgatttagtagtgtagatttggtttgggtgcccaagctgctggagggcacggtcaccgtctcctcagcctccaccaagggcccatcggtcttcccctggcaccctcctccaagagcacctctggggcacagcggccctgggctgcctggtcaaggactacttccacgtagcgtgctgagcgggctggcaaggcgcatagnnnnnnnn

SEQ ID NO: 205653 - DNA, 162 bp, Homo sapiens; identical to SEQ ID NO: 205432
  misc_feature: GYAE6OF02IKJFY.30.25.C03.1.454.CMB.1.raw
  modified_base (155)..(162): a, c, t, g, unknown or other
  misc_feature (155)..(162): n is a, c, g, or t

SEQ ID NO: 205654 - DNA, 232 bp, Homo sapiens; identical to SEQ ID NO: 205123
  misc_feature: GYAE6OF02GLCI4.30.25.C03.1.454.CMB.1.raw
  modified_base (229)..(232): a, c, t, g, unknown or other
  misc_feature (229)..(232): n is a, c, g, or t

SEQ ID NO: 205655 - DNA, 200 bp, Homo sapiens
  misc_feature: GYAE6OF02G06KR.30.25.C03.1.454.CMB.1.raw
  modified_base (173)..(200): a, c, t, g, unknown or other
  misc_feature (173)..(200): n is a, c, g, or t
tcagcacgctacgtcacgaccggtgctcgatttagtagtgtagatttgggtttgggggaagaggaagactgacggtcccccaggagttcaggtgctgggcacagcggccctgggctgcctggtcaaggactacttccacgtagcgtgctgagcgggctggcaaggcgcatagnnnnnnnnnnnnnnnnnnnnnnnnnnnn

SEQ ID NO: 205656 - DNA, 231 bp, Homo sapiens; identical to SEQ ID NO: 205061
  misc_feature: GYAE6OF02HRI5V.30.25.C03.1.454.CMB.1.raw
  modified_base (228)..(231): a, c, t, g, unknown or other
  misc_feature (228)..(231): n is a, c, g, or t

SEQ ID NO: 205657 - DNA, 184 bp, Homo sapiens
  misc_feature: GYAE6OF02FFMBR.30.25.C03.1.454.CMB.1.raw
  modified_base (159)..(184): a, c, t, g, unknown or other
  misc_feature (159)..(184): n is a, c, g, or t
tcagcacgctacgtcacgaccggtgctcgatttagtagtgtagatttgggtttggggggaagaggaacgactggcggtcctgccacagcggccctgggctggccctggtcaaggactacttcgacgtagcgtgctgagcgggctggcaaggcgcatagnnnnnnnnnnnnnnnnnnnnnnnnnn

SEQ ID NO: 205658 - DNA, 155 bp, Homo sapiens; identical to SEQ ID NO: 205076
  misc_feature: GYAE6OF02HXVLL.30.25.C03.1.454.CMB.1.raw
  modified_base (155)..(155): a, c, t, g, unknown or other
  misc_feature (155)..(155): n is a, c, g, or t

SEQ ID NO: 205659 - DNA, 233 bp, Homo sapiens; identical to SEQ ID NO: 205189
  misc_feature: GYAE6OF02FM00Z.30.25.C03.1.454.CMB.1.raw
  modified_base (230)..(233): a, c, t, g, unknown or other
  misc_feature (230)..(233): n is a, c, g, or t

SEQ ID NO: 205660 - DNA, 154 bp, Homo sapiens; identical to SEQ ID NO: 205060
  misc_feature: GYAE6OF02HOTYX.30.25.C03.1.454.CMB.1.raw
  modified_base (154)..(154): a, c, t, g, unknown or other
  misc_feature (154)..(154): n is a, c, g, or t

SEQ ID NO: 205661 - DNA, 209 bp, Homo sapiens
  misc_feature: GYAE6OF02F9O8P.30.25.C03.1.454.CMB.1.raw
  modified_base (177)..(209): a, c, t, g, unknown or other
  misc_feature (177)..(209): n is a, c, g, or t
tcagcacgctacgtcacgaccggtgctcgatttagtagtgtagatttgggttgggggaagagggaagacctgacggtcccccaggacgttcaggtgctgggcacagcggcccttgggctgcctggtcaaggactacgttccacgtagcgtgctgagcgggctggcaaggcgcatagnnnnnnnnnnnnnnnnnnnnnnnnnnnnnnnnn

SEQ ID NO: 205662 - DNA, 281 bp, Homo sapiens
  misc_feature: GYAE6OF02HBNXT.30.25.C03.1.454.CMB.1.raw
  modified_base (270)..(281): a, c, t, g, unknown or other
  misc_feature (270)..(281): n is a, c, g, or t
tcagcacgctacgtcacgaccggtgctcgatttagtagtgtagatttgggtttgggtcgaccgaagctgcgtgggagggcgacggtccaccgtcctcctcacgccctccaaccgaacgggcccagtcggttccttccccgtggcctaccctcctaccaagagccacctcggtcgggggccacaggccggcccgtgggctcgccgtggtacgaaggacttaccttccacgtagcgtgctgaggcgggtcgtggacgaaggcgactagtagnnnnnnnnnnnn

SEQ ID NO: 205663 - DNA, 210 bp, Homo sapiens
  misc_feature: GYAE6OF02FR0VS.30.25.C03.1.454.CMB.1.raw
  modified_base (142)..(142): a, c, t, g, unknown or other
  misc_feature (142)..(142): n is a, c, g, or t
  modified_base (173)..(210): a, c, t, g, unknown or other
  misc_feature (173)..(210): n is a, c, g, or t
tcagcacgctacgtcacgaccggtgctcgatttagtagtgtagatttgggtttggggaagaggaagactgacggtccccaggagttcaggtgctgggcaccagcggccctgggctggcctggtcaaggctacttccacgtancgtgctgagcgggctggcaaggcgcatacgnnnnnnnnnnnnnnnnnnnnnnnnnnnnnnnnnnnnnn

SEQ ID NO: 205664 - DNA, 178 bp, Homo sapiens; identical to SEQ ID NO: 205093
  misc_feature: GYAE6OF02GXNFG.30.25.C03.1.454.CMB.1.raw
  modified_base (173)..(178): a, c, t, g, unknown or other
  misc_feature (173)..(178): n is a, c, g, or t

SEQ ID NO: 205665 - DNA, 173 bp, Homo sapiens; identical to SEQ ID NO: 205646
  misc_feature: GYAE6OF02GGN4K.30.25.C03.1.454.CMB.1.raw
  modified_base (172)..(173): a, c, t, g, unknown or other
  misc_feature (172)..(173): n is a, c, g, or t

SEQ ID NO: 205666 - DNA, 199 bp, Homo sapiens
  misc_feature: GYAE6OF02GUU6J.30.25.C03.1.454.CMB.1.raw
  modified_base (157)..(199): a, c, t, g, unknown or other
  misc_feature (157)..(199): n is a, c, g, or t
tcagcacgctacgtcacgaccggtgctcgatttagtagtgtagatttgggttgggggaagagggaagactgacggtcctgccacagcggccctgggctgcctggtcaaggacctacttccacgtagccgtgctgagcgggctggcaaggcgcatagnnnnnnnnnnnnnnnnnnnnnnnnnnnnnnnnnnnnnnnnnnn

SEQ ID NO: 205667 - DNA, 209 bp, Homo sapiens
  misc_feature: GYAE6OF02GRE7X.30.25.C03.1.454.CMB.1.raw
  modified_base (177)..(209): a, c, t, g, unknown or other
  misc_feature (177)..(209): n is a, c, g, or t
tcagcacgctacgtcacgaccggtgctcgatttagtagtgtagatttgggtttgggggaagaggaagactgacggtcccccaggagttcgaggtgctgggccacagcggccctgggctgcctggtcaaggactacttccacgtagcgtgcctggagcgggctggcaaggcgcatagnnnnnnnnnnnnnnnnnnnnnnnnnnnnnnnnn

SEQ ID NO: 205668 - DNA, 173 bp, Homo sapiens; identical to SEQ ID NO: 205084
  misc_feature: GYAE6OF02GX07W.30.25.C03.1.454.CMB.1.raw
  modified_base (173)..(173): a, c, t, g, unknown or other
  misc_feature (173)..(173): n is a, c, g, or t

SEQ ID NO: 205669 - DNA, 227 bp, Homo sapiens
  misc_feature: GYAE6OF02J2VEQ.30.25.C03.1.454.CMB.1.raw
  modified_base (223)..(227): a, c, t, g, unknown or other
  misc_feature (223)..(227): n is a, c, g, or t
tcagcacgctacgtcacgaccggtgctcgatttagtagtgtagattggtttgggtgccaagctgctggagggcacggtcaccgtctcctcagcctccaccaagggcccatcggtcttcccctggcaccctcctccaagagcacctctggggcacagcggcctgggctgcctggtcaaggactacttccacgtagcgtgctgagcggctggcaaggcgcatagnnnnn

SEQ ID NO: 205670 - DNA, 159 bp, Homo sapiens; identical to SEQ ID NO: 205340
  misc_feature: GYAE6OF02HJ418.30.25.C03.1.454.CMB.1.raw
  modified_base (155)..(159): a, c, t, g, unknown or other
  misc_feature (155)..(159): n is a, c, g, or t

SEQ ID NO: 205671 - DNA, 231 bp, Homo sapiens; identical to SEQ ID NO: 205061
  misc_feature: GYAE6OF02FZZQY.30.25.C03.1.454.CMB.1.raw
  modified_base (228)..(231): a, c, t, g, unknown or other
  misc_feature (228)..(231): n is a, c, g, or t

SEQ ID NO: 205672 - DNA, 174 bp, Homo sapiens; identical to SEQ ID NO: 205077
  misc_feature: GYAE6OF02IXUD3.30.25.C03.1.454.CMB.1.raw
  modified_base (173)..(174): a, c, t, g, unknown or other
  misc_feature (173)..(174): n is a, c, g, or t

SEQ ID NO: 205673 - DNA, 156 bp, Homo sapiens
  misc_feature: GYAE6OF02HHKX6.30.25.C03.1.454.CMB.1.raw
  modified_base (154)..(156): a, c, t, g, unknown or other
  misc_feature (154)..(156): n is a, c, g, or t
tcagcacgctacgtcacgaccggtgctcgatttagtagtgtagatttgggtttgggggaagaggaagactgacggtcctgccacagcggccctgggctgcctggcaaggactacttccacgtagcgtgctgagcgggctggcaaggcgcatagnnn

SEQ ID NO: 205674 - DNA, 155 bp, Homo sapiens; identical to SEQ ID NO: 205076
  misc_feature: GYAE6OF02HBHNG.30.25.C03.1.454.CMB.1.raw
  modified_base (155)..(155): a, c, t, g, unknown or other
  misc_feature (155)..(155): n is a, c, g, or t

SEQ ID NO: 205675 - DNA, 236 bp, Homo sapiens; identical to SEQ ID NO: 205399
  misc_feature: GYAE6OF02IETOL.30.25.C03.1.454.CMB.1.raw
  modified_base (230)..(236): a, c, t, g, unknown or other
  misc_feature (230)..(236): n is a, c, g, or t

SEQ ID NO: 205676 - DNA, 176 bp, Homo sapiens; identical to SEQ ID NO: 205124
  misc_feature: GYAE6OF02G1OZI.30.25.C03.1.454.CMB.1.raw
  modified_base (173)..(176): a, c, t, g, unknown or other
  misc_feature (173)..(176): n is a, c, g, or t

SEQ ID NO: 205677 - DNA, 156 bp, Homo sapiens; identical to SEQ ID NO: 205094
  misc_feature: GYAE6OF02F76U4.30.25.C03.1.454.CMB.1.raw
  modified_base (155)..(156): a, c, t, g, unknown or other
  misc_feature (155)..(156): n is a, c, g, or t

SEQ ID NO: 205678 - DNA, 229 bp, Homo sapiens; identical to SEQ ID NO: 205136
  misc_feature: GYAE6OF02IGS61.30.25.C03.1.454.CMB.1.raw
  modified_base (229)..(229): a, c, t, g, unknown or other
  misc_feature (229)..(229): n is a, c, g, or t

SEQ ID NO: 205679 - DNA, 155 bp, Homo sapiens; identical to SEQ ID NO: 205076
  misc_feature: GYAE6OF02FRJ9A.30.25.C03.1.454.CMB.1.raw
  modified_base (155)..(155): a, c, t, g, unknown or other
  misc_feature (155)..(155): n is a, c, g, or t

SEQ ID NO: 205680 - DNA, 172 bp, Homo sapiens
  misc_feature: GYAE6OF02F48FM.30.25.C03.1.454.CMB.1.raw
  modified_base (172)..(172): a, c, t, g, unknown or other
  misc_feature (172)..(172): n is a, c, g, or t
tcagcacgctacgtcacgaccggtgctcgatttagtagtgtagatttgggtttggggaagaggaagactgacggtcccccaggagttcaggtgctgggcacagcggccctgggctgcctggtcaaggactacttccacgtagcgtgctgagcgggctggcaaggcgcatagn

SEQ ID NO: 205681 - DNA, 230 bp, Homo sapiens; identical to SEQ ID NO: 205191
  misc_feature: GYAE6OF02ICK8O.30.25.C03.1.454.CMB.1.raw
  modified_base (229)..(230): a, c, t, g, unknown or other
  misc_feature (229)..(230): n is a, c, g, or t

SEQ ID NO: 205682 - DNA, 155 bp, Homo sapiens; identical to SEQ ID NO: 205076
  misc_feature: GYAE6OF02GIET4.30.25.C03.1.454.CMB.1.raw
  modified_base (155)..(155): a, c, t, g, unknown or other
  misc_feature (155)..(155): n is a, c, g, or t

SEQ ID NO: 205683 - DNA, 230 bp, Homo sapiens
  misc_feature: GYAE6OF02GVI1R.30.25.C03.1.454.CMB.1.raw
  modified_base (229)..(230): a, c, t, g, unknown or other
  misc_feature (229)..(230): n is a, c, g, or t
tcagcacgctacgtcacgaccggtgctcgatttagtagtgtagatttgggtttgggtgcccaagctgctggagggcacggtcaccgtctcctcagcctccaccaagggcccatcggtcttcccctggcaccctcctccaagagcacctccgagagcacagccgccctgggctgcctggtcaaggactacttccacgtagcgtgctgagcgggctggcaaggcgcatagnn

SEQ ID NO: 205684 - DNA, 185 bp, Homo sapiens
  misc_feature: GYAE6OF02FZUZJ.30.25.C03.1.454.CMB.1.raw
  modified_base (156)..(185): a, c, t, g, unknown or other
  misc_feature (156)..(185): n is a, c, g, or t
tcagcacgctacgtcacgaccggtgctcgatttagtagtgtagatttgggtttggggggaagaggaagactgacggtcctgccacagcggccctgggctgcctggtcaaggactacttccacgtagcgtgctgagcgggctggcaaggcgcatagnnnnnnnnnnnnnnnnnnnnnnnnnnnnnn

SEQ ID NO: 205685 - DNA, 186 bp, Homo sapiens
  misc_feature: GYAE6OF02JYKD2.30.25.C03.1.454.CMB.1.raw
  modified_base (180)..(186): a, c, t, g, unknown or other
  misc_feature (180)..(186): n is a, c, g, or t
tcagcacgctacgtcacgaccggtgctcgatttagtagtgtagatttggtttggggaagaggaagactgacggtccccaggagttcaggtgctgggcacagcggccctgggctgcctggtcaaggacggtcaaggactacttccacgtagcgtgctgagcgggctggcaaggcgcatagnnnnnnn

SEQ ID NO: 205686 - DNA, 232 bp, Homo sapiens; identical to SEQ ID NO: 205063
  misc_feature: GYAE6OF02GFWW3.30.25.C03.1.454.CMB.1.raw
  modified_base (230)..(232): a, c, t, g, unknown or other
  misc_feature (230)..(232): n is a, c, g, or t

SEQ ID NO: 205687 - DNA, 156 bp, Homo sapiens; identical to SEQ ID NO: 205094
  misc_feature: GYAE6OF02HECPL.30.25.C03.1.454.CMB.1.raw
  modified_base (155)..(156): a, c, t, g, unknown or other
  misc_feature (155)..(156): n is a, c, g, or t

SEQ ID NO: 205688 - DNA, 173 bp, Homo sapiens; identical to SEQ ID NO: 205084
  misc_feature: GYAE6OF02GVKLZ.30.25.C03.1.454.CMB.1.raw
  modified_base (173)..(173): a, c, t, g, unknown or other
  misc_feature (173)..(173): n is a, c, g, or t

SEQ ID NO: 205689 - DNA, 175 bp, Homo sapiens
  misc_feature: GYAE6OF02GXHDI.30.25.C03.1.454.CMB.1.raw
  modified_base (172)..(175): a, c, t, g, unknown or other
  misc_feature (172)..(175): n is a, c, g, or t
tcagcacgctacgtcacgaccggtgctcgatttagtagtgtagatttgggtttggggaagaggaagactgacggtcccccaggagttcaggtgctgggcacagcggccctgggctgcctggtcaaggactacttccacgtagcgtgctgagcgggctggcaaggcgcatagnnnn

SEQ ID NO: 205690 - DNA, 239 bp, Homo sapiens
  misc_feature: GYAE6OF02JQT15.30.25.C03.1.454.CMB.1.raw
  modified_base (228)..(239): a, c, t, g, unknown or other
  misc_feature (228)..(239): n is a, c, g, or t
tcagcacgctacgtcacgaccggtgctcgatttagtagtgtagatttgggtttgggtgcccaagctgctggagggcacggtcaccgtctcctcagcctccaccaagggcccatcggtcttcccctggcaccctcctccaacgagcacctctgggggcacagcggcctgggctgcctggtcaaggctacttccacgtagcgtgctgagcgggctggcaaggcgcatagnnnnnnnnnnnn

SEQ ID NO: 205691 - DNA, 175 bp, Homo sapiens; identical to SEQ ID NO: 205102
  misc_feature: GYAE6OF02FTV30.30.25.C03.1.454.CMB.1.raw
  modified_base (173)..(175): a, c, t, g, unknown or other
  misc_feature (173)..(175): n is a, c, g, or t

SEQ ID NO: 205692 - DNA, 155 bp, Homo sapiens; identical to SEQ ID NO: 205076
  misc_feature: GYAE6OF02FNQEG.30.25.C03.1.454.CMB.1.raw
  modified_base (155)..(155): a, c, t, g, unknown or other
  misc_feature (155)..(155): n is a, c, g, or t

SEQ ID NO: 205693 - DNA, 156 bp, Homo sapiens; identical to SEQ ID NO: 205094
  misc_feature: GYAE6OF02H9YKQ.30.25.C03.1.454.CMB.1.raw
  modified_base (155)..(156): a, c, t, g, unknown or other
  misc_feature (155)..(156): n is a, c, g, or t

SEQ ID NO: 205694 - DNA, 230 bp, Homo sapiens
  misc_feature: GYAE6OF02JWPX8.30.25.C03.1.454.CMB.1.raw
  modified_base (226)..(230): a, c, t, g, unknown or other
  misc_feature (226)..(230): n is a, c, g, or t
tcagcacgctacgtcacgaccggtgctcgatttagtagtgtagatttgggtttgggtgccaagctgctggagggcacggtcaccgtctcctcagcctccaccaagggcccatcggtcttcccctggcaccctcctccaagagcacctctggggcacagcggccctgggctgcctggtcaaggactacttccacgtagcggctgagcgggctggcaaggcgcatagnnnnn

SEQ ID NO: 205695 - DNA, 178 bp, Homo sapiens
  misc_feature: GYAE6OF02FGFRP.30.25.C03.1.454.CMB.1.raw
  modified_base (157)..(178): a, c, t, g, unknown or other
  misc_feature (157)..(178): n is a, c, g, or t
tcagcacgctacgtcacgaccggtgctcgatttagtagtgtagatttgggtttgggggaagaggaagactggacggtcctgccacagcggccctgggctgcctgggtcaaggactacttccacgtagcgtgctgagcgggctggcaaggcgcatagnnnnnnnnnnnnnnnnnnnnnn

SEQ ID NO: 205696 - DNA, 174 bp, Homo sapiens; identical to SEQ ID NO: 205077
  misc_feature: GYAE6OF02HCDHY.30.25.C03.1.454.CMB.1.raw
  modified_base (173)..(174): a, c, t, g, unknown or other
  misc_feature (173)..(174): n is a, c, g, or t

SEQ ID NO: 205697 - DNA, 183 bp, Homo sapiens
  misc_feature: GYAE6OF02HJBSM.30.25.C03.1.454.CMB.1.raw
  modified_base (172)..(183): a, c, t, g, unknown or other
  misc_feature (172)..(183): n is a, c, g, or t
tcagcacgctacgtcacgaccggtgctcgatttagtagtgtagatttgggttgggggaagaggaagactgacggtcccccaggagttcaggtgctgggcacagcggccctgggctgcctggtcaaggactacttccacgtagcgtgctgagcgggctggcaaggcgcatagnnnnnnnnnnnn

SEQ ID NO: 205698 - DNA, 155 bp, Homo sapiens; identical to SEQ ID NO: 205076
  misc_feature: GYAE6OF02H4LBM.30.25.C03.1.454.CMB.1.raw
  modified_base (155)..(155): a, c, t, g, unknown or other
  misc_feature (155)..(155): n is a, c, g, or t

SEQ ID NO: 205699 - DNA, 154 bp, Homo sapiens; identical to SEQ ID NO: 205060
  misc_feature: GYAE6OF02JDZAT.30.25.C03.1.454.CMB.1.raw
  modified_base (154)..(154): a, c, t, g, unknown or other
  misc_feature (154)..(154): n is a, c, g, or t

SEQ ID NO: 205700 - DNA, 176 bp, Homo sapiens; identical to SEQ ID NO: 205124
  misc_feature: GYAE6OF02H2HVV.30.25.C03.1.454.CMB.1.raw
  modified_base (173)..(176): a, c, t, g, unknown or other
  misc_feature (173)..(176): n is a, c, g, or t

SEQ ID NO: 205701 - DNA, 154 bp, Homo sapiens; identical to SEQ ID NO: 205060
  misc_feature: GYAE6OF02HBJGE.30.25.C03.1.454.CMB.1.raw
  modified_base (154)..(154): a, c, t, g, unknown or other
  misc_feature (154)..(154): n is a, c, g, or t

SEQ ID NO: 205702 - DNA, 233 bp, Homo sapiens; identical to SEQ ID NO: 205207
  misc_feature: GYAE6OF02IWPE8.30.25.C03.1.454.CMB.1.raw
  modified_base (229)..(233): a, c, t, g, unknown or other
  misc_feature (229)..(233): n is a, c, g, or t

SEQ ID NO: 205703 - DNA, 263 bp, Homo sapiens
  misc_feature: GYAE6OF02FWA9Z.30.25.C03.1.454.CMB.1.raw
  modified_base (234)..(263): a, c, t, g, unknown or other
  misc_feature (234)..(263): n is a, c, g, or t
tcagcacgctacgtcacgaccggtgctcgatttagtagtgtagatttgggtttgggtgcccaaggctgctggagggcacggtcaccgtctcctcagcctccaccaagggcccactcggtcttccccctggcacccgtcctccaagagcacctctgggggcacagcggccctgggctgcctggtcaaggactacttccacgtagcgtgctcgagcgggctggcaaggcgcatagnnnnnnnnnnnnnnnnnnnnnnnnnnnnnn

SEQ ID NO: 205704 - DNA, 252 bp, Homo sapiens
  misc_feature: GYAE6OF02HABTP.30.25.C03.1.454.CMB.1.raw
  modified_base (231)..(252): a, c, t, g, unknown or other
  misc_feature (231)..(252): n is a, c, g, or t
tcagcacgctacgtcacgaccggtgctcgatttagtagtgtagatttgggtttgggtggcccaagctgctggagggcacggtcaccgtctcctcagcctccaccaagggcccatcggtcttccccctggcaccctcctccaagagcacctctgggggcacagcggccctgggctgcctggtcaaggactacttccacgtagcgtgctgagcgggctggcaaggcgcatagnnnnnnnnnnnnnnnnnnnnnn

SEQ ID NO: 205705 - DNA, 172 bp, Homo sapiens
  misc_feature: GYAE6OF02G2GR4.30.25.C03.1.454.CMB.1.raw
  modified_base (172)..(172): a, c, t, g, unknown or other
  misc_feature (172)..(172): n is a, c, g, or t
tcagcacgctacgtcacgaccggtgctcgatttagtagtgtagatttgggtttgggggaagaggaagactgacggtcccccaggagttcaggtgctgggcacagcggccctgggctgcctggtcaaggactacttccagtagcgtgctgagcgggctggcaaggcgcatagn

SEQ ID NO: 205706 - DNA, 173 bp, Homo sapiens; identical to SEQ ID NO: 205084
  misc_feature: GYAE6OF02IA0LA.30.25.C03.1.454.CMB.1.raw
  modified_base (173)..(173): a, c, t, g, unknown or other
  misc_feature (173)..(173): n is a, c, g, or t

SEQ ID NO: 205707 - DNA, 231 bp, Homo sapiens
  misc_feature: GYAE6OF02IH7HG.30.25.C03.1.454.CMB.1.raw
  modified_base (231)..(231): a, c, t, g, unknown or other
  misc_feature (231)..(231): n is a, c, g, or t
tcagcacgctacgtcacgaccggtgctcgatttagtagtgtagatttgggtttgggtgcccaagctgctggagggcacggtcaccgtctcctcagcctccaccaagggcccatcggtcttcccccctggcaccctcctccaagagcacctctgggggcacagcggccctgggctgcctggtcaaggactacttccacgtagcgtgctgagcgggctggcaaggcgcatagn

SEQ ID NO: 205708 - DNA, 173 bp, Homo sapiens; identical to SEQ ID NO: 205084
  misc_feature: GYAE6OF02HZD56.30.25.C03.1.454.CMB.1.raw
  modified_base (173)..(173): a, c, t, g, unknown or other
  misc_feature (173)..(173): n is a, c, g, or t

SEQ ID NO: 205709 - DNA, 231 bp, Homo sapiens; identical to SEQ ID NO: 205129
  misc_feature: GYAE6OF02FMM7W.30.25.C03.1.454.CMB.1.raw
  modified_base (229)..(231): a, c, t, g, unknown or other
  misc_feature (229)..(231): n is a, c, g, or t

SEQ ID NO: 205710 - DNA, 155 bp, Homo sapiens; identical to SEQ ID NO: 205076
  misc_feature: GYAE6OF02FGYNX.30.25.C03.1.454.CMB.1.raw
  modified_base (155)..(155): a, c, t, g, unknown or other
  misc_feature (155)..(155): n is a, c, g, or t

SEQ ID NO: 205711 - DNA, 175 bp, Homo sapiens; identical to SEQ ID NO: 205102
  misc_feature: GYAE6OF02GOBE9.30.25.C03.1.454.CMB.1.raw
  modified_base (173)..(175): a, c, t, g, unknown or other
  misc_feature (173)..(175): n is a, c, g, or t

SEQ ID NO: 205712 - DNA, 233 bp, Homo sapiens; identical to SEQ ID NO: 205223
  misc_feature: GYAE6OF02JD89X.30.25.C03.1.454.CMB.1.raw
  modified_base (229)..(233): a, c, t, g, unknown or other
  misc_feature (229)..(233): n is a, c, g, or t

SEQ ID NO: 205713 - DNA, 232 bp, Homo sapiens; identical to SEQ ID NO: 205123
  misc_feature: GYAE6OF02IULN3.30.25.C03.1.454.CMB.1.raw
  modified_base (229)..(232): a, c, t, g, unknown or other
  misc_feature (229)..(232): n is a, c, g, or t

SEQ ID NO: 205714 - DNA, 234 bp, Homo sapiens
  misc_feature: GYAE6OF02JFPHX.30.25.C03.1.454.CMB.1.raw
  modified_base (228)..(234): a, c, t, g, unknown or other
  misc_feature (228)..(234): n is a, c, g, or t
tcagcacgctacgtcacgaccggtgctcgatttagtagtgtagatttgggtttgggtgcccaagctgctggagggcacggtcaccgtctcctcagcctccaccaagggcccatcggtcttcccctggcaccctctccaagagcacctctggggcacagcggccctgggctgcctggtcaaggactacttccacgtagcgtgctgagcgggctggcaaggcgcataggnnnnnnn

SEQ ID NO: 205715 - DNA, 232 bp, Homo sapiens; identical to SEQ ID NO: 205063
  misc_feature: GYAE6OF02G7ANN.30.25.C03.1.454.CMB.1.raw
  modified_base (230)..(232): a, c, t, g, unknown or other
  misc_feature (230)..(232): n is a, c, g, or t

SEQ ID NO: 205716 - DNA, 230 bp, Homo sapiens; identical to SEQ ID NO: 205095
  misc_feature: GYAE6OF02GM8OE.30.25.C03.1.454.CMB.1.raw
  modified_base (230)..(230): a, c, t, g, unknown or other
  misc_feature (230)..(230): n is a, c, g, or t

SEQ ID NO: 205717 - DNA, 231 bp, Homo sapiens; identical to SEQ ID NO: 205180
  misc_feature: GYAE6OF02JGV1S.30.25.C03.1.454.CMB.1.raw
  modified_base (229)..(231): a, c, t, g, unknown or other
  misc_feature (229)..(231): n is a, c, g, or t

SEQ ID NO: 205718 - DNA, 233 bp, Homo sapiens
  misc_feature: GYAE6OF02G8IRK.30.25.C03.1.454.CMB.1.raw
  modified_base (230)..(233): a, c, t, g, unknown or other
  misc_feature (230)..(233): n is a, c, g, or t
tcagcacgctacgtcacgaccggtgctcgatttagtagtgtagatttgggtttgggtgcccaagctgctggagggcacggtcaccgtctcctcagcctccaccaagggcccatcggtcttccccctggcaccctcctccaagagcacctctgggggcacagcggccctgggctgcctgatcaaggactacttccacgtagcgtgctgagcgggctggcaaggcgcatagnnnn

SEQ ID NO: 205719 - DNA, 174 bp, Homo sapiens; identical to SEQ ID NO: 205077
  misc_feature: GYAE6OF02I97NW.30.25.C03.1.454.CMB.1.raw
  modified_base (173)..(174): a, c, t, g, unknown or other
  misc_feature (173)..(174): n is a, c, g, or t

SEQ ID NO: 205720 - DNA, 233 bp, Homo sapiens
  misc_feature: GYAE6OF02GKGIH.30.25.C03.1.454.CMB.1.raw
  modified_base (230)..(233): a, c, t, g, unknown or other
  misc_feature (230)..(233): n is a, c, g, or t
tcagcacgctacgtcacgaccggtgctcgatttagtagtgtagatttgggtttgggtgcccaagctgctggagggcacggtcaccgtctcctcagcctccaccaagggcccatcggtcttccccctggcaccctcctccaagagcacctctgggggcacagcggccctgggctgcctggtcaaggactacttccatgtagcgtgctgagcgggctggcaaggcgcatagnnnn

SEQ ID NO: 205721 - DNA, 184 bp, Homo sapiens
  misc_feature: GYAE6OF02IZX9N.30.25.C03.1.454.CMB.1.raw
  modified_base (139)..(139): a, c, t, g, unknown or other
  misc_feature (139)..(139): n is a, c, g, or t
  modified_base (155)..(184): a, c, t, g, unknown or other
  misc_feature (155)..(184): n is a, c, g, or t
tcagcacgctacgtcacgaccggtgctcgatttagtagtgtagatttgggtttggggggaagaggaagactgacggtcctgccacagcggccctgggctgcctggtcaaggctacttccacgtagcgtgctgagcgggntggcaaggcgcatagnnnnnnnnnnnnnnnnnnnnnnnnnnnnnn

SEQ ID NO: 205722 - DNA, 156 bp, Homo sapiens; identical to SEQ ID NO: 205094
  misc_feature: GYAE6OF02FYN39.30.25.C03.1.454.CMB.1.raw
  modified_base (155)..(156): a, c, t, g, unknown or other
  misc_feature (155)..(156): n is a, c, g, or t

SEQ ID NO: 205723 - DNA, 234 bp, Homo sapiens; identical to SEQ ID NO: 205242
  misc_feature: GYAE6OF02HZBNY.30.25.C03.1.454.CMB.1.raw
  modified_base (230)..(234): a, c, t, g, unknown or other
  misc_feature (230)..(234): n is a, c, g, or t

SEQ ID NO: 205724 - DNA, 160 bp, Homo sapiens; identical to SEQ ID NO: 205267
  misc_feature: GYAE6OF02HWES1.30.25.C03.1.454.CMB.1.raw
  modified_base (155)..(160): a, c, t, g, unknown or other
  misc_feature (155)..(160): n is a, c, g, or t

SEQ ID NO: 205725 - DNA, 241 bp, Homo sapiens; identical to SEQ ID NO: 205307
  misc_feature: GYAE6OF02J1PVJ.30.25.C03.1.454.CMB.1.raw
  modified_base (228)..(241): a, c, t, g, unknown or other
  misc_feature (228)..(241): n is a, c, g, or t

SEQ ID NO: 205726 - DNA, 189 bp, Homo sapiens
  misc_feature: GYAE6OF02ITBHU.30.25.C03.1.454.CMB.1.raw
  modified_base (160)..(189): a, c, t, g, unknown or other
  misc_feature (160)..(189): n is a, c, g, or t
tcagcacgctacgtcacgaccggtgctcgatttagtagtgtagatttgggtttgggggaagaggaaagactgacggtcctggccacagcggccctgggctgacctggtcaaaggactacgttccacgtagcgtgctgagcgggctggcaaggcgcatagnnnnnnnnnnnnnnnnnnnnnnnnnnnnnn

SEQ ID NO: 205727 - DNA, 172 bp, Homo sapiens; identical to SEQ ID NO: 205314
  misc_feature: GYAE6OF02GHTM5.30.25.C03.1.454.CMB.1.raw
  modified_base (170)..(172): a, c, t, g, unknown or other
  misc_feature (170)..(172): n is a, c, g, or t

SEQ ID NO: 205728 - DNA, 236 bp, Homo sapiens
  misc_feature: GYAE6OF02HKIZL.30.25.C03.1.454.CMB.1.raw
  modified_base (232)..(236): a, c, t, g, unknown or other
  misc_feature (232)..(236): n is a, c, g, or t
tcagcacgctacgtcacgaccggtgctcgatttagtagtgtagatttgggtttgggttggtccgaagctgctggagggcgacggtcaccgtctcctcagcctccaccaagggcccatcggtcttcccctggccaccctcctccaagagcacctctggggcacagcggcctgggctgcctggtcaaggactacttccacgtagcgtgctgagcgggctggcaaggcgcatagnnnnn

SEQ ID NO: 205729 - DNA, 175 bp, Homo sapiens; identical to SEQ ID NO: 205102
  misc_feature: GYAE6OF02G3SW7.30.25.C03.1.454.CMB.1.raw
  modified_base (173)..(175): a, c, t, g, unknown or other
  misc_feature (173)..(175): n is a, c, g, or t

SEQ ID NO: 205730 - DNA, 171 bp, Homo sapiens; identical to SEQ ID NO: 205048
  misc_feature: GYAE6OF02HFYAF.30.25.C03.1.454.CMB.1.raw
  modified_base (171)..(171): a, c, t, g, unknown or other
  misc_feature (171)..(171): n is a, c, g, or t

SEQ ID NO: 205731 - DNA, 184 bp, Homo sapiens
  misc_feature: GYAE6OF02FX1D9.30.25.C03.1.454.CMB.1.raw
  modified_base (173)..(184): a, c, t, g, unknown or other
  misc_feature (173)..(184): n is a, c, g, or t
tcagcacgctacgtcacgaccggtgctcgatttagtagtgtagatttgggtttgggggaagaggaagactgacggtcccccaggagttcaggtgctgggcacagcggccctgggctgcctggtcaaggactacttccacgtagcgtgctgagcgggctggcaaggcgcatagnnnnnnnnnnnn

SEQ ID NO: 205732 - DNA, 234 bp, Homo sapiens; identical to SEQ ID NO: 205242
  misc_feature: GYAE6OF02IUJ7L.30.25.C03.1.454.CMB.1.raw
  modified_base (230)..(234): a, c, t, g, unknown or other
  misc_feature (230)..(234): n is a, c, g, or t

SEQ ID NO: 205733 - DNA, 155 bp, Homo sapiens; identical to SEQ ID NO: 205076
  misc_feature: GYAE6OF02IFF4P.30.25.C03.1.454.CMB.1.raw
  modified_base (155)..(155): a, c, t, g, unknown or other
  misc_feature (155)..(155): n is a, c, g, or t

SEQ ID NO: 205734 - DNA, 174 bp, Homo sapiens; identical to SEQ ID NO: 205077
  misc_feature: GYAE6OF02GGO0W.30.25.C03.1.454.CMB.1.raw
  modified_base (173)..(174): a, c, t, g, unknown or other
  misc_feature (173)..(174): n is a, c, g, or t

SEQ ID NO: 205735 - DNA, 177 bp, Homo sapiens
  misc_feature: GYAE6OF02JMC07.30.25.C03.1.454.CMB.1.raw
  modified_base (172)..(177): a, c, t, g, unknown or other
  misc_feature (172)..(177): n is a, c, g, or t
tcagcacgctacgtcacgaccggtgctcgatttagtagtgtagatttgggtttgggggaagaggaagactgacggtccccaggagttcaggtgctgggcacagcggccctgggctgcctggtcaaggactacttccacgtagcgtgctgagcgggctggcaaggcgcatagnnnnnn

SEQ ID NO: 205736 - DNA, 173 bp, Homo sapiens; identical to SEQ ID NO: 205084
  misc_feature: GYAE6OF02G53YI.30.25.C03.1.454.CMB.1.raw
  modified_base (173)..(173): a, c, t, g, unknown or other
  misc_feature (173)..(173): n is a, c, g, or t

SEQ ID NO: 205737 - DNA, 230 bp, Homo sapiens; identical to SEQ ID NO: 205064
  misc_feature: GYAE6OF02HPJWW.30.25.C03.1.454.CMB.1.raw
  modified_base (228)..(230): a, c, t, g, unknown or other
  misc_feature (228)..(230): n is a, c, g, or t

SEQ ID NO: 205738 - DNA, 255 bp, Homo sapiens
  misc_feature: GYAE6OF02HMME9.30.25.C03.1.454.CMB.1.raw
  modified_base (229)..(255): a, c, t, g, unknown or other
  misc_feature (229)..(255): n is a, c, g, or t
tcagcacgctacgtcacgaccggtgctcgatttagtagtgtagatttgggtttgggtgcccaagctgctggagggcacggtcaccgtctcctcagcctccaccaagggcccatcggtcttccccctggcaccctcctccaagagcacctctggggcacagcggccctgggctgcctggtcaaggactacttccacgtagcgtgctgagcgggctggcaaggcgcatagnnnnnnnnnnnnnnnnnnnnnnnnnnn

SEQ ID NO: 205739 - DNA, 233 bp, Homo sapiens; identical to SEQ ID NO: 205189
  misc_feature: GYAE6OF02GY5DW.30.25.C03.1.454.CMB.1.raw
  modified_base (230)..(233): a, c, t, g, unknown or other
  misc_feature (230)..(233): n is a, c, g, or t

SEQ ID NO: 205740 - DNA, 232 bp, Homo sapiens; identical to SEQ ID NO: 205063
  misc_feature: GYAE6OF02H1SR4.30.25.C03.1.454.CMB.1.raw
  modified_base (230)..(232): a, c, t, g, unknown or other
  misc_feature (230)..(232): n is a, c, g, or t

SEQ ID NO: 205741 - DNA, 175 bp, Homo sapiens; identical to SEQ ID NO: 205102
  misc_feature: GYAE6OF02G2DDG.30.25.C03.1.454.CMB.1.raw
  modified_base (173)..(175): a, c, t, g, unknown or other
  misc_feature (173)..(175): n is a, c, g, or t

SEQ ID NO: 205742 - DNA, 233 bp, Homo sapiens; identical to SEQ ID NO: 205189
  misc_feature: GYAE6OF02G3OAR.30.25.C03.1.454.CMB.1.raw
  modified_base (230)..(233): a, c, t, g, unknown or other
  misc_feature (230)..(233): n is a, c, g, or t

SEQ ID NO: 205743 - DNA, 234 bp, Homo sapiens; identical to SEQ ID NO: 205242
  misc_feature: GYAE6OF02GNUHN.30.25.C03.1.454.CMB.1.raw
  modified_base (230)..(234): a, c, t, g, unknown or other
  misc_feature (230)..(234): n is a, c, g, or t

SEQ ID NO: 205744 - DNA, 173 bp, Homo sapiens; identical to SEQ ID NO: 205084
  misc_feature: GYAE6OF02F0OBQ.30.25.C03.1.454.CMB.1.raw
  modified_base (173)..(173): a, c, t, g, unknown or other
  misc_feature (173)..(173): n is a, c, g, or t

SEQ ID NO: 205745 - DNA, 165 bp, Homo sapiens
  misc_feature: GYAE6OF02FQQDP.30.25.C03.1.454.CMB.1.raw
  modified_base (156)..(165): a, c, t, g, unknown or other
  misc_feature (156)..(165): n is a, c, g, or t
tcagcacgctacgtcacgaccggtgctcgatttagtagtgtagatttgggtttgggggaaggaggaagactgacggtcctgccacagcggccctgggctgcctggtcaaggactacttccacgtagcgtgctgagcgggctggcaaggcgcatagnnnnnnnnnn

SEQ ID NO: 205746 - DNA, 233 bp, Homo sapiens; identical to SEQ ID NO: 205207
  misc_feature: GYAE6OF02FHWHN.30.25.C03.1.454.CMB.1.raw
  modified_base (229)..(233): a, c, t, g, unknown or other
  misc_feature (229)..(233): n is a, c, g, or t

SEQ ID NO: 205747 - DNA, 189 bp, Homo sapiens
  misc_feature: GYAE6OF02FKXWI.30.25.C03.1.454.CMB.1.raw
  modified_base (172)..(189): a, c, t, g, unknown or other
  misc_feature (172)..(189): n is a, c, g, or t
tcagcacgctacgtcacgaccggtgctcgatttagtagtgtagatttgggtttgggggaagaggaagactgacggtcccccaggagttcaggtgctgggcacagcggaccctgggctgcctggtcaaggctattccacgtagcgtgctgagcgggctggcaaggcgcatagnnnnnnnnnnnnnnnnnn

SEQ ID NO: 205748 - DNA, 173 bp, Homo sapiens; identical to SEQ ID NO: 205084
  misc_feature: GYAE6OF02GV80N.30.25.C03.1.454.CMB.1.raw
  modified_base (173)..(173): a, c, t, g, unknown or other
  misc_feature (173)..(173): n is a, c, g, or t

SEQ ID NO: 205749 - DNA, 173 bp, Homo sapiens; identical to SEQ ID NO: 205084
  misc_feature: GYAE6OF02HN4U0.30.25.C03.1.454.CMB.1.raw
  modified_base (173)..(173): a, c, t, g, unknown or other
  misc_feature (173)..(173): n is a, c, g, or t

SEQ ID NO: 205750 - DNA, 232 bp, Homo sapiens
  misc_feature: GYAE6OF02GR08C.30.25.C03.1.454.CMB.1.raw
  modified_base (229)..(232): a, c, t, g, unknown or other
  misc_feature (229)..(232): n is a, c, g, or t
tcagcacgctacgtcacgaccggtgctcgatttagtagtgtagatttgggtttgggtgcccaagctgctggagggcacggtcaccgtctcctcagcctccaccaaggcccatcggtcttcccctggcaccctcctccaagagcacctcgtgggggcacagcggccctgggctgcctggtcaaggactacttccacgtagcgtgctgagcgggctggcaaggcgcatagnnnn

SEQ ID NO: 205751 - DNA, 232 bp, Homo sapiens; identical to SEQ ID NO: 205063
  misc_feature: GYAE6OF02F7KCM.30.25.C03.1.454.CMB.1.raw
  modified_base (230)..(232): a, c, t, g, unknown or other
  misc_feature (230)..(232): n is a, c, g, or t

SEQ ID NO: 205752 - DNA, 230 bp, Homo sapiens; identical to SEQ ID NO: 205071
  misc_feature: GYAE6OF02IBSLE.30.25.C03.1.454.CMB.1.raw
  modified_base (229)..(230): a, c, t, g, unknown or other
  misc_feature (229)..(230): n is a, c, g, or t

SEQ ID NO: 205753 - DNA, 232 bp, Homo sapiens; identical to SEQ ID NO: 205063
  misc_feature: GYAE6OF02G0SOH.30.25.C03.1.454.CMB.1.raw
  modified_base (230)..(232): a, c, t, g, unknown or other
  misc_feature (230)..(232): n is a, c, g, or t

SEQ ID NO: 205754 - DNA, 235 bp, Homo sapiens
  misc_feature: GYAE6OF02G15FW.30.25.C03.1.454.CMB.1.raw
  modified_base (233)..(235): a, c, t, g, unknown or other
  misc_feature (233)..(235): n is a, c, g, or t
tcagcacgctacgtcacgaccggtgctcgatttagtagtgtagatttgggtttgggtggcccaagctaggctggagggcacggtcaccgtctcctcagcctccaccaagggcccatcggtcttccccctggcaccctcctccaagagcacctctgggggcacagcggccctgggctgcctggtcaaggactacttccacgtagcgtgctgagcgggctggcaaggcgcatagnnn

SEQ ID NO: 205755 - DNA, 186 bp, Homo sapiens
  misc_feature: GYAE6OF02FKNF2.30.25.C03.1.454.CMB.1.raw
  modified_base (174)..(186): a, c, t, g, unknown or other
  misc_feature (174)..(186): n is a, c, g, or t
tcagcacgctacgtcacgaccggtgctcgatttagtagtgtagatttgggtttgggggaaggaggaagactgacggtcccccaggagttcaggtgctgggcacagcggccctgggctgcctggtcaaggactacttccacgtagcgtgctgagcgggctggcaaggcgcatagnnnnnnnnnnnnn

SEQ ID NO: 205756 - DNA, 232 bp, Homo sapiens; identical to SEQ ID NO: 205063
  misc_feature: GYAE6OF02GXEGE.30.25.C03.1.454.CMB.1.raw
  modified_base (230)..(232): a, c, t, g, unknown or other
  misc_feature (230)..(232): n is a, c, g, or t

SEQ ID NO: 205757 - DNA, 175 bp, Homo sapiens; identical to SEQ ID NO: 205102
  misc_feature: GYAE6OF02IV7TF.30.25.C03.1.454.CMB.1.raw
  modified_base (173)..(175): a, c, t, g, unknown or other
  misc_feature (173)..(175): n is a, c, g, or t

SEQ ID NO: 205758 - DNA, 157 bp, Homo sapiens; identical to SEQ ID NO: 205114
  misc_feature: GYAE6OF02F1KNC.30.25.C03.1.454.CMB.1.raw
  modified_base (155)..(157): a, c, t, g, unknown or other
  misc_feature (155)..(157): n is a, c, g, or t

SEQ ID NO: 205759 - DNA, 235 bp, Homo sapiens; identical to SEQ ID NO: 205318
  misc_feature: GYAE6OF02G174K.30.25.C03.1.454.CMB.1.raw
  modified_base (230)..(235): a, c, t, g, unknown or other
  misc_feature (230)..(235): n is a, c, g, or t

SEQ ID NO: 205760 - DNA, 235 bp, Homo sapiens
  misc_feature: GYAE6OF02HS3II.30.25.C03.1.454.CMB.1.raw
  modified_base (229)..(235): a, c, t, g, unknown or other
  misc_feature (229)..(235): n is a, c, g, or t
tcagcacgctacgtcacgaccggtgctcgatttagtagtgtagatttgggtttgggtgcccaagctgctggagggcacggtcaccgtctcctcagcctccaccaagggcccatcggtcttcccctggcaccctcctccaagagcacctctgggggcacagcggccctgggctgcctggtcaaggactacttccacgtagcgtgctgagcgggctggcaaggcgcatagnnnnnnn

SEQ ID NO: 205761 - DNA, 168 bp, Homo sapiens
  misc_feature: GYAE6OF02HGUMT.30.25.C03.1.454.CMB.1.raw
  modified_base (156)..(168): a, c, t, g, unknown or other
  misc_feature (156)..(168): n is a, c, g, or t
tcagcacgctacgtcacgaccggtgctcgatttagtagtgtagatttgggtttgggggaagaggaagactgacggtcctgccacagcggccctgggctgcctggtcaaggactacttccacgtagcgtgctgagcgggctggcaaggcgacatagnnnnnnnnnnnnn

SEQ ID NO: 205762 - DNA, 232 bp, Homo sapiens; identical to SEQ ID NO: 205198
  misc_feature: GYAE6OF02JE6FG.30.25.C03.1.454.CMB.1.raw
  modified_base (228)..(232): a, c, t, g, unknown or other
  misc_feature (228)..(232): n is a, c, g, or t

SEQ ID NO: 205763 - DNA, 174 bp, Homo sapiens
  misc_feature: GYAE6OF02HMURQ.30.25.C03.1.454.CMB.1.raw
  modified_base (174)..(174): a, c, t, g, unknown or other
  misc_feature (174)..(174): n is a, c, g, or t
tcagcacgctacgtcacgaccggtgctcgatttagtagtgtagatttgggtttgggggaagaggaagactgaccggtcccccaggagttcaggtgctgggcacagcggccctgggctgcctggtcaaggactacttccacgtagcgtgctgagcgggctggcaaggcgcatagn

SEQ ID NO: 205764 - DNA, 234 bp, Homo sapiens
  misc_feature: GYAE6OF02JCN7X.30.25.C03.1.454.CMB.1.raw
  modified_base (229)..(234): a, c, t, g, unknown or other
  misc_feature (229)..(234): n is a, c, g, or t
tcagcacgctacgtcacgaccggtgctcgatttagtagtgtagatttgggtttgggtgcccaagctgctggagggcacggtcaccgtctcctcagcctccaccaagggcccatcggtcttccccctggcaccctcctccaagagcacctctggggcacagcggccctgggctgcctggtcaaggactacttccacgtagcgtgctgagcgggctggcaaggcgcatagnnnnnn

SEQ ID NO: 205765 - DNA, 155 bp, Homo sapiens; identical to SEQ ID NO: 205076
  misc_feature: GYAE6OF02IAIZ4.30.25.C03.1.454.CMB.1.raw
  modified_base (155)..(155): a, c, t, g, unknown or other
  misc_feature (155)..(155): n is a, c, g, or t

SEQ ID NO: 205766 - DNA, 184 bp, Homo sapiens
  misc_feature: GYAE6OF02GYN98.30.25.C03.1.454.CMB.1.raw
  modified_base (161)..(184): a, c, t, g, unknown or other
  misc_feature (161)..(184): n is a, c, g, or t
tcagcacgctacgtcacgaccggtgctcgatttagtagtgtagatttgggtttggggggtaaggtagggaaggactgacggtcctgccacagcggccctgggctgcctggtcaaggctacttccacgtagcgtgctgagcgggctggcaaggcgcgatagnnnnnnnnnnnnnnnnnnnnnnnn

SEQ ID NO: 205767 - DNA, 215 bp, Homo sapiens
  misc_feature: GYAE6OF02HNGU0.30.25.C03.1.454.CMB.1.raw
  modified_base (189)..(215): a, c, t, g, unknown or other
  misc_feature (189)..(215): n is a, c, g, or t
tcagcacgctacgtcacgaccggtgctcgatttagtagtgtagatttgggtttggggggaagagggaagacgtgaccgggtccccccagggacgttcaggtgctgggtcacagcggccctgggctgcctggtcaaggactacttccacgtagcgtgtctgagcgggctgggtcctaaggtcgcattagnnnnnnnnnnnnnnnnnnnnnnnnnnn

SEQ ID NO: 205768 - DNA, 173 bp, Homo sapiens
  misc_feature: GYAE6OF02J0N6H.30.25.C03.1.454.CMB.1.raw
  modified_base (172)..(173): a, c, t, g, unknown or other
  misc_feature (172)..(173): n is a, c, g, or t
tcagcacgctacgtcacgaccggtgctcgatttagtagtgtagatttggtttgggggaagaggaagactgacggtcccccaggagttcaggtgctgggcacagcggccctgggctgcctggtcaaggactacttccacgtagcgtgctgagcgggctggcaaggcgcatagnn

SEQ ID NO: 205769 - DNA, 232 bp, Homo sapiens; identical to SEQ ID NO: 205063
  misc_feature: GYAE6OF02F9O2M.30.25.C03.1.454.CMB.1.raw
  modified_base (230)..(232): a, c, t, g, unknown or other
  misc_feature (230)..(232): n is a, c, g, or t

SEQ ID NO: 205770 - DNA, 231 bp, Homo sapiens; identical to SEQ ID NO: 205120
  misc_feature: GYAE6OF02JBOEH.30.25.C03.1.454.CMB.1.raw
  modified_base (230)..(231): a, c, t, g, unknown or other
  misc_feature (230)..(231): n is a, c, g, or t

SEQ ID NO: 205771 - DNA, 155 bp, Homo sapiens; identical to SEQ ID NO: 205076
  misc_feature: GYAE6OF02IZDTY.30.25.C03.1.454.CMB.1.raw
  modified_base (155)..(155): a, c, t, g, unknown or other
  misc_feature (155)..(155): n is a, c, g, or t

SEQ ID NO: 205772 - DNA, 235 bp, Homo sapiens; identical to SEQ ID NO: 205760
  misc_feature: GYAE6OF02HGEFL.30.25.C03.1.454.CMB.1.raw
  modified_base (229)..(235): a, c, t, g, unknown or other
  misc_feature (229)..(235): n is a, c, g, or t

SEQ ID NO: 205773 - DNA, 234 bp, Homo sapiens; identical to SEQ ID NO: 205764
  misc_feature: GYAE6OF02G93XG.30.25.C03.1.454.CMB.1.raw
  modified_base (229)..(234): a, c, t, g, unknown or other
  misc_feature (229)..(234): n is a, c, g, or t

SEQ ID NO: 205774 - DNA, 232 bp, Homo sapiens; identical to SEQ ID NO: 205063
  misc_feature: GYAE6OF02IAHBM.30.25.C03.1.454.CMB.1.raw
  modified_base (230)..(232): a, c, t, g, unknown or other
  misc_feature (230)..(232): n is a, c, g, or t

SEQ ID NO: 205775 - DNA, 233 bp, Homo sapiens; identical to SEQ ID NO: 205189
  misc_feature: GYAE6OF02GBLOA.30.25.C03.1.454.CMB.1.raw
  modified_base (230)..(233): a, c, t, g, unknown or other
  misc_feature (230)..(233): n is a, c, g, or t

SEQ ID NO: 205776 - DNA, 182 bp, Homo sapiens
  misc_feature: GYAE6OF02HMKCJ.30.25.C03.1.454.CMB.1.raw
  modified_base (172)..(182): a, c, t, g, unknown or other
  misc_feature (172)..(182): n is a, c, g, or t
tcagcacgctacgtcacgaccggtgctcgatttagtagtgtagatttgggttgggggaagaggaagactgacggtcccccaggagttcaggtgctgggcacagcggccctgggctgcctggtcaaggactacttccacgtagcgtgctgagcgggctggcaaggcgcatagnnnnnnnnnnn

SEQ ID NO: 205777 - DNA, 176 bp, Homo sapiens; identical to SEQ ID NO: 205124
  misc_feature: GYAE6OF02JI1Z0.30.25.C03.1.454.CMB.1.raw
  modified_base (173)..(176): a, c, t, g, unknown or other
  misc_feature (173)..(176): n is a, c, g, or t

SEQ ID NO: 205778 - DNA, 229 bp, Homo sapiens; identical to SEQ ID NO: 205136
  misc_feature: GYAE6OF02F6TN9.30.25.C03.1.454.CMB.1.raw
  modified_base (229)..(229): a, c, t, g, unknown or other
  misc_feature (229)..(229): n is a, c, g, or t

SEQ ID NO: 205779 - DNA, 176 bp, Homo sapiens; identical to SEQ ID NO: 205124
  misc_feature: GYAE6OF02GXEFB.30.25.C03.1.454.CMB.1.raw
  modified_base (173)..(176): a, c, t, g, unknown or other
  misc_feature (173)..(176): n is a, c, g, or t

SEQ ID NO: 205780 - DNA, 176 bp, Homo sapiens
  misc_feature: GYAE6OF02FTVQC.30.25.C03.1.454.CMB.1.raw
  modified_base (174)..(176): a, c, t, g, unknown or other
  misc_feature (174)..(176): n is a, c, g, or t
tcagcacgctacgtcacgaccggtgctcgatttagtagtgtagatttgggtttgggggaagaggaagactgacggtccccccaggagttcaggtgctgggcacagcggccctgggctgcctggtcaaggactacttccacgtagcgtgctgagcgggctggcaaggcgcatagnnn

SEQ ID NO: 205781 - DNA, 223 bp, Homo sapiens
  misc_feature: GYAE6OF02G8JW4.30.25.C03.1.454.CMB.1.raw
  modified_base (174)..(223): a, c, t, g, unknown or other
  misc_feature (174)..(223): n is a, c, g, or t
tcagcacgctacgtcacgaccggtgctcgatttagtagtgtagatttgggtttgggggaaggaggaagactgacggtcccccaggagttcaggtgctgggcacagcggccctgggctgcctggtcaaggactacttccacgtagcgtgctgagcgggctggcaaggcgcatagnnnnnnnnnnnnnnnnnnnnnnnnnnnnnnnnnnnnnnnnnnnnnnnnnn

SEQ ID NO: 205782 - DNA, 178 bp, Homo sapiens; identical to SEQ ID NO: 205093
  misc_feature: GYAE6OF02G0PZT.30.25.C03.1.454.CMB.1.raw
  modified_base (173)..(178): a, c, t, g, unknown or other
  misc_feature (173)..(178): n is a, c, g, or t

SEQ ID NO: 205783 - DNA, 160 bp, Homo sapiens; identical to SEQ ID NO: 205267
  misc_feature: GYAE6OF02HU0EZ.30.25.C03.1.454.CMB.1.raw
  modified_base (155)..(160): a, c, t, g, unknown or other
  misc_feature (155)..(160): n is a, c, g, or t

SEQ ID NO: 205784 - DNA, 231 bp, Homo sapiens; identical to SEQ ID NO: 205120
  misc_feature: GYAE6OF02GI33P.30.25.C03.1.454.CMB.1.raw
  modified_base (230)..(231): a, c, t, g, unknown or other
  misc_feature (230)..(231): n is a, c, g, or t

SEQ ID NO: 205785 - DNA, 232 bp, Homo sapiens; identical to SEQ ID NO: 205063
  misc_feature: GYAE6OF02FZPJX.30.25.C03.1.454.CMB.1.raw
  modified_base (230)..(232): a, c, t, g, unknown or other
  misc_feature (230)..(232): n is a, c, g, or t

SEQ ID NO: 205786 - DNA, 232 bp, Homo sapiens; identical to SEQ ID NO: 205063
  misc_feature: GYAE6OF02H12GA.30.25.C03.1.454.CMB.1.raw
  modified_base (230)..(232): a, c, t, g, unknown or other
  misc_feature (230)..(232): n is a, c, g, or t

SEQ ID NO: 205787 - DNA, 173 bp, Homo sapiens; identical to SEQ ID NO: 205084
  misc_feature: GYAE6OF02G4OTO.30.25.C03.1.454.CMB.1.raw
  modified_base (173)..(173): a, c, t, g, unknown or other
  misc_feature (173)..(173): n is a, c, g, or t

SEQ ID NO: 205788 - DNA, 232 bp, Homo sapiens; identical to SEQ ID NO: 205063
  misc_feature: GYAE6OF02GV66U.30.25.C03.1.454.CMB.1.raw
  modified_base (230)..(232): a, c, t, g, unknown or other
  misc_feature (230)..(232): n is a, c, g, or t

SEQ ID NO: 205789 - DNA, 239 bp, Homo sapiens; identical to SEQ ID NO: 205502
  misc_feature: GYAE6OF02GWSMT.30.25.C03.1.454.CMB.1.raw
  modified_base (230)..(239): a, c, t, g, unknown or other
  misc_feature (230)..(239): n is a, c, g, or t

SEQ ID NO: 205790 - DNA, 234 bp, Homo sapiens; identical to SEQ ID NO: 205242
  misc_feature: GYAE6OF02HPKID.30.25.C03.1.454.CMB.1.raw
  modified_base (230)..(234): a, c, t, g, unknown or other
  misc_feature (230)..(234): n is a, c, g, or t

SEQ ID NO: 205791 - DNA, 155 bp, Homo sapiens; identical to SEQ ID NO: 205076
  misc_feature: GYAE6OF02F6YGT.30.25.C03.1.454.CMB.1.raw
  modified_base (155)..(155): a, c, t, g, unknown or other
  misc_feature (155)..(155): n is a, c, g, or t

SEQ ID NO: 205792 - DNA, 233 bp, Homo sapiens; identical to SEQ ID NO: 205189
  misc_feature: GYAE6OF02G8ZSV.30.25.C03.1.454.CMB.1.raw
  modified_base (230)..(233): a, c, t, g, unknown or other
  misc_feature (230)..(233): n is a, c, g, or t

SEQ ID NO: 205793 - DNA, 232 bp, Homo sapiens; identical to SEQ ID NO: 205063
  misc_feature: GYAE6OF02HDDO4.30.25.C03.1.454.CMB.1.raw
  modified_base (230)..(232): a, c, t, g, unknown or other
  misc_feature (230)..(232): n is a, c, g, or t

SEQ ID NO: 205794 - DNA, 199 bp, Homo sapiens
  misc_feature: GYAE6OF02G8MBI.30.25.C03.1.454.CMB.1.raw
  modified_base (174)..(199): a, c, t, g, unknown or other
  misc_feature (174)..(199): n is a, c, g, or t
tcagcacgctacgtcacgaccggtgctcgatttagtagtgtagatttgggtttgggggaagagggaagactgacggtcccccaggagttcaggtgctgggcacagcggccctgggctgcctggtcaaggactacttccacgtagcgtgctgagcgggctggcaaggcgcatagnnnnnnnnnnnnnnnnnnnnnnnnnn

SEQ ID NO: 205795 - DNA, 232 bp, Homo sapiens; identical to SEQ ID NO: 205063
  misc_feature: GYAE6OF02JBPDO.30.25.C03.1.454.CMB.1.raw
  modified_base (230)..(232): a, c, t, g, unknown or other
  misc_feature (230)..(232): n is a, c, g, or t

SEQ ID NO: 205796 - DNA, 174 bp, Homo sapiens
  misc_feature: GYAE6OF02F2H6H.30.25.C03.1.454.CMB.1.raw
  modified_base (174)..(174): a, c, t, g, unknown or other
  misc_feature (174)..(174): n is a, c, g, or t
tcagcacgctacgtcacgaccggtgctcgatttagtagtgtagatttgggtttgggggaagaggaagactgacggtccccccaggagttcaggtgctgggcacagcggccctgggctgcctggtcaaggactacttccacgtagcgtgctgagcgggctggcaaggcgcatagn

SEQ ID NO: 205797 - DNA, 179 bp, Homo sapiens; identical to SEQ ID NO: 205264
  misc_feature: GYAE6OF02JZFUO.30.25.C03.1.454.CMB.1.raw
  modified_base (173)..(179): a, c, t, g, unknown or other
  misc_feature (173)..(179): n is a, c, g, or t

SEQ ID NO: 205798 - DNA, 230 bp, Homo sapiens; identical to SEQ ID NO: 205095
  misc_feature: GYAE6OF02ISVTR.30.25.C03.1.454.CMB.1.raw
  modified_base (230)..(230): a, c, t, g, unknown or other
  misc_feature (230)..(230): n is a, c, g, or t

SEQ ID NO: 205799 - DNA, 237 bp, Homo sapiens; identical to SEQ ID NO: 205230
  misc_feature: GYAE6OF02H0HUQ.30.25.C03.1.454.CMB.1.raw
  modified_base (230)..(237): a, c, t, g, unknown or other
  misc_feature (230)..(237): n is a, c, g, or t

SEQ ID NO: 205800 - DNA, 155 bp, Homo sapiens; identical to SEQ ID NO: 205076
  misc_feature: GYAE6OF02FODHD.30.25.C03.1.454.CMB.1.raw
  modified_base (155)..(155): a, c, t, g, unknown or other
  misc_feature (155)..(155): n is a, c, g, or t

SEQ ID NO: 205801 - DNA, 234 bp, Homo sapiens; identical to SEQ ID NO: 205242
  misc_feature: GYAE6OF02IJSXE.30.25.C03.1.454.CMB.1.raw
  modified_base (230)..(234): a, c, t, g, unknown or other
  misc_feature (230)..(234): n is a, c, g, or t

SEQ ID NO: 205802 - DNA, 231 bp, Homo sapiens; identical to SEQ ID NO: 205120
  misc_feature: GYAE6OF02HI6SP.30.25.C03.1.454.CMB.1.raw
  modified_base (230)..(231): a, c, t, g, unknown or other
  misc_feature (230)..(231): n is a, c, g, or t

SEQ ID NO: 205803 - DNA, 157 bp, Homo sapiens; identical to SEQ ID NO: 205114
  misc_feature: GYAE6OF02FOGY8.30.25.C03.1.454.CMB.1.raw
  modified_base (155)..(157): a, c, t, g, unknown or other
  misc_feature (155)..(157): n is a, c, g, or t

SEQ ID NO: 205804 - DNA, 236 bp, Homo sapiens; identical to SEQ ID NO: 205399
  misc_feature: GYAE6OF02F6Y23.30.25.C03.1.454.CMB.1.raw
  modified_base (230)..(236): a, c, t, g, unknown or other
  misc_feature (230)..(236): n is a, c, g, or t

SEQ ID NO: 205805 - DNA, 234 bp, Homo sapiens
  misc_feature: GYAE6OF02HV76O.30.25.C03.1.454.CMB.1.raw
  modified_base (229)..(234): a, c, t, g, unknown or other
  misc_feature (229)..(234): n is a, c, g, or t
tcagcacgctacgtcacgaccggtgctcgatttagtagtgtagatttgggtttgggtgcccaagctgctggagggcacggtcaccgtctcctcagcctccaccaagggcccatcggtcttccccctggcaccctcctccaagagcacctctgggggcacagcggccctgggctgcctggtcaaggactacttcacgtagcgtgctgagcgggctggcaaggcgcatagnnnnnn

SEQ ID NO: 205806 - DNA, 450 bp, Homo sapiens
  misc_feature: GYAE6OF02F450Z.30.25.C03.1.454.CMB.1.raw
  modified_base (250)..(253): a, c, t, g, unknown or other
  misc_feature (250)..(253): n is a, c, g, or t
  modified_base (257)..(258): a, c, t, g, unknown or other
  misc_feature (257)..(258): n is a, c, g, or t
  modified_base (263)..(265): a, c, t, g, unknown or other
  misc_feature (263)..(265): n is a, c, g, or t
  modified_base (268)..(268): a, c, t, g, unknown or other
  misc_feature (268)..(268): n is a, c, g, or t
  modified_base (270)..(270): a, c, t, g, unknown or other
  misc_feature (270)..(270): n is a, c, g, or t
  modified_base (272)..(272): a, c, t, g, unknown or other
  misc_feature (272)..(272): n is a, c, g, or t
  modified_base (278)..(281): a, c, t, g, unknown or other
  misc_feature (278)..(281): n is a, c, g, or t
  modified_base (283)..(283): a, c, t, g, unknown or other
  misc_feature (283)..(283): n is a, c, g, or t
  modified_base (287)..(287): a, c, t, g, unknown or other
  misc_feature (287)..(287): n is a, c, g, or t
  modified_base (289)..(289): a, c, t, g, unknown or other
  misc_feature (289)..(289): n is a, c, g, or t
  modified_base (292)..(292): a, c, t, g, unknown or other
  misc_feature (292)..(292): n is a, c, g, or t
  modified_base (294)..(294): a, c, t, g, unknown or other
  misc_feature (294)..(294): n is a, c, g, or t
  modified_base (296)..(297): a, c, t, g, unknown or other
  misc_feature (296)..(297): n is a, c, g, or t
  modified_base (299)..(300): a, c, t, g, unknown or other
  misc_feature (299)..(300): n is a, c, g, or t
  modified_base (302)..(302): a, c, t, g, unknown or other
  misc_feature (302)..(302): n is a, c, g, or t
  modified_base (304)..(304): a, c, t, g, unknown or other
  misc_feature (304)..(304): n is a, c, g, or t
  modified_base (306)..(308): a, c, t, g, unknown or other
  misc_feature (306)..(308): n is a, c, g, or t
  modified_base (310)..(311): a, c, t, g, unknown or other
  misc_feature (310)..(311): n is a, c, g, or t
  modified_base (314)..(315): a, c, t, g, unknown or other
  misc_feature (314)..(315): n is a, c, g, or t
  modified_base (321)..(321): a, c, t, g, unknown or other
  misc_feature (321)..(321): n is a, c, g, or t
  modified_base (323)..(323): a, c, t, g, unknown or other
  misc_feature (323)..(323): n is a, c, g, or t
  modified_base (325)..(325): a, c, t, g, unknown or other
  misc_feature (325)..(325): n is a, c, g, or t
  modified_base (327)..(328): a, c, t, g, unknown or other
  misc_feature (327)..(328): n is a, c, g, or t
  modified_base (330)..(330): a, c, t, g, unknown or other
  misc_feature (330)..(330): n is a, c, g, or t
  modified_base (332)..(332): a, c, t, g, unknown or other
  misc_feature (332)..(332): n is a, c, g, or t
  modified_base (334)..(334): a, c, t, g, unknown or other
  misc_feature (334)..(334): n is a, c, g, or t
  modified_base (338)..(338): a, c, t, g, unknown or other
  misc_feature (338)..(338): n is a, c, g, or t
  modified_base (358)..(358): a, c, t, g, unknown or other
  misc_feature (358)..(358): n is a, c, g, or t
  modified_base (360)..(360): a, c, t, g, unknown or other
  misc_feature (360)..(360): n is a, c, g, or t
  modified_base (362)..(362): a, c, t, g, unknown or other
  misc_feature (362)..(362): n is a, c, g, or t
  modified_base (364)..(364): a, c, t, g, unknown or other
  misc_feature (364)..(364): n is a, c, g, or t
  modified_base (367)..(367): a, c, t, g, unknown or other
  misc_feature (367)..(367): n is a, c, g, or t
  modified_base (369)..(369): a, c, t, g, unknown or other
  misc_feature (369)..(369): n is a, c, g, or t
  modified_base (371)..(373): a, c, t, g, unknown or other
  misc_feature (371)..(373): n is a, c, g, or t
  modified_base (378)..(378): a, c, t, g, unknown or other
  misc_feature (378)..(378): n is a, c, g, or t
  modified_base (382)..(382): a, c, t, g, unknown or other
  misc_feature (382)..(382): n is a, c, g, or t
  modified_base (386)..(386): a, c, t, g, unknown or other
  misc_feature (386)..(386): n is a, c, g, or t
  modified_base (388)..(388): a, c, t, g, unknown or other
  misc_feature (388)..(388): n is a, c, g, or t
  modified_base (394)..(394): a, c, t, g, unknown or other
  misc_feature (394)..(394): n is a, c, g, or t
  modified_base (443)..(443): a, c, t, g, unknown or other
  misc_feature (443)..(443): n is a, c, g, or t
  modified_base (448)..(449): a, c, t, g, unknown or other
  misc_feature (448)..(449): n is a, c, g, or t
tcagcacgctacgtcacgaccggtgctcgatttagtagtgtagatttgggtttgggttgggccaagctcgctggagggcacggtcaccgtctccgtcagcctccgacccaaggcccatcggtcttccccgtgccacctcctccaagagcacctcctgggggccacagtcggccctgggctcgaccttggtccaaggtcctaccttccaccgtacgcgttgctgagtcgggcttgggcaaggcgcatacgnnnngcgnncagcnnngcntntntctgtnnnnanacgngngcncncnntnntntngnnncnntgnngcgtcncncngnngngngngtgnctcgtgacgacatactctcncntntngcncncnnncgcgntatntatntntatatnatatatatatactactcgtgtgtcgcgacgacgagtagagacgacgagncgtcnnc

SEQ ID NO: 205807 - DNA, 203 bp, Homo sapiens
  misc_feature: GYAE6OF02IAQ78.30.25.C03.1.454.CMB.1.raw
  modified_base (178)..(203): a, c, t, g, unknown or other
  misc_feature (178)..(203): n is a, c, g, or t
tcagcacgctacgtcacgaccggtgctcgatttagtagtgtagatttggggtttgggggggaagaggaagactgacggtccccccaggagttcaggtgctagggcacagcggccctgggcctgcctggtcaaggctacttccacgtagcgtgctgagcgggctggcaaggcgcatagnnnnnnnnnnnnnnnnnnnnnnnnnn

SEQ ID NO: 205808 - DNA, 169 bp, Homo sapiens
  misc_feature: GYAE6OF02FSTR0.30.25.C03.1.454.CMB.1.raw
  modified_base (155)..(169): a, c, t, g, unknown or other
  misc_feature (155)..(169): n is a, c, g, or t
tcagcacgctacgtcacgaccggtgctcgatttagtagtgtagatttgggtttgggggaagaggaagactgacggtcctgccacagcggccctgggctgcctggtcaaggactacttccacgtagcgtgctgagcgggctggcaaggcgcatagnnnnnnnnnnnnnnn

SEQ ID NO: 205809 - DNA, 174 bp, Homo sapiens; identical to SEQ ID NO: 205077
  misc_feature: GYAE6OF02F3Z44.30.25.C03.1.454.CMB.1.raw
  modified_base (173)..(174): a, c, t, g, unknown or other
  misc_feature (173)..(174): n is a, c, g, or t

SEQ ID NO: 205810 - DNA, 234 bp, Homo sapiens; identical to SEQ ID NO: 205242
  misc_feature: GYAE6OF02HNMM2.30.25.C03.1.454.CMB.1.raw
  modified_base (230)..(234): a, c, t, g, unknown or other
  misc_feature (230)..(234): n is a, c, g, or t

SEQ ID NO: 205811 - DNA, 234 bp, Homo sapiens
  misc_feature: GYAE6OF02H8R5Z.30.25.C03.1.454.CMB.1.raw
  modified_base (229)..(234): a, c, t, g, unknown or other
  misc_feature (229)..(234): n is a, c, g, or t
tcagcacgctacgtcacgaccggtgctcgatttagtagtgtagatttgggtttgggtgcccaagctgctggagggcacggtcacgtctcctcagcctccaccaagggcccatcggtcttccccctggcaccctcctccaagagcacctctgggggcacagcggccctgggctgcctggtcaaggactacttccacgtagcgtgctgagcgggctggcaaggcgcatagnnnnnn

SEQ ID NO: 205812 - DNA, 252 bp, Homo sapiens
  misc_feature: GYAE6OF02FIWI2.30.25.C03.1.454.CMB.1.raw
  modified_base (233)..(252): a, c, t, g, unknown or other
  misc_feature (233)..(252): n is a, c, g, or t
tcagcacgctacgtcacgaccggtgctcgatttagtagtgtagatttgggtttggggtgacccaagcctgctggagggccacggtcaccgtctcctcagcctccaccaagggcccatcggtcttccccctggcaccctcctccaagagcacctctggggcacagcggccctgggctgcctggtcaaggactacttccacgtagcgtgctgagcgggctggcaaggcgcatagnnnnnnnnnnnnnnnnnnnn

SEQ ID NO: 205813 - DNA, 157 bp, Homo sapiens; identical to SEQ ID NO: 205114
  misc_feature: GYAE6OF02HJK8B.30.25.C03.1.454.CMB.1.raw
  modified_base (155)..(157): a, c, t, g, unknown or other
  misc_feature (155)..(157): n is a, c, g, or t

SEQ ID NO: 205814 - DNA, 233 bp, Homo sapiens; identical to SEQ ID NO: 205189
  misc_feature: GYAE6OF02F93VR.30.25.C03.1.454.CMB.1.raw
  modified_base (230)..(233): a, c, t, g, unknown or other
  misc_feature (230)..(233): n is a, c, g, or t

SEQ ID NO: 205815 - DNA, 234 bp, Homo sapiens; identical to SEQ ID NO: 205242
  misc_feature: GYAE6OF02G1Y58.30.25.C03.1.454.CMB.1.raw
  modified_base (230)..(234): a, c, t, g, unknown or other
  misc_feature (230)..(234): n is a, c, g, or t

SEQ ID NO: 205816 - DNA, 176 bp, Homo sapiens; identical to SEQ ID NO: 205780
  misc_feature: GYAE6OF02IEX05.30.25.C03.1.454.CMB.1.raw
  modified_base (174)..(176): a, c, t, g, unknown or other
  misc_feature (174)..(176): n is a, c, g, or t

SEQ ID NO: 205817 - DNA, 286 bp, Homo sapiens
  misc_feature: GYAE6OF02H4543.30.25.C03.1.454.CMB.1.raw
  modified_base (229)..(229): a, c, t, g, unknown or other
  misc_feature (229)..(229): n is a, c, g, or t
  modified_base (237)..(286): a, c, t, g, unknown or other
  misc_feature (237)..(286): n is a, c, g, or t
tcagcacgctacgtcacgaccggtgctcgatttagtagtgtagatttgggtttgggtgcccaagctagctggagggcacggtcacgtctcctcagccctccaccaagggcccatcggttctttccccctggcaccctcctccaagagcacctctgggggcaacagcggccctgggctgcctggtcaaggactacttccacgtagcgtgctagagcgggctggcaaggcncagtacgnnnnnnnnnnnnnnnnnnnnnnnnnnnnnnnnnnnnnnnnnnnnnnnnnn

SEQ ID NO: 205818 - DNA, 156 bp, Homo sapiens; identical to SEQ ID NO: 205094
  misc_feature: GYAE6OF02F7MLU.30.25.C03.1.454.CMB.1.raw
  modified_base (155)..(156): a, c, t, g, unknown or other
  misc_feature (155)..(156): n is a, c, g, or t

SEQ ID NO: 205819 - DNA, 173 bp, Homo sapiens; identical to SEQ ID NO: 205084
  misc_feature: GYAE6OF02GKQ2G.30.25.C03.1.454.CMB.1.raw
  modified_base (173)..(173): a, c, t, g, unknown or other
  misc_feature (173)..(173): n is a, c, g, or t

SEQ ID NO: 205820 - DNA, 233 bp, Homo sapiens; identical to SEQ ID NO: 205207
  misc_feature: GYAE6OF02H679L.30.25.C03.1.454.CMB.1.raw
  modified_base (229)..(233): a, c, t, g, unknown or other
  misc_feature (229)..(233): n is a, c, g, or t

SEQ ID NO: 205821 - DNA, 175 bp, Homo sapiens; identical to SEQ ID NO: 205102
  misc_feature: GYAE6OF02HH0CQ.30.25.C03.1.454.CMB.1.raw
  modified_base (173)..(175): a, c, t, g, unknown or other
  misc_feature (173)..(175): n is a, c, g, or t

SEQ ID NO: 205822 - DNA, 231 bp, Homo sapiens
  misc_feature: GYAE6OF02HZED3.30.25.C03.1.454.CMB.1.raw
  modified_base (229)..(231): a, c, t, g, unknown or other
  misc_feature (229)..(231): n is a, c, g, or t
tcagcacgctacgtcacgaccggtgctcgatttagtagtgtagatttgggtttgggtgcccaagctgctggagggcacggtcaccgtctcctcagcctccaccaagggcccatcggtcttccccctggcaccctcctccaagagcacctctgggggcacagcggccctgggctgcctggtcaaggactacttccacgtagcgtgctgagcgggctggcaggcgcatagnnn

SEQ ID NO: 205823 - DNA, 173 bp, Homo sapiens; identical to SEQ ID NO: 205084
  misc_feature: GYAE6OF02JDO2J.30.25.C03.1.454.CMB.1.raw
  modified_base (173)..(173): a, c, t, g, unknown or other
  misc_feature (173)..(173): n is a, c, g, or t

SEQ ID NO: 205824 - DNA, 257 bp, Homo sapiens
  misc_feature: GYAE6OF02F7NOC.30.25.C03.1.454.CMB.1.raw
  modified_base (233)..(257): a, c, t, g, unknown or other
  misc_feature (233)..(257): n is a, c, g, or t
tcagcacgctacgtcacgaccggtgctcgatttagtagtgtagatttgggtttgggtggcccaagctgctggagggccacggtcaccgtctcctcacgcctccaccaagggcccatcggtcttccccctggcaccctcctccaagagcacctctgggggcacagcggccctgggctgcctggtcaaggactacttccacgtaggcgtgctgagcggctggcaaggcgcatagnnnnnnnnnnnnnnnnnnnnnnnnn

SEQ ID NO: 205825 - DNA, 160 bp, Homo sapiens; identical to SEQ ID NO: 205267
  misc_feature: GYAE6OF02J1DD4.30.25.C03.1.454.CMB.1.raw
  modified_base (155)..(160): a, c, t, g, unknown or other
  misc_feature (155)..(160): n is a, c, g, or t

SEQ ID NO: 205826 - DNA, 233 bp, Homo sapiens; identical to SEQ ID NO: 205189
  misc_feature: GYAE6OF02GO16O.30.25.C03.1.454.CMB.1.raw
  modified_base (230)..(233): a, c, t, g, unknown or other
  misc_feature (230)..(233): n is a, c, g, or t

SEQ ID NO: 205827 - DNA, 233 bp, Homo sapiens; identical to SEQ ID NO: 205189
  misc_feature: GYAE6OF02F6OQE.30.25.C03.1.454.CMB.1.raw
  modified_base (230)..(233): a, c, t, g, unknown or other
  misc_feature (230)..(233): n is a, c, g, or t

SEQ ID NO: 205828 - DNA, 232 bp, Homo sapiens; identical to SEQ ID NO: 205063
  misc_feature: GYAE6OF02I4WN5.30.25.C03.1.454.CMB.1.raw
  modified_base (230)..(232): a, c, t, g, unknown or other
  misc_feature (230)..(232): n is a, c, g, or t

SEQ ID NO: 205829 - DNA, 157 bp, Homo sapiens
  misc_feature: GYAE6OF02FJLSF.30.25.C03.1.454.CMB.1.raw
  modified_base (155)..(157): a, c, t, g, unknown or other
  misc_feature (155)..(157): n is a, c, g, or t
tcagcacgctacgtcacgaccggtgctcgatttagtagtgtagatttgggtttgggggaagaggaagactgacggtcctgccacagcggccctgggctgactggtcaaggactacttccacgtagcgtgctgagcgggctggcaaggcgcatagnnn

SEQ ID NO: 205830 - DNA, 154 bp, Homo sapiens; identical to SEQ ID NO: 205195
  misc_feature: GYAE6OF02F6587.30.25.C03.1.454.CMB.1.raw

SEQ ID NO: 205831 - DNA, 242 bp, Homo sapiens
  misc_feature: GYAE6OF02HZLJO.30.25.C03.1.454.CMB.1.raw
  modified_base (230)..(242): a, c, t, g, unknown or other
  misc_feature (230)..(242): n is a, c, g, or t
tcagcacgctacgtcacgaccggtgctcgatttagtagtgtagatttgggtttgggtgcccaagctgctggagggcacggtcaccgtctcctcagcctccaccaagggcccatcggtcttccccctggcaccctcctccaagagcacctctgggggcacagcggccctgggctgcctggtcaaggactacttccacgtagcgtgctgagcgggctggcaaggcgcatagnnnnnnnnnnnnn

SEQ ID NO: 205832 - DNA, 156 bp, Homo sapiens; identical to SEQ ID NO: 205460
  misc_feature: GYAE6OF02IPA31.30.25.C03.1.454.CMB.1.raw
  modified_base (156)..(156): a, c, t, g, unknown or other
  misc_feature (156)..(156): n is a, c, g, or t

SEQ ID NO: 205833 - DNA, 232 bp, Homo sapiens; identical to SEQ ID NO: 205063
  misc_feature: GYAE6OF02HK66X.30.25.C03.1.454.CMB.1.raw
  modified_base (230)..(232): a, c, t, g, unknown or other
  misc_feature (230)..(232): n is a, c, g, or t

SEQ ID NO: 205834 - DNA, 177 bp, Homo sapiens; identical to SEQ ID NO: 205232
  misc_feature: GYAE6OF02G81EG.30.25.C03.1.454.CMB.1.raw
  modified_base (173)..(177): a, c, t, g, unknown or other
  misc_feature (173)..(177): n is a, c, g, or t

SEQ ID NO: 205835 - DNA, 232 bp, Homo sapiens; identical to SEQ ID NO: 205063
  misc_feature: GYAE6OF02HPN7Y.30.25.C03.1.454.CMB.1.raw
  modified_base (230)..(232): a, c, t, g, unknown or other
  misc_feature (230)..(232): n is a, c, g, or t

SEQ ID NO: 205836 - DNA, 238 bp, Homo sapiens
  misc_feature: GYAE6OF02JDISN.30.25.C03.1.454.CMB.1.raw
  modified_base (230)..(238): a, c, t, g, unknown or other
  misc_feature (230)..(238): n is a, c, g, or t
tcagcacgctacgtcacgaccggtgctcgatttagtagtgtagatttgggtttgggtgcccaagctgctggagggcacggtcaccgtctcctcagcctccaccaagggcccatcggtcttccccctggcaccctcctccaagagcacctctgggggcacagcggccctgggctgcctggtcaaggactacttccacgtagcgtgctgagcgggctggcaaggcgcatagnnnnnnnnn

SEQ ID NO: 205837 - DNA, 233 bp, Homo sapiens; identical to SEQ ID NO: 205189
  misc_feature: GYAE6OF02GLQMF.30.25.C03.1.454.CMB.1.raw
  modified_base (230)..(233): a, c, t, g, unknown or other
  misc_feature (230)..(233): n is a, c, g, or t

SEQ ID NO: 205838 - DNA, 256 bp, Homo sapiens
  misc_feature: GYAE6OF02J3A3X.30.25.C03.1.454.CMB.1.raw
  modified_base (230)..(256): a, c, t, g, unknown or other
  misc_feature (230)..(256): n is a, c, g, or t
tcagcacgctacgtcacgaccggtgctcgatttagtagtgtagatttgggtttgggtgccaagctgctggagggcacggtcaccgtctcctcagcctccaccaagggcccatcggtcttccccctggcaccctcctccaagagcacctctgggggcacagcggccctggactgcctggtcaaggctacttccacgtagcgtgactgagcgggctggcaaggcgtcaatgnnnnnnnnnnnnnnnnnnnnnnnnnnn

SEQ ID NO: 205839 - DNA, 234 bp, Homo sapiens; identical to SEQ ID NO: 205242
  misc_feature: GYAE6OF02HPH0Z.30.25.C03.1.454.CMB.1.raw
  modified_base (230)..(234): a, c, t, g, unknown or other
  misc_feature (230)..(234): n is a, c, g, or t

SEQ ID NO: 205840 - DNA, 158 bp, Homo sapiens
  misc_feature: GYAE6OF02H34RO.30.25.C03.1.454.CMB.1.raw
  modified_base (156)..(158): a, c, t, g, unknown or other
  misc_feature (156)..(158): n is a, c, g, or t
tcagcacgctacgtcacgaccggtgctcgatttagtagtgtagatttgggtttggggggaagaggaagactgacggtcctgccacagcggccctgggctgcctggtcaaggactacttccacgtagcgtgctgagcgggctggcaaggcgcatagnnn

SEQ ID NO: 205841 - DNA, 154 bp, Homo sapiens; identical to SEQ ID NO: 205195
  misc_feature: GYAE6OF02HSIWP.30.25.C03.1.454.CMB.1.raw

SEQ ID NO: 205842 - DNA, 235 bp, Homo sapiens; identical to SEQ ID NO: 205318
  misc_feature: GYAE6OF02HIEMM.30.25.C03.1.454.CMB.1.raw
  modified_base (230)..(235): a, c, t, g, unknown or other
  misc_feature (230)..(235): n is a, c, g, or t

SEQ ID NO: 205843 - DNA, 177 bp, Homo sapiens; identical to SEQ ID NO: 205232
  misc_feature: GYAE6OF02H10MT.30.25.C03.1.454.CMB.1.raw
  modified_base (173)..(177): a, c, t, g, unknown or other
  misc_feature (173)..(177): n is a, c, g, or t

SEQ ID NO: 205844 - DNA, 176 bp, Homo sapiens; identical to SEQ ID NO: 205780
  misc_feature: GYAE6OF02ITI74.30.25.C03.1.454.CMB.1.raw
  modified_base (174)..(176): a, c, t, g, unknown or other
  misc_feature (174)..(176): n is a, c, g, or t

SEQ ID NO: 205845 - DNA, 213 bp, Homo sapiens
  misc_feature: GYAE6OF02G2C0P.30.25.C03.1.454.CMB.1.raw
  modified_base (160)..(213): a, c, t, g, unknown or other
  misc_feature (160)..(213): n is a, c, g, or t
tcagcacgctacgtcacgaccggtgctcgatttagtagtgtagatttgggtttgggggaaggaggaagactgacggtcctgccacagcgggccctgggctgcctggtcaaggactacttccacgtagcgtgctgagcgggctggcaaggcgtcataggcnnnnnnnnnnnnnnnnnnnnnnnnnnnnnnnnnnnnnnnnnnnnnnnnnnnnnn

SEQ ID NO: 205846 - DNA, 222 bp, Homo sapiens
  misc_feature: GYAE6OF02HHDCT.30.25.C03.1.454.CMB.1.raw
  modified_base (172)..(172): a, c, t, g, unknown or other
  misc_feature (172)..(172): n is a, c, g, or t
  modified_base (178)..(222): a, c, t, g, unknown or other
  misc_feature (178)..(222): n is a, c, g, or t
tcagcacgctacgtcacgaccggtgctcgatttagtagtgtagatttgggtttgggggggaagaggaagacctgacggtcccccaggagttcaggtgctgggcacgacgcggccctgggctgccctgggtcaaggctacttccacgtagcgtgctgagcggctggcaaggcncatagnnnnnnnnnnnnnnnnnnnnnnnnnnnnnnnnnnnnnnnnnnnnn

SEQ ID NO: 205847 - DNA, 156 bp, Homo sapiens; identical to SEQ ID NO: 205094
  misc_feature: GYAE6OF02FJ112.30.25.C03.1.454.CMB.1.raw
  modified_base (155)..(156): a, c, t, g, unknown or other
  misc_feature (155)..(156): n is a, c, g, or t

SEQ ID NO: 205848 - DNA, 236 bp, Homo sapiens; identical to SEQ ID NO: 205399
  misc_feature: GYAE6OF02G8577.30.25.C03.1.454.CMB.1.raw
  modified_base (230)..(236): a, c, t, g, unknown or other
  misc_feature (230)..(236): n is a, c, g, or t

SEQ ID NO: 205849 - DNA, 175 bp, Homo sapiens
  misc_feature: GYAE6OF02IK7DB.30.25.C03.1.454.CMB.1.raw
  modified_base (175)..(175): a, c, t, g, unknown or other
  misc_feature (175)..(175): n is a, c, g, or t
tcagcacgctacgtcacgaccggtgctcgatttagtagtgtagatttgggtttggggggaagaggaagactgacggtccccccaggagttcaggtgctgggcacagcggccctgggctgcctggtcaaggactacttccacgtagcgtgctgagcgggctggcaaggcgcatagn

SEQ ID NO: 205850 - DNA, 234 bp, Homo sapiens
  misc_feature: GYAE6OF02IDW60.30.25.C03.1.454.CMB.1.raw
  modified_base (231)..(234): a, c, t, g, unknown or other
  misc_feature (231)..(234): n is a, c, g, or t
tcagcacgctacgtcacgaccggtgctcgatttagtagtgtagatttgggtttgggtgcccaagctgctggagggcacggtcaccgtctcctcagcctccaccaagggcccatcggtcttcccccctggcaccctcctccaagagcacctctgggggcacagcggccctgggctgcctggtcaaggactacttccacgtagcgtgctgagcgggctggcaaggcgcatagnnnn

SEQ ID NO: 205851 - DNA, 334 bp, Homo sapiens
  misc_feature: GYAE6OF02JLZ27.30.25.C03.1.454.CMB.1.raw
  modified_base (232)..(234): a, c, t, g, unknown or other
  misc_feature (232)..(234): n is a, c, g, or t
  modified_base (236)..(238): a, c, t, g, unknown or other
  misc_feature (236)..(238): n is a, c, g, or t
  modified_base (240)..(240): a, c, t, g, unknown or other
  misc_feature (240)..(240): n is a, c, g, or t
  modified_base (243)..(243): a, c, t, g, unknown or other
  misc_feature (243)..(243): n is a, c, g, or t
  modified_base (246)..(246): a, c, t, g, unknown or other
  misc_feature (246)..(246): n is a, c, g, or t
  modified_base (248)..(248): a, c, t, g, unknown or other
  misc_feature (248)..(248): n is a, c, g, or t
  modified_base (250)..(251): a, c, t, g, unknown or other
  misc_feature (250)..(251): n is a, c, g, or t
  modified_base (253)..(253): a, c, t, g, unknown or other
  misc_feature (253)..(253): n is a, c, g, or t
  modified_base (257)..(334): a, c, t, g, unknown or other
  misc_feature (257)..(334): n is a, c, g, or t
tcagcacgctacgtcacgaccggtgctcgatttagtagtgtagatttgggtttgggtgcccgaagctgctggagggcacggtcaccggtctcctcagcctccaccaagggcccatcggtcttccccctggccaccctcctccaagagcacctctgggggcacagcggccctgggctgcctggtcaaggctacttccacgtagcgtgctgagcgggctggcaaggcgcatagnnntnnngntgncantncnngncacnnnnnnnnnnnnnnnnnnnnnnnnnnnnnnnnnnnnnnnnnnnnnnnnnnnnnnnnnnnnnnnnnnnnnnnnnnnnnn

SEQ ID NO: 205852 - DNA, 173 bp, Homo sapiens; identical to SEQ ID NO: 205471
  misc_feature: GYAE6OF02GXFCU.30.25.C03.1.454.CMB.1.raw

SEQ ID NO: 205853 - DNA, 233 bp, Homo sapiens; identical to SEQ ID NO: 205189
  misc_feature: GYAE6OF02GIHE0.30.25.C03.1.454.CMB.1.raw
  modified_base (230)..(233): a, c, t, g, unknown or other
  misc_feature (230)..(233): n is a, c, g, or t

SEQ ID NO: 205854 - DNA, 236 bp, Homo sapiens; identical to SEQ ID NO: 205399
  misc_feature: GYAE6OF02HBXOZ.30.25.C03.1.454.CMB.1.raw
  modified_base (230)..(236): a, c, t, g, unknown or other
  misc_feature (230)..(236): n is a, c, g, or t

SEQ ID NO: 205855 - DNA, 231 bp, Homo sapiens; identical to SEQ ID NO: 205129
  misc_feature: GYAE6OF02F6TL1.30.25.C03.1.454.CMB.1.raw
  modified_base (229)..(231): a, c, t, g, unknown or other
  misc_feature (229)..(231): n is a, c, g, or t

SEQ ID NO: 205856 - DNA, 237 bp, Homo sapiens; identical to SEQ ID NO: 205230
  misc_feature: GYAE6OF02IU2UR.30.25.C03.1.454.CMB.1.raw
  modified_base (230)..(237): a, c, t, g, unknown or other
  misc_feature (230)..(237): n is a, c, g, or t

SEQ ID NO: 205857 - DNA, 236 bp, Homo sapiens
  misc_feature: GYAE6OF02GGLY3.30.25.C03.1.454.CMB.1.raw
  modified_base (229)..(236): a, c, t, g, unknown or other
  misc_feature (229)..(236): n is a, c, g, or t
tcagcacgctacgtcacgaccggtgctcgatttagtagtgtagatttgggtttgggtgcccaagctgctggagggcacggtcaccgtctcctcagcctccaccaagggcccatcggtcttccccctggcaccctcctccaagagcacctctggggcacagcggccctgggctgcctggtcaaggctacttccacgtagcgtgctgagcgggctggcaaggcgcataggnnnnnnnn

SEQ ID NO: 205858 - DNA, 234 bp, Homo sapiens; identical to SEQ ID NO: 205242
  misc_feature: GYAE6OF02HHN5M.30.25.C03.1.454.CMB.1.raw
  modified_base (230)..(234): a, c, t, g, unknown or other
  misc_feature (230)..(234): n is a, c, g, or t

SEQ ID NO: 205859 - DNA, 186 bp, Homo sapiens
  misc_feature: GYAE6OF02FJ5GY.30.25.C03.1.454.CMB.1.raw
  modified_base (174)..(186): a, c, t, g, unknown or other
  misc_feature (174)..(186): n is a, c, g, or t
tcagcacgctacgtcacgaccggtgctcgatttagtagtgtagatttggggtttgggggaagaggaagactgacggtcccccaggagttcaggtgctgggcacagcggccctgggctgcctggtcaaggactacttccacgtagcgtgctgagcgggctggcaaggcgcatagnnnnnnnnnnnnn

SEQ ID NO: 205860 - DNA, 254 bp, Homo sapiens
  misc_feature: GYAE6OF02ISSF8.30.25.C03.1.454.CMB.1.raw
  modified_base (189)..(192): a, c, t, g, unknown or other
  misc_feature (189)..(192): n is a, c, g, or t
  modified_base (194)..(254): a, c, t, g, unknown or other
  misc_feature (194)..(254): n is a, c, g, or t
tcagcacgctacgtcacgaccggtgctcgatttagtagtgtagatttggggtttggggggaagggaggaaggacgtgacgggtcccccccagggagttcgaggtgctgggcacgagcggccctggggcctgcctggtcaaggacgtacttccacgtagcgtgctgagccgggctggcaaggcgcatagnnnncnnnnnnnnnnnnnnnnnnnnnnnnnnnnnnnnnnnnnnnnnnnnnnnnnnnnnnnnnnnnn

SEQ ID NO: 205861 - DNA, 178 bp, Homo sapiens; identical to SEQ ID NO: 205093
  misc_feature: GYAE6OF02HGRLU.30.25.C03.1.454.CMB.1.raw
  modified_base (173)..(178): a, c, t, g, unknown or other
  misc_feature (173)..(178): n is a, c, g, or t

SEQ ID NO: 205862 - DNA, 269 bp, Homo sapiens
  misc_feature: GYAE6OF02FH1R5.30.25.C03.1.454.CMB.1.raw
  modified_base (230)..(269): a, c, t, g, unknown or other
  misc_feature (230)..(269): n is a, c, g, or t
tcagcacgctacgtcacgaccggtgctcgatttagtagtgtagatttgggtttgggtgcccaagcgtgctggagggcacggtcaccgtctcctcagcctccaccaagggcccatcggtcttcccctggcaccctcctccaagagcacctctggggcacagcggccctgggctgcctggtcaaggactacgttccacgtagcgtgctgagcgggctggcaaggcgcatagnnnnnnnnnnnnnnnnnnnnnnnnnnnnnnnnnnnnnnnn

SEQ ID NO: 205863 - DNA, 233 bp, Homo sapiens
  misc_feature: GYAE6OF02INM32.30.25.C03.1.454.CMB.1.raw
  modified_base (231)..(233): a, c, t, g, unknown or other
  misc_feature (231)..(233): n is a, c, g, or t
tcagcacgctacgtcacgaccggtgctcgatttagtagtgtagatttgggtttgggtgcccaagctgctggagggcacggtcaccgtctcctcagcctccaccaagggcccatcggtcttcccccctggcaccctcctccaagagcacctctgggggcacagcggccctgggctacctggtcaaggactacttccacgtagcgtgctgagcgggctggcaaggcgcatagnnn

SEQ ID NO: 205864 - DNA, 232 bp, Homo sapiens; identical to SEQ ID NO: 205063
  misc_feature: GYAE6OF02HWC65.30.25.C03.1.454.CMB.1.raw
  modified_base (230)..(232): a, c, t, g, unknown or other
  misc_feature (230)..(232): n is a, c, g, or t

SEQ ID NO: 205865 - DNA, 235 bp, Homo sapiens; identical to SEQ ID NO: 205318
  misc_feature: GYAE6OF02HC5ZG.30.25.C03.1.454.CMB.1.raw
  modified_base (230)..(235): a, c, t, g, unknown or other
  misc_feature (230)..(235): n is a, c, g, or t

SEQ ID NO: 205866 - DNA, 237 bp, Homo sapiens
  misc_feature: GYAE6OF02IKOIB.30.25.C03.1.454.CMB.1.raw
  modified_base (231)..(237): a, c, t, g, unknown or other
  misc_feature (231)..(237): n is a, c, g, or t
tcagcacgctacgtcacgaccggtgctcgatttagtagtgtagatttgggtttgggtgcccaagctgctggagggcacggtcaccgtctcctcagcctccaccaagggcccatcggtcttcccccctggcaccctcctccaagagcacctctgggggcacagcggccctgggctgcctggtcaaggactacttccacgtagcgtgctgagcgggctggcaaggcgcatagnnnnnnn

SEQ ID NO: 205867 - DNA, 290 bp, Homo sapiens
  misc_feature: GYAE6OF02G7S9F.30.25.C03.1.454.CMB.1.raw
  modified_base (245)..(290): a, c, t, g, unknown or other
  misc_feature (245)..(290): n is a, c, g, or t
tcagcacgctacgtcacgaccggtgctcgatttagtagtgtagatttgggtttgggggtgcccaagcctgctggagggcacgggtcaccgttctccttcagcctccaccaagggcccatcggtcttccccctggcaccctcctccaagagtcacctctggggctacagcggccctgggtctggcctggtcaaggctacgttccacgtagcgtgcgtgagtcggggctggcgaaggcgcagtagcnnnnnnnnnnnnnnnnnnnnnnnnnnnnnnnnnnnnnnnnnnnnnn

SEQ ID NO: 205868 - DNA, 233 bp, Homo sapiens; identical to SEQ ID NO: 205189
  misc_feature: GYAE6OF02GF8YU.30.25.C03.1.454.CMB.1.raw
  modified_base (230)..(233): a, c, t, g, unknown or other
  misc_feature (230)..(233): n is a, c, g, or t

SEQ ID NO: 205869 - DNA, 234 bp, Homo sapiens; identical to SEQ ID NO: 205242
  misc_feature: GYAE6OF02IICH0.30.25.C03.1.454.CMB.1.raw
  modified_base (230)..(234): a, c, t, g, unknown or other
  misc_feature (230)..(234): n is a, c, g, or t

SEQ ID NO: 205870 - DNA, 216 bp, Homo sapiens
  misc_feature: GYAE6OF02HMBG2.30.25.C03.1.454.CMB.1.raw
  modified_base (182)..(216): a, c, t, g, unknown or other
  misc_feature (182)..(216): n is a, c, g, or t
tcagcacgctacgtcacgaccggtgctcgatttagtagtgtagatttgggtttgggggggaagggaggaagactggacggtccccccaggagttcagggtgctgggcacagcggcccgtgggctgcctggtcaaggactacttccacgtagcgtgctgagcgggctgggcaaggcgcatagnnnnnnnnnnnnnnnnnnnnnnnnnnnnnnnnnnn

SEQ ID NO: 205871 - DNA, 237 bp, Homo sapiens; identical to SEQ ID NO: 205230
  misc_feature: GYAE6OF02FW3TW.30.25.C03.1.454.CMB.1.raw
  modified_base (230)..(237): a, c, t, g, unknown or other
  misc_feature (230)..(237): n is a, c, g, or t

SEQ ID NO: 205872 - DNA, 233 bp, Homo sapiens; identical to SEQ ID NO: 205189
  misc_feature: GYAE6OF02GITRQ.30.25.C03.1.454.CMB.1.raw
  modified_base (230)..(233): a, c, t, g, unknown or other
  misc_feature (230)..(233): n is a, c, g, or t

SEQ ID NO: 205873 - DNA, 232 bp, Homo sapiens; identical to SEQ ID NO: 205063
  misc_feature: GYAE6OF02F6ZI1.30.25.C03.1.454.CMB.1.raw
  modified_base (230)..(232): a, c, t, g, unknown or other
  misc_feature (230)..(232): n is a, c, g, or t

SEQ ID NO: 205874 - DNA, 183 bp, Homo sapiens
  misc_feature: GYAE6OF02GQ7L0.30.25.C03.1.454.CMB.1.raw
  modified_base (173)..(183): a, c, t, g, unknown or other
  misc_feature (173)..(183): n is a, c, g, or t
tcagcacgctacgtcacgaccggtgctcgatttagtagtgtagatttgggtttgggggaagaggaagactgacggtccccccaggagttcaggtgctgggcacagcggccctgggctgcctggtcaaggctacttccacgtagcgtgctgagcgggctggcaaggcgcatagnnnnnnnnnnn

SEQ ID NO: 205875 - DNA, 180 bp, Homo sapiens
  misc_feature: GYAE6OF02GN08A.30.25.C03.1.454.CMB.1.raw
  modified_base (174)..(180): a, c, t, g, unknown or other
  misc_feature (174)..(180): n is a, c, g, or t
tcagcacgctacgtcacgaccggtgctcgatttagtagtgtagatttgggtttggggggaagaggaagactgacggtcccccaggagttcaggtgctgggcacagcggccctgggctgcctggtcaaggactacttccacgtagcgtgctgagcgggctggcaaggcgcatagnnnnnnn

SEQ ID NO: 205876 - DNA, 233 bp, Homo sapiens; identical to SEQ ID NO: 205189
  misc_feature: GYAE6OF02FOYXM.30.25.C03.1.454.CMB.1.raw
  modified_base (230)..(233): a, c, t, g, unknown or other
  misc_feature (230)..(233): n is a, c, g, or t

SEQ ID NO: 205877 - DNA, 163 bp, Homo sapiens
  misc_feature: GYAE6OF02F4LK7.30.25.C03.1.454.CMB.1.raw
  modified_base (156)..(163): a, c, t, g, unknown or other
  misc_feature (156)..(163): n is a, c, g, or t
tcagcacgctacgtcacgaccggtgctcgatttagtagtgtagatttgggtttgggggaagaggaagactgacggtcctgccacagcggccctgggctgcctggtcaaggacctacttccacgtagcgtgctgagcgggctggcaaggcgcatagnnnnnnnn

SEQ ID NO: 205878 - DNA, 234 bp, Homo sapiens; identical to SEQ ID NO: 205242
  misc_feature: GYAE6OF02HK4HQ.30.25.C03.1.454.CMB.1.raw
  modified_base (230)..(234): a, c, t, g, unknown or other
  misc_feature (230)..(234): n is a, c, g, or t

SEQ ID NO: 205879 - DNA, 233 bp, Homo sapiens; identical to SEQ ID NO: 205189
  misc_feature: GYAE6OF02HFQ27.30.25.C03.1.454.CMB.1.raw
  modified_base (230)..(233): a, c, t, g, unknown or other
  misc_feature (230)..(233): n is a, c, g, or t

SEQ ID NO: 205880 - DNA, 180 bp, Homo sapiens
  misc_feature: GYAE6OF02FJ9V5.30.25.C03.1.454.CMB.1.raw
  modified_base (173)..(180): a, c, t, g, unknown or other
  misc_feature (173)..(180): n is a, c, g, or t
tcagcacgctacgtcacgaccggtgctcgatttagtagtgtagatttgggtttgggggaagaggaagactgacggtcccccaggagttcaggtgctgggcacagcggccctgggctgcctggtcaaggactacttccacgtagcgtgctgagcgggctggcaaggcgcatagnnnnnnnn

SEQ ID NO: 205881 - DNA, 178 bp, Homo sapiens; identical to SEQ ID NO: 205093
  misc_feature: GYAE6OF02GESG3.30.25.C03.1.454.CMB.1.raw
  modified_base (173)..(178): a, c, t, g, unknown or other
  misc_feature (173)..(178): n is a, c, g, or t

SEQ ID NO: 205882 - DNA, 232 bp, Homo sapiens; identical to SEQ ID NO: 205063
  misc_feature: GYAE6OF02FT633.30.25.C03.1.454.CMB.1.raw
  modified_base (230)..(232): a, c, t, g, unknown or other
  misc_feature (230)..(232): n is a, c, g, or t

SEQ ID NO: 205883 - DNA, 236 bp, Homo sapiens; identical to SEQ ID NO: 205399
  misc_feature: GYAE6OF02IROI6.30.25.C03.1.454.CMB.1.raw
  modified_base (230)..(236): a, c, t, g, unknown or other
  misc_feature (230)..(236): n is a, c, g, or t

SEQ ID NO: 205884 - DNA, 237 bp, Homo sapiens
  misc_feature: GYAE6OF02HQBL4.30.25.C03.1.454.CMB.1.raw
  modified_base (229)..(237): a, c, t, g, unknown or other
  misc_feature (229)..(237): n is a, c, g, or t
tcagcacgctacgtcacgaccggtgctcgatttagtagtgtagatttgggtttgggtgcccaagctgctggagggcacggtcaccgtctcctcagcctccaccaagggcccatcggtcttcccctggcaccctcctccaagagcacctctgggggcacagcggccctgggctgcctggtcaaggactacttccacgtagcgtgctgagcgggctggcaaggcgcatagnnnnnnnnn

SEQ ID NO: 205885 - DNA, 176 bp, Homo sapiens; identical to SEQ ID NO: 205780
  misc_feature: GYAE6OF02F3JVP.30.25.C03.1.454.CMB.1.raw
  modified_base (174)..(176): a, c, t, g, unknown or other
  misc_feature (174)..(176): n is a, c, g, or t

SEQ ID NO: 205886 - DNA, 234 bp, Homo sapiens; identical to SEQ ID NO: 205242
  misc_feature: GYAE6OF02GKANG.30.25.C03.1.454.CMB.1.raw
  modified_base (230)..(234): a, c, t, g, unknown or other
  misc_feature (230)..(234): n is a, c, g, or t

SEQ ID NO: 205887 - DNA, 236 bp, Homo sapiens
  misc_feature: GYAE6OF02GNOYZ.30.25.C03.1.454.CMB.1.raw
  modified_base (229)..(236): a, c, t, g, unknown or other
  misc_feature (229)..(236): n is a, c, g, or t
tcagcacgctacgtcacgaccggtgctcgatttagtagtgtagatttgggtttgggtgcccaagctgctggagggcacggtcaccgtctcctcagcctccaccaagggcccatcggtcttccccctggcaccctcctccaagagtacctctggggcacagcggccctgggctgcctggtcaaggactacttccacgtagcgtgctgagcgggctggcaaggcgcatagnnnnnnnn

SEQ ID NO: 205888 - DNA, 234 bp, Homo sapiens; identical to SEQ ID NO: 205242
  misc_feature: GYAE6OF02HC4Z0.30.25.C03.1.454.CMB.1.raw
  modified_base (230)..(234): a, c, t, g, unknown or other
  misc_feature (230)..(234): n is a, c, g, or t

SEQ ID NO: 205889 - DNA, 161 bp, Homo sapiens
  misc_feature: GYAE6OF02HLLZT.30.25.C03.1.454.CMB.1.raw
  modified_base (156)..(161): a, c, t, g, unknown or other
  misc_feature (156)..(161): n is a, c, g, or t
tcagcacgctacgtcacgaccggtgctcgatttagtagtgtagatttgggtttggggggaagaggaagactgacggtcctgccacagcggccctgggctgcctggtcaaggactacttccacgtagcgtgctgagcgggctggcaaggcgcatagnnnnnn

SEQ ID NO: 205890 - DNA, 225 bp, Homo sapiens
  misc_feature: GYAE6OF02GN1ZX.30.25.C03.1.454.CMB.1.raw
  modified_base (177)..(225): a, c, t, g, unknown or other
  misc_feature (177)..(225): n is a, c, g, or t
tcagcacgctacgtcacgaccggtgctcgatttagtagtgtagatttgggtttgggggggaaggaggaagactgacggtccccccaggagttcaggtgctgggcacagcggccctgggctgcctggtcaaggactacttccacgtagcgtgctgagcgggctggcaaggcgcatagnnnnnnnnnnnnnnnnnnnnnnnnnnnnnnnnnnnnnnnnnnnnnnnnn

SEQ ID NO: 205891 - DNA, 185 bp, Homo sapiens
  misc_feature: GYAE6OF02GF7BQ.30.25.C03.1.454.CMB.1.raw
  modified_base (175)..(185): a, c, t, g, unknown or other
  misc_feature (175)..(185): n is a, c, g, or t
tcagcacgctacgtcacgaccggtgctcgatttagtagtgtagatttgggtttggggggaagaggaagactgacggtccccccaggagttcaggtgctgggcacagcggccctgggctgcctggtcaaggactacttccacgtagcgtgctgagcgggctggcaaggcgcatagnnnnnnnnnnn

SEQ ID NO: 205892 - DNA, 156 bp, Homo sapiens; identical to SEQ ID NO: 205094
  misc_feature: GYAE6OF02HXKYO.30.25.C03.1.454.CMB.1.raw
  modified_base (155)..(156): a, c, t, g, unknown or other
  misc_feature (155)..(156): n is a, c, g, or t

SEQ ID NO: 205893 - DNA, 189 bp, Homo sapiens
  misc_feature: GYAE6OF02GD94G.30.25.C03.1.454.CMB.1.raw
  modified_base (172)..(189): a, c, t, g, unknown or other
  misc_feature (172)..(189): n is a, c, g, or t
tcagcacgctacgtcacgaccggtgctcgatttagtagtgtagatttgggtttgggggaagaggaagactgacggtcccccaggagttcaggtgctgggcacagcggccctggctgcctggtcaaggactacttccacgtagcgtgctgagcgggctggcaaggcgcatagnnnnnnnnnnnnnnnnnn

SEQ ID NO: 205894 - DNA, 175 bp, Homo sapiens; identical to SEQ ID NO: 205849
  misc_feature: GYAE6OF02IDWW5.30.25.C03.1.454.CMB.1.raw
  modified_base (175)..(175): a, c, t, g, unknown or other
  misc_feature (175)..(175): n is a, c, g, or t

SEQ ID NO: 205895 - DNA, 235 bp, Homo sapiens; identical to SEQ ID NO: 205318
  misc_feature: GYAE6OF02IWRA4.30.25.C03.1.454.CMB.1.raw
  modified_base (230)..(235): a, c, t, g, unknown or other
  misc_feature (230)..(235): n is a, c, g, or t

SEQ ID NO: 205896 - DNA, 254 bp, Homo sapiens
  misc_feature: GYAE6OF02IHP6O.30.25.C03.1.454.CMB.1.raw
  modified_base (229)..(254): a, c, t, g, unknown or other
  misc_feature (229)..(254): n is a, c, g, or t
tcagcacgctacgtcacgaccggtgctcgatttagtagtgtagatttgggtttgggtgcccaagctgctggagggcacggtcaccgtctcctcagcctccaccaagggcccatcggtcttccccctggcaccctcctccaagagcacctctggggcacagcggccctgggctgcctggtcaaggactacttccacgtagcgtgctgagcgggctggcaaggcgcatagnnnnnnnnnnnnnnnnnnnnnnnnnn

SEQ ID NO: 205897 - DNA, 254 bp, Homo sapiens
  misc_feature: GYAE6OF02F00S0.30.25.C03.1.454.CMB.1.raw
  modified_base (232)..(254): a, c, t, g, unknown or other
  misc_feature (232)..(254): n is a, c, g, or t
tcagcacgctacgtcacgaccggtgctcgatttagtagtgtagatttgggtttgggtgcccaagctgctggagggcacggtcaccgtctcctcagcctccacccaagggcccatccggtcttcccccctggcaccctcctccaagagcacctctgggggcacagcggccctgggctgcctggtcaaggctacttccacgtagcgtgctgagcgggctggcaaggcgcatagnnnnnnnnnnnnnnnnnnnnnnn

SEQ ID NO: 205898 - DNA, 232 bp, Homo sapiens; identical to SEQ ID NO: 205085
  misc_feature: GYAE6OF02FYRFT.30.25.C03.1.454.CMB.1.raw
  modified_base (229)..(232): a, c, t, g, unknown or other
  misc_feature (229)..(232): n is a, c, g, or t

SEQ ID NO: 205899 - DNA, 242 bp, Homo sapiens
  misc_feature: GYAE6OF02H2YCW.30.25.C03.1.454.CMB.1.raw
  modified_base (220)..(220): a, c, t, g, unknown or other
  misc_feature (220)..(220): n is a, c, g, or t
  modified_base (226)..(242): a, c, t, g, unknown or other
  misc_feature (226)..(242): n is a, c, g, or t
tcagcacgctacgtcacgaccggtgctcgatttagtagtgtagatttgggtttgggtgcccaagctgctggagggcacggtcaccgtctcctcagcctccaccaagggcccatcggtcttcccctggcaccctctccaagagcactctggggcacagcggccctgggctgcctggtcaaggactacttccacgtagcgtgctgagcgggctggcaaggcncatagnnnnnnnnnnnnnnnnn

SEQ ID NO: 205900 - DNA, 234 bp, Homo sapiens; identical to SEQ ID NO: 205764
  misc_feature: GYAE6OF02HR600.30.25.C03.1.454.CMB.1.raw
  modified_base (229)..(234): a, c, t, g, unknown or other
  misc_feature (229)..(234): n is a, c, g, or t

SEQ ID NO: 205901 - DNA, 177 bp, Homo sapiens; identical to SEQ ID NO: 205232
  misc_feature: GYAE6OF02HM5XQ.30.25.C03.1.454.CMB.1.raw
  modified_base (173)..(177): a, c, t, g, unknown or other
  misc_feature (173)..(177): n is a, c, g, or t

SEQ ID NO: 205902 - DNA, 180 bp, Homo sapiens
  misc_feature: GYAE6OF02I82T8.30.25.C03.1.454.CMB.1.raw
  modified_base (174)..(180): a, c, t, g, unknown or other
  misc_feature (174)..(180): n is a, c, g, or t
tcagcacgctacgtcacgaccggtgctcgatttagtagtgtagatttgggtttgggggaagaggaagactgacggtccccccaggagttcaggtgctgggcacagcggccctgggctgcctggtcaaggactacttccacgtagcgtgctgagcgggctggcaaggcgcatagnnnnnnn

SEQ ID NO: 205903 - DNA, 235 bp, Homo sapiens; identical to SEQ ID NO: 205318
  misc_feature: GYAE6OF02G46LX.30.25.C03.1.454.CMB.1.raw
  modified_base (230)..(235): a, c, t, g, unknown or other
  misc_feature (230)..(235): n is a, c, g, or t

SEQ ID NO: 205904 - DNA, 285 bp, Homo sapiens
  misc_feature: GYAE6OF02JFABU.30.25.C03.1.454.CMB.1.raw
  modified_base (236)..(285): a, c, t, g, unknown or other
  misc_feature (236)..(285): n is a, c, g, or t
tcagcacgctacgtcacgaccggtgctcgatttagtagtgtagatttgggtttgggtgcccaagctggctggagggcacggtcaccgtctcctcagcctccaccaagggcccatcggtcttccccctggcaccctcctccaagagcacctcctgggggcacgagcggccctgggctggcctggtcaaggactaacttccacgtagcgtgactgagcgggctggcaaggcgcatagnnnnnnnnnnnnnnnnnnnnnnnnnnnnnnnnnnnnnnnnnnnnnnnnnn

SEQ ID NO: 205905 - DNA, 178 bp, Homo sapiens; identical to SEQ ID NO: 205550
  misc_feature: GYAE6OF02GW95O.30.25.C03.1.454.CMB.1.raw
  modified_base (174)..(178): a, c, t, g, unknown or other
  misc_feature (174)..(178): n is a, c, g, or t

SEQ ID NO: 205906 - DNA, 240 bp, Homo sapiens
  misc_feature: GYAE6OF02HB12S.30.25.C03.1.454.CMB.1.raw
  modified_base (229)..(240): a, c, t, g, unknown or other
  misc_feature (229)..(240): n is a, c, g, or t
tcagcacgctacgtcacgaccggtgctcgatttagtagtgtagatttgggtttgggtgcccaagctgctggagggcacggtcaccgtctcctcagcctccaccaagggcccatcggtcttccccctggcaccctcctccaagagcacctctgggggcacagcggccctgggctgcctggtcaaggctacttccacgtagcgtgctgagcgggctggcaaggcgcatagnnnnnnnnnnnn

SEQ ID NO: 205907 - DNA, 238 bp, Homo sapiens; identical to SEQ ID NO: 205836
  misc_feature: GYAE6OF02HWLK7.30.25.C03.1.454.CMB.1.raw
  modified_base (230)..(238): a, c, t, g, unknown or other
  misc_feature (230)..(238): n is a, c, g, or t

SEQ ID NO: 205908 - DNA, 178 bp, Homo sapiens
  misc_feature: GYAE6OF02INDBM.30.25.C03.1.454.CMB.1.raw
  modified_base (175)..(178): a, c, t, g, unknown or other
  misc_feature (175)..(178): n is a, c, g, or t
tcagcacgctacgtcacgaccggtgctcgatttagtagtgtagatttgggtttggggggaagaggaagactgacggtccccccaggagttcaggtgctgggcacagcggccctgggctgcctggtcaaggactacttccacgtagcgtgctgagcgggctggcaaggcgcatagnnnn

SEQ ID NO: 205909 - DNA, 235 bp, Homo sapiens
  misc_feature: GYAE6OF02GEW9L.30.25.C03.1.454.CMB.1.raw
  modified_base (229)..(235): a, c, t, g, unknown or other
  misc_feature (229)..(235): n is a, c, g, or t
tcagcacgctacgtcacgaccggtgctcgatttagtagtgtagatttgggtttgggtgcccaagctgctggagggcacggtcaccgtctcctcagcctccaccaagggcccatcggtcttccccctggcaccctcctccaagagcacctctgggggcacagcggccctgggctgcctggtcaaggctacttccacgtagcgtgctgagcgggctggcaaggcgcatagnnnnnnn

SEQ ID NO: 205910 - DNA, 234 bp, Homo sapiens; identical to SEQ ID NO: 205242
  misc_feature: GYAE6OF02I6ITS.30.25.C03.1.454.CMB.1.raw
  modified_base (230)..(234): a, c, t, g, unknown or other
  misc_feature (230)..(234): n is a, c, g, or t

SEQ ID NO: 205911 - DNA, 231 bp, Homo sapiens; identical to SEQ ID NO: 205120
  misc_feature: GYAE6OF02HRB5L.30.25.C03.1.454.CMB.1.raw
  modified_base (230)..(231): a, c, t, g, unknown or other
  misc_feature (230)..(231): n is a, c, g, or t

SEQ ID NO: 205912 - DNA, 184 bp, Homo sapiens
  misc_feature: GYAE6OF02G1HKT.30.25.C03.1.454.CMB.1.raw
  modified_base (156)..(184): a, c, t, g, unknown or other
  misc_feature (156)..(184): n is a, c, g, or t
tcagcacgctacgtcacgaccggtgctcgatttagtagtgtagatttgggtttggggggaagaggaagactgacggtcctgccacagcggccctgggctgcctggtcaaggactacttccacgtagcgtgctgagcgggctggcaaggcgcatagnnnnnnnnnnnnnnnnnnnnnnnnnnnnn

SEQ ID NO: 205913 - DNA, 161 bp, Homo sapiens; identical to SEQ ID NO: 205889
  misc_feature: GYAE6OF02IFXZD.30.25.C03.1.454.CMB.1.raw
  modified_base (156)..(161): a, c, t, g, unknown or other
  misc_feature (156)..(161): n is a, c, g, or t

SEQ ID NO: 205914 - DNA, 177 bp, Homo sapiens
  misc_feature: GYAE6OF02FNYQM.30.25.C03.1.454.CMB.1.raw
  modified_base (174)..(177): a, c, t, g, unknown or other
  misc_feature (174)..(177): n is a, c, g, or t
tcagcacgctacgtcacgaccggtgctcgatttagtagtgtagatttgggtttgggggaagaggaagactgacggtccccccaggagttcaggtgctgggcacagcggccctgggctgcctggtcaaggactacttccacgtagcgtgctgagcgggctggcaaggcgcatagnnnn

SEQ ID NO: 205915 - DNA, 233 bp, Homo sapiens; identical to SEQ ID NO: 205189
  misc_feature: GYAE6OF02HF8PX.30.25.C03.1.454.CMB.1.raw
  modified_base (230)..(233): a, c, t, g, unknown or other
  misc_feature (230)..(233): n is a, c, g, or t

SEQ ID NO: 205916 - DNA, 175 bp, Homo sapiens; identical to SEQ ID NO: 205477
  misc_feature: GYAE6OF02GEGES.30.25.C03.1.454.CMB.1.raw
  modified_base (174)..(175): a, c, t, g, unknown or other
  misc_feature (174)..(175): n is a, c, g, or t

SEQ ID NO: 205917 - DNA, 231 bp, Homo sapiens; identical to SEQ ID NO: 205120
  misc_feature: GYAE6OF02FQJ3L.30.25.C03.1.454.CMB.1.raw
  modified_base (230)..(231): a, c, t, g, unknown or other
  misc_feature (230)..(231): n is a, c, g, or t

SEQ ID NO: 205918 - DNA, 234 bp, Homo sapiens; identical to SEQ ID NO: 205242
  misc_feature: GYAE6OF02FVWS5.30.25.C03.1.454.CMB.1.raw
  modified_base (230)..(234): a, c, t, g, unknown or other
  misc_feature (230)..(234): n is a, c, g, or t

SEQ ID NO: 205919 - DNA, 254 bp, Homo sapiens
  misc_feature: GYAE6OF02FLH1T.30.25.C03.1.454.CMB.1.raw
  modified_base (236)..(254): a, c, t, g, unknown or other
  misc_feature (236)..(254): n is a, c, g, or t
tcagcacgctacgtcacgaccggtgctcgatttagtagtgtagatttgggtttgggtgcccaagctgctggagggcacggtcaccgtctccctcagcctccacccaaggggccccatcggtcttcccccctggcaccctcctccaagagcacctctgggggcacagcggccctgggcctgcctggtcaaggactacttccacgtagcgtgctgagcgggctggcaaggcgcatagnnnnnnnnnnnnnnnnnnn

SEQ ID NO: 205920 - DNA, 179 bp, Homo sapiens
  misc_feature: GYAE6OF02JRI9L.30.25.C03.1.454.CMB.1.raw
  modified_base (177)..(179): a, c, t, g, unknown or other
  misc_feature (177)..(179): n is a, c, g, or t
tcagcacgctacgtcacgaccggtgctcgatttagtagtgtagatttgggtttgggggtaaggaggaagactgacggtcccccacggagttcaggtgctgggcacagcggccctgggctggcctggtcaaggactacttccacgtagcgtgctgagcgggctggcaaggcgcatagnnn

SEQ ID NO: 205921 - DNA, 179 bp, Homo sapiens
  misc_feature: GYAE6OF02IAV3S.30.25.C03.1.454.CMB.1.raw
  modified_base (174)..(179): a, c, t, g, unknown or other
  misc_feature (174)..(179): n is a, c, g, or t
tcagcacgctacgtcacgaccggtgctcgatttagtagtgtagatttgggtttgggggaagagaagactgaccggtccccccaggagttcaggtgctgggcacagcggccctgggctgcctggtcaaggactacttccacgtagcgtgctgagcgggctggcaaggcgcatagnnnnnn

SEQ ID NO: 205922 - DNA, 236 bp, Homo sapiens
  misc_feature: GYAE6OF02FUM0R.30.25.C03.1.454.CMB.1.raw
  modified_base (228)..(236): a, c, t, g, unknown or other
  misc_feature (228)..(236): n is a, c, g, or t
tcagcacgctacgtcacgaccggtgctcgatttagtagtgtagatttgggtttgggtgcccaagctgctggagggcacggtcaccgtctcctcagcctccaccaagggcccatcggtcttccccctggcaccctcctccaagagcacctctgggggcacagcggccctgggctgcctggtcaaggctactccacgtagcgtgctgagcgggctggcaaggcgcatagnnnnnnnnn

SEQ ID NO: 205923 - DNA, 235 bp, Homo sapiens
  misc_feature: GYAE6OF02GLCO2.30.25.C03.1.454.CMB.1.raw
  modified_base (231)..(235): a, c, t, g, unknown or other
  misc_feature (231)..(235): n is a, c, g, or t
tcagcacgctacgtcacgaccggtgctcgatttagtagtgtagatttgggtttgggtgcccaagctgctggagggcacggtcaccgtctcctcagcctccaccaagggcccatcggtcttccccctggcaccctcctccaagagtacctctgggggcacagcggccctgggctgcctggtcaaggactacttccacgtagcgtgctgagcgggctggcaaggcgcatgaannnnn

SEQ ID NO: 205924 - DNA, 235 bp, Homo sapiens; identical to SEQ ID NO: 205318
  misc_feature: GYAE6OF02F0DUX.30.25.C03.1.454.CMB.1.raw
  modified_base (230)..(235): a, c, t, g, unknown or other
  misc_feature (230)..(235): n is a, c, g, or t

SEQ ID NO: 205925 - DNA, 245 bp, Homo sapiens
  misc_feature: GYAE6OF02HK46B.30.25.C03.1.454.CMB.1.raw
  modified_base (233)..(245): a, c, t, g, unknown or other
  misc_feature (233)..(245): n is a, c, g, or t
tcagcacgctacgtcacgaccggtgctcgatttagtagtgtagatttgggtttgggtgcccaagctgctggagggcacggtcaccgtctcctcagcctccaccaagggcccatcggtcttcccctggcaccctcctccaagagcacctcgtggggcacagccggccctgggctgcctggtcaaggacctacttccacgtagcgtgactggagcgggctggcaaggcgcatagnnnnnnnnnnnnn

SEQ ID NO: 205926 - DNA, 234 bp, Homo sapiens; identical to SEQ ID NO: 205242
  misc_feature: GYAE6OF02HGDFI.30.25.C03.1.454.CMB.1.raw
  modified_base (230)..(234): a, c, t, g, unknown or other
  misc_feature (230)..(234): n is a, c, g, or t

SEQ ID NO: 205927 - DNA, 238 bp, Homo sapiens; identical to SEQ ID NO: 205836
  misc_feature: GYAE6OF02G5K09.30.25.C03.1.454.CMB.1.raw
  modified_base (230)..(238): a, c, t, g, unknown or other
  misc_feature (230)..(238): n is a, c, g, or t

SEQ ID NO: 205928 - DNA, 235 bp, Homo sapiens
  misc_feature: GYAE6OF02JLYQ3.30.25.C03.1.454.CMB.1.raw
  modified_base (223)..(223): a, c, t, g, unknown or other
  misc_feature (223)..(223): n is a, c, g, or t
  modified_base (229)..(235): a, c, t, g, unknown or other
  misc_feature (229)..(235): n is a, c, g, or t
tcagcacgctacgtcacgaccggtgctcgatttagtagtgtagatttggtttgggtgcccaagctgctggagggcacggtcaccgtctcctcagcctccaccaagggcccatcggtcttccccctggccaccctcctccaagagcacctctggggcacagcggccctgggctgcctggtcaaggactacttccacgtagcgtgctgagcgggctggcaaggcncatagnnnnnnn

SEQ ID NO: 205929 - DNA, 240 bp, Homo sapiens
  misc_feature: GYAE6OF02HVXVV.30.25.C03.1.454.CMB.1.raw
  modified_base (228)..(228): a, c, t, g, unknown or other
  misc_feature (228)..(228): n is a, c, g, or t
  modified_base (231)..(240): a, c, t, g, unknown or other
  misc_feature (231)..(240): n is a, c, g, or t
tcagcacgctacgtcacgaccggtgctcgatttagtagtgtagatttgggtttgggtgcccaagctgctggagggcacggtcaccgtctcctcagcctccaccaagggcccatcggtcttccccctggcaccctcctccaagagcacctctgggggcacagcggccctgggctgcctggtcaaggactacttccacgtagcgtgctgagcgggctggcaaggcgctanagnnnnnnnnnn

SEQ ID NO: 205930 - DNA, 156 bp, Homo sapiens; identical to SEQ ID NO: 205460
  misc_feature: GYAE6OF02HQATI.30.25.C03.1.454.CMB.1.raw
  modified_base (156)..(156): a, c, t, g, unknown or other
  misc_feature (156)..(156): n is a, c, g, or t

SEQ ID NO: 205931 - DNA, 176 bp, Homo sapiens
  misc_feature: GYAE6OF02I7J29.30.25.C03.1.454.CMB.1.raw
  modified_base (136)..(136): a, c, t, g, unknown or other
  misc_feature (136)..(136): n is a, c, g, or t
  modified_base (157)..(176): a, c, t, g, unknown or other
  misc_feature (157)..(176): n is a, c, g, or t
tcagcacgctacgtcacgaccggtgctcgatttagtagtgtagatttgggtttgggggggaagaggaagactgacggtcctgccacagcggccctgggctgcctgggtcaaggctacttccacgtagcgtgctgancgggctggcaaggcgcatagnnnnnnnnnnnnnnnnnnnn

SEQ ID NO: 205932 - DNA, 157 bp, Homo sapiens; identical to SEQ ID NO: 205114
  misc_feature: GYAE6OF02JI3S6.30.25.C03.1.454.CMB.1.raw
  modified_base (155)..(157): a, c, t, g, unknown or other
  misc_feature (155)..(157): n is a, c, g, or t

SEQ ID NO: 205933 - DNA, 239 bp, Homo sapiens; identical to SEQ ID NO: 205502
  misc_feature: GYAE6OF02HU571.30.25.C03.1.454.CMB.1.raw
  modified_base (230)..(239): a, c, t, g, unknown or other
  misc_feature (230)..(239): n is a, c, g, or t

SEQ ID NO: 205934 - DNA, 249 bp, Homo sapiens
  misc_feature: GYAE6OF02GEHS4.30.25.C03.1.454.CMB.1.raw
  modified_base (227)..(227): a, c, t, g, unknown or other
  misc_feature (227)..(227): n is a, c, g, or t
  modified_base (234)..(249): a, c, t, g, unknown or other
  misc_feature (234)..(249): n is a, c, g, or t
tcagcacgctacgtcacgaccggtgctcgatttagtagtgtagatttgggtttgggtgcccaagctgcctggagggtcacggtcaccgtctcctcagcctccaccaagggcccatcggtcttccccctggcaccctcctccaagagcacctctggggcacagtcggccctgggctgtcctggtcaaggctactccacgtagcgtgcgtgagcgggcgtggcaaggcncataggnnnnnnnnnnnnnnnn

SEQ ID NO: 205935 - DNA, 239 bp, Homo sapiens
  misc_feature: GYAE6OF02IO1KC.30.25.C03.1.454.CMB.1.raw
  modified_base (231)..(239): a, c, t, g, unknown or other
  misc_feature (231)..(239): n is a, c, g, or t
tcagcacgctacgtcacgaccggtgctcgatttagtagtgtagatttgggtttgggtgcccaagctgctggagggcacggtcaccgtctcctcagcctccaccaagggcccatcggtcttcccccctggcaccctcctccaagagcacctctgggggcacagcggccctgggctgcctggtcaaggactacttccacgtagcgtgctgagcgggctggcaaggcgcatagnnnnnnnnn

SEQ ID NO: 205936 - DNA, 179 bp, Homo sapiens; identical to SEQ ID NO: 205479
  misc_feature: GYAE6OF02F3DMT.30.25.C03.1.454.CMB.1.raw
  modified_base (174)..(179): a, c, t, g, unknown or other
  misc_feature (174)..(179): n is a, c, g, or t

SEQ ID NO: 205937 - DNA, 157 bp, Homo sapiens; identical to SEQ ID NO: 205114
  misc_feature: GYAE6OF02GHUXV.30.25.C03.1.454.CMB.1.raw
  modified_base (155)..(157): a, c, t, g, unknown or other
  misc_feature (155)..(157): n is a, c, g, or t

SEQ ID NO: 205938 - DNA, 239 bp, Homo sapiens
  misc_feature: GYAE6OF02JAQXX.30.25.C03.1.454.CMB.1.raw
  modified_base (230)..(239): a, c, t, g, unknown or other
  misc_feature (230)..(239): n is a, c, g, or t
tcagcacgctacgtcacgaccggtgctcgatttagtagtgtagatttgggtttgggtgcccaagctactggagggcacggtcaccgtctcctcagcctccaccaagggcccatcggtcttccccctggcaccctcctccaagagcacctctgggggcacagcggccctgggctgcctgggtcaaggctacttccacgtagcgtgctgagcgggctggcaaggcgcatagnnnnnnnnnn

SEQ ID NO: 205939 - DNA, 163 bp, Homo sapiens
  misc_feature: GYAE6OF02F2KXU.30.25.C03.1.454.CMB.1.raw
  modified_base (156)..(163): a, c, t, g, unknown or other
  misc_feature (156)..(163): n is a, c, g, or t
tcagcacgctacgtcacgaccggtgctcgatttagtagtgtagatttgggtttggggggaagaggaagactgacggtcctgccacagcggccctgggctgcctggtcaaggactacttccacgtagcgtgctgagcgggctggcaaggcgcatagnnnnnnnn

SEQ ID NO: 205940 - DNA, 156 bp, Homo sapiens; identical to SEQ ID NO: 205094
  misc_feature: GYAE6OF02G4077.30.25.C03.1.454.CMB.1.raw
  modified_base (155)..(156): a, c, t, g, unknown or other
  misc_feature (155)..(156): n is a, c, g, or t

SEQ ID NO: 205941 - DNA, 236 bp, Homo sapiens
  misc_feature: GYAE6OF02HQHZX.30.25.C03.1.454.CMB.1.raw
  modified_base (229)..(236): a, c, t, g, unknown or other
  misc_feature (229)..(236): n is a, c, g, or t
tcagcacgctacgtcacgaccggtgctcgatttagtagtgtagatttgggtttgggtgcccaagctgctggagggcacggtcaccgtctcctcagcctccaccaagggcccatcggtcttcccctggcaccctcctccaagagcacctctgggggcacagcggccctgggctgcctggtcaaggactacttccacgtagcgtgctgagcgggctggcaaggcgcatagnnnnnnnn

SEQ ID NO: 205942 - DNA, 179 bp, Homo sapiens; identical to SEQ ID NO: 205479
  misc_feature: GYAE6OF02F7JLP.30.25.C03.1.454.CMB.1.raw
  modified_base (174)..(179): a, c, t, g, unknown or other
  misc_feature (174)..(179): n is a, c, g, or t

SEQ ID NO: 205943 - DNA, 234 bp, Homo sapiens; identical to SEQ ID NO: 205242
  misc_feature: GYAE6OF02I4W8E.30.25.C03.1.454.CMB.1.raw
  modified_base (230)..(234): a, c, t, g, unknown or other
  misc_feature (230)..(234): n is a, c, g, or t

SEQ ID NO: 205944 - DNA, 265 bp, Homo sapiens
  misc_feature: GYAE6OF02G30FT.30.25.C03.1.454.CMB.1.raw
  modified_base (228)..(230): a, c, t, g, unknown or other
  misc_feature (228)..(230): n is a, c, g, or t
  modified_base (232)..(235): a, c, t, g, unknown or other
  misc_feature (232)..(235): n is a, c, g, or t
  modified_base (237)..(242): a, c, t, g, unknown or other
  misc_feature (237)..(242): n is a, c, g, or t
  modified_base (245)..(265): a, c, t, g, unknown or other
  misc_feature (245)..(265): n is a, c, g, or t
tcagcacgctacgtcacgaccggtgctcgatttagtagtgtagatttgggtttgggtgcccaagctgctggagggcacggtcaccgtctcctcagcctccaccaagggcccatcggtcttccccctggcaccctcctccaagagcacctctggggcacagcggccctgggctgcctggtcaaggactacttccacgtagctgctgagcgggctggcaaggcgcatagnnnannnngnnnnnnctnnnnnnnnnnnnnnnnnnnnn

SEQ ID NO: 205945 - DNA, 238 bp, Homo sapiens
  misc_feature: GYAE6OF02HBOPX.30.25.C03.1.454.CMB.1.raw
  modified_base (222)..(222): a, c, t, g, unknown or other
  misc_feature (222)..(222): n is a, c, g, or t
  modified_base (228)..(238): a, c, t, g, unknown or other
  misc_feature (228)..(238): n is a, c, g, or t
tcagcacgctacgtcacgaccggtgctcgatttagtagtgtagatttgggtttgggtgcccaagctgctggagggcacggtcaccgtctcctcagcctccaccaaggcccatcggtcttccccctggcaccctcctccaagagcacctctgggggcacagcggccctgggctgcctggtcaaggctacttccacgtagcgtgctgagcgggctggcaaggcncatagnnnnnnnnnnn

SEQ ID NO: 205946 - DNA, 180 bp, Homo sapiens
  misc_feature: GYAE6OF02HZ6E7.30.25.C03.1.454.CMB.1.raw
  modified_base (176)..(180): a, c, t, g, unknown or other
  misc_feature (176)..(180): n is a, c, g, or t
tcagcacgctacgtcacgaccggtgctcgatttagtagtgtagatttgggtttggggggaagaggaagactgacggtccccccaggagttcaggtgctgggcacagcggccctgggctgcctggtcaaaggactacttccacgtagcgtgctgagcgggctggcaaggcgcatagnnnnn

SEQ ID NO: 205947 - DNA, 192 bp, Homo sapiens
  misc_feature: GYAE6OF02G81JQ.30.25.C03.1.454.CMB.1.raw
  modified_base (174)..(192): a, c, t, g, unknown or other
  misc_feature (174)..(192): n is a, c, g, or t
tcagcacgctacgtcacgaccggtgctcgatttagtagtgtagatttgggtttgggggaagaggaagactgacggtccccccaggagttcaggtgctgggcacagcggccctgggctgcctggtcaaggactacttccacgtagcgtgctgagcgggctggcaaggcgcatagnnnnnnnnnnnnnnnnnnn

SEQ ID NO: 205948 - DNA, 236 bp, Homo sapiens
  misc_feature: GYAE6OF02HRYZN.30.25.C03.1.454.CMB.1.raw
  modified_base (225)..(225): a, c, t, g, unknown or other
  misc_feature (225)..(225): n is a, c, g, or t
  modified_base (228)..(236): a, c, t, g, unknown or other
  misc_feature (228)..(236): n is a, c, g, or t
tcagcacgctacgtcacgaccggtgctcgatttagtagtgtagatttgggtttgggtgcccaagctgctggagggcacggtcaccgtctcctcagcctccaccaagggcccatcggtcttcccctggcaccctcctccaagagcacctctgggggcacagcggccctgggctgcctggtcaaggactacttccacgtagcgtgctgagcggctggcaaggcgcanagnnnnnnnnn

SEQ ID NO: 205949 - DNA, 205 bp, Homo sapiens
  misc_feature: GYAE6OF02JG9G9.30.25.C03.1.454.CMB.1.raw
  modified_base (177)..(205): a, c, t, g, unknown or other
  misc_feature (177)..(205): n is a, c, g, or t
tcagcacgctacgtcacgaccggtgctcgatttagtagtgtagatttgggtttggggggaaggaggaagactgacggtccccccaggagttcaggtgctgggcacagcggccctggggctgcctggtcaaggactacttccacgtagcgtgctgagcgggctggcaaggcgcatagnnnnnnnnnnnnnnnnnnnnnnnnnnnnn

SEQ ID NO: 205950 - DNA, 173 bp, Homo sapiens
  misc_feature: GYAE6OF02F0JDE.30.25.C03.1.454.CMB.1.raw
tcagcacgctacgtcacgaccggtgctcgatttagtagtgtagatttgggtttggggggaagaggaagactgacggtccccccaggagttcaggtgctgggcacagcggccctgggctgcctggtcaaggactactccacgtagcgtgctgagcgggctggcaaggcgcatag

SEQ ID NO: 205951 - DNA, 239 bp, Homo sapiens
  misc_feature: GYAE6OF02HEKQ2.30.25.C03.1.454.CMB.1.raw
  modified_base (225)..(225): a, c, t, g, unknown or other
  misc_feature (225)..(225): n is a, c, g, or t
  modified_base (231)..(239): a, c, t, g, unknown or other
  misc_feature (231)..(239): n is a, c, g, or t
tcagcacgctacgtcacgaccggtgctcgatttagtagtgtagatttgggtttgggtgcccaagctgctggagggcacggtcaccgtctcctcagcctccaccaagggcccatcggtcttaccccctggcaccctcctccaagagcacctctgggggcacagcggccctgggctgcctggtcaaggactacttccacgtagcgtgctgagcgggctggcaaggcncatagnnnnnnnnn

SEQ ID NO: 205952 - DNA, 236 bp, Homo sapiens; identical to SEQ ID NO: 205399
  misc_feature: GYAE6OF02JG5AQ.30.25.C03.1.454.CMB.1.raw
  modified_base (230)..(236): a, c, t, g, unknown or other
  misc_feature (230)..(236): n is a, c, g, or t

SEQ ID NO: 205953 - DNA, 264 bp, Homo sapiens
  misc_feature: GYAE6OF02JL0HK.30.25.C03.1.454.CMB.1.raw
  modified_base (150)..(150): a, c, t, g, unknown or other
  misc_feature (150)..(150): n is a, c, g, or t
  modified_base (233)..(264): a, c, t, g, unknown or other
  misc_feature (233)..(264): n is a, c, g, or t
tcagcacgctacgtcacgaccggtgctcgatttagtagtgtagatttgggtttggggtgcccaagctgctggagggcacggtcaccgtctcctcagcctccaccaagggccccatcggtcttccccctggccacccgtcctccaagagcncctctggggcacagcgccctgggctgcctggtcaaggactacgttccacgtagcgtgcttgagcgggctggcaggcgcatagnnnnnnnnnnnnnnnnnnnnnnnnnnnnnnnn

SEQ ID NO: 205954 - DNA, 261 bp, Homo sapiens
  misc_feature: GYAE6OF02GUDNH.30.25.C03.1.454.CMB.1.raw
  modified_base (229)..(229): a, c, t, g, unknown or other
  misc_feature (229)..(229): n is a, c, g, or t
  modified_base (234)..(261): a, c, t, g, unknown or other
  misc_feature (234)..(261): n is a, c, g, or t
tcagcacgctacgtcacgaccggtgctcgatttagtagtgtagatttgggtttgggtgcccaagctgctggagggcacggtcaccgtctcctcagcctccaccaagggcccatcggtcttccccctggcaccctcctccaagagcacctcgtgggggcacagccggccctgggctgcctggtcaaggactacttccacgtagcgtgctgagcggggctggcgaaggcgnatagnnnnnnnnnnnnnnnnnnnnnnnnnnnn

SEQ ID NO: 205955 - DNA, 163 bp, Homo sapiens
  misc_feature: GYAE6OF02GGO5J.30.25.C03.1.454.CMB.1.raw
  modified_base (154)..(163): a, c, t, g, unknown or other
  misc_feature (154)..(163): n is a, c, g, or t
tcagcacgctacgtcacgaccggtgctcgatttagtagtgtagatttgggtttgggggaagaggaagactgacggtcctgccacagcggccctgggctgcctggtcaaggactacttccagtagcgtgctgagcgggctggcaaggcgcatagnnnnnnnnnn

SEQ ID NO: 205956 - DNA, 247 bp, Homo sapiens
  misc_feature: GYAE6OF02FUMZQ.30.25.C03.1.454.CMB.1.raw
  modified_base (232)..(247): a, c, t, g, unknown or other
  misc_feature (232)..(247): n is a, c, g, or t
tcagcacgctacgtcacgaccggtgctcgatttagtagtgtagatttgggtttgggtgcccaagctgctggagggcacggtcaccgtctcctcagcctccaccaagggcccatcggtcttccccctggcaccctcctccaagagcacctcgtgggggcacagcggccctgggctgcctggtcaaggactacttccacgtagcgtgctgagcgggctggcaaggcgcagtagnnnnnnnnnnnnnnnn

SEQ ID NO: 205957 - DNA, 196 bp, Homo sapiens
  misc_feature: GYAE6OF02IWER7.30.25.C03.1.454.CMB.1.raw
  modified_base (173)..(196): a, c, t, g, unknown or other
  misc_feature (173)..(196): n is a, c, g, or t
tcagcacgctacgtcacgaccggtgctcgatttagtagtgtagatttgggtttgggggaagaggaagactgacggtccccccaggagttcaggtgctgggcacagcggccctgggctgcctggtcaaggactactccacgtagcgtgctgagcgggctggcaaggcgcatagnnnnnnnnnnnnnnnnnnnnnnnn

SEQ ID NO: 205958 - DNA, 239 bp, Homo sapiens; identical to SEQ ID NO: 205502
  misc_feature: GYAE6OF02IFZ95.30.25.C03.1.454.CMB.1.raw
  modified_base (230)..(239): a, c, t, g, unknown or other
  misc_feature (230)..(239): n is a, c, g, or t

SEQ ID NO: 205959 - DNA, 254 bp, Homo sapiens
  misc_feature: GYAE6OF02GZJXH.30.25.C03.1.454.CMB.1.raw
  modified_base (224)..(224): a, c, t, g, unknown or other
  misc_feature (224)..(224): n is a, c, g, or t
  modified_base (231)..(254): a, c, t, g, unknown or other
  misc_feature (231)..(254): n is a, c, g, or t
tcagcacgctacgtcacgaccggtgctcgatttagtagtgtagatttgggtttgggtgcccaagctgctggagggcacggtcaccgtctcctcagcctccaccaagggcccatcggtcttccccctggcaccctcctccaagagcacctctgggggcacagcggccctgggctgcctggtcaaggactacttccacgtagcgtgctgagcgggctggcaaggcncgatagnnnnnnnnnnnnnnnnnnnnnnnn

SEQ ID NO: 205960 - DNA, 161 bp, Homo sapiens; identical to SEQ ID NO: 205889
  misc_feature: GYAE6OF02GW390.30.25.C03.1.454.CMB.1.raw
  modified_base (156)..(161): a, c, t, g, unknown or other
  misc_feature (156)..(161): n is a, c, g, or t

SEQ ID NO: 205961 - DNA, 632 bp, Homo sapiens
  misc_feature: GYAE6OF02GN2U6.30.25.C03.1.454.CMB.1.raw
  modified_base (203)..(203): a, c, t, g, unknown or other
  misc_feature (203)..(203): n is a, c, g, or t
  modified_base (207)..(207): a, c, t, g, unknown or other
  misc_feature (207)..(207): n is a, c, g, or t
  modified_base (209)..(209): a, c, t, g, unknown or other
  misc_feature (209)..(209): n is a, c, g, or t
  modified_base (218)..(218): a, c, t, g, unknown or other
  misc_feature (218)..(218): n is a, c, g, or t
  modified_base (222)..(222): a, c, t, g, unknown or other
  misc_feature (222)..(222): n is a, c, g, or t
  modified_base (224)..(224): a, c, t, g, unknown or other
  misc_feature (224)..(224): n is a, c, g, or t
  modified_base (226)..(226): a, c, t, g, unknown or other
  misc_feature (226)..(226): n is a, c, g, or t
  modified_base (228)..(228): a, c, t, g, unknown or other
  misc_feature (228)..(228): n is a, c, g, or t
  modified_base (231)..(231): a, c, t, g, unknown or other
  misc_feature (231)..(231): n is a, c, g, or t
  modified_base (233)..(234): a, c, t, g, unknown or other
  misc_feature (233)..(234): n is a, c, g, or t
  modified_base (236)..(239): a, c, t, g, unknown or other
  misc_feature (236)..(239): n is a, c, g, or t
  modified_base (241)..(242): a, c, t, g, unknown or other
  misc_feature (241)..(242): n is a, c, g, or t
  modified_base (244)..(244): a, c, t, g, unknown or other
  misc_feature (244)..(244): n is a, c, g, or t
  modified_base (252)..(252): a, c, t, g, unknown or other
  misc_feature (252)..(252): n is a, c, g, or t
  modified_base (263)..(263): a, c, t, g, unknown or other
  misc_feature (263)..(263): n is a, c, g, or t
  modified_base (269)..(269): a, c, t, g, unknown or other
  misc_feature (269)..(269): n is a, c, g, or t
  modified_base (271)..(271): a, c, t, g, unknown or other
  misc_feature (271)..(271): n is a, c, g, or t
  modified_base (279)..(279): a, c, t, g, unknown or other
  misc_feature (279)..(279): n is a, c, g, or t
  modified_base (281)..(281): a, c, t, g, unknown or other
  misc_feature (281)..(281): n is a, c, g, or t
  modified_base (291)..(291): a, c, t, g, unknown or other
  misc_feature (291)..(291): n is a, c, g, or t
  modified_base (293)..(293): a, c, t, g, unknown or other
  misc_feature (293)..(293): n is a, c, g, or t
  modified_base (396)..(396): a, c, t, g, unknown or other
  misc_feature (396)..(396): n is a, c, g, or t
tcagcacgctacgtcacgaccggtgctcgattttagtagtgtagattttggggttttgggggggggaagaggaagaactggacggtccccccgaggagggttcagggtgactgggcactagcggccctcggggctgccctggttccaaggacttacttccacgtaggcgtgctggagccgggcgtggcaagggcgcagtagcntcancnctgctgctntcgngngngngcncnnannnncnncngtgtgttntcgccacacanactatntntacgacananagagtagacncncctactactactatattcgtcgtacgtacgtaccgcgtacgtccgtacgtacgtactagtacgtacgtcgcgtcggtcgtcgtacgtcttctctctacacacncacgcacgctcgcgtacgtacgagtagtagtcgtacgtacgtttacgttactacgtactacgtacgtaaccttaacttacgtttaccttacctttaccgtttccgtttacgttaccgttacggtaccgggtaccggttaacggtaggtaggtagttaacgtaacgtaacgtacggttacggtacggtactaccgtacgtaccgtaccgttaccgttccgttaccttaccttacccg

SEQ ID NO: 205962 - DNA, 234 bp, Homo sapiens; identical to SEQ ID NO: 205242
  misc_feature: GYAE6OF02GXZEV.30.25.C03.1.454.CMB.1.raw
  modified_base (230)..(234): a, c, t, g, unknown or other
  misc_feature (230)..(234): n is a, c, g, or t

SEQ ID NO: 205963 - DNA, 234 bp, Homo sapiens
  misc_feature: GYAE6OF02FV792.30.25.C03.1.454.CMB.1.raw
  modified_base (230)..(234): a, c, t, g, unknown or other
  misc_feature (230)..(234): n is a, c, g, or t
tcagcacgctacgtcacgaccggtgctcgatttagtagtgtagatttgggtttgggtgcccaagctgctggagggcacggtcaccgtctcctcagcctccaccaagggcccatcggtcttccccctggcaccctcctccaagagcacctctgggggcacagcggccctgggctgactggtcaaggactacttccacgtagcgtgctgagcgggctggcaaggcgcatagnnnnn

SEQ ID NO: 205964 - DNA, 175 bp, Homo sapiens
  misc_feature: GYAE6OF02GXZTD.30.25.C03.1.454.CMB.1.raw
  modified_base (174)..(175): a, c, t, g, unknown or other
  misc_feature (174)..(175): n is a, c, g, or t
tcagcacgctacgtcacgaccggtgctcgatttagtagtgtagatttgggtttggggggaagaggaagactgacggtcccccaggagttcaggtgctgggcacagcggccctgggctgcctggtcaaggactacttccacgtagcgtgctgagcgggctggcaaggcgcatagnn

SEQ ID NO: 205965 - DNA, 242 bp, Homo sapiens; identical to SEQ ID NO: 205831
  misc_feature: GYAE6OF02FGLDE.30.25.C03.1.454.CMB.1.raw
  modified_base (230)..(242): a, c, t, g, unknown or other
  misc_feature (230)..(242): n is a, c, g, or t

SEQ ID NO: 205966 - DNA, 238 bp, Homo sapiens
  misc_feature: GYAE6OF02FYV8Z.30.25.C03.1.454.CMB.1.raw
  modified_base (230)..(238): a, c, t, g, unknown or other
  misc_feature (230)..(238): n is a, c, g, or t
tcagcacgctacgtcacgaccggtgctcgatttagtagtgtagatttgggtttgggtgcccaagctgctggagggcacggtcaccgtctcctcagcctccaccaagggcccatcggtctttcccctggcaccctcctccaagagcacctctgggggcacagcggccctgggctgcctggtcaaggactacttccacgtagcgtgctgagcgggctggcaaggcgcatagnnnnnnnnn

SEQ ID NO: 205967 - DNA, 232 bp, Homo sapiens; identical to SEQ ID NO: 205063
  misc_feature: GYAE6OF02F6F3H.30.25.C03.1.454.CMB.1.raw
  modified_base (230)..(232): a, c, t, g, unknown or other
  misc_feature (230)..(232): n is a, c, g, or t

SEQ ID NO: 205968 - DNA, 273 bp, Homo sapiens
  misc_feature: GYAE6OF02J01JX.30.25.C03.1.454.CMB.1.raw
  modified_base (233)..(233): a, c, t, g, unknown or other
  misc_feature (233)..(233): n is a, c, g, or t
  modified_base (235)..(235): a, c, t, g, unknown or other
  misc_feature (235)..(235): n is a, c, g, or t
  modified_base (240)..(240): a, c, t, g, unknown or other
  misc_feature (240)..(240): n is a, c, g, or t
  modified_base (243)..(243): a, c, t, g, unknown or other
  misc_feature (243)..(243): n is a, c, g, or t
  modified_base (245)..(247): a, c, t, g, unknown or other
  misc_feature (245)..(247): n is a, c, g, or t
  modified_base (249)..(273): a, c, t, g, unknown or other
  misc_feature (249)..(273): n is a, c, g, or t
tcagcacgctacgtcacgaccggtgctcgatttagtagtgtagatttgggtttgggtgcccaagctgctggaggcacggtcaccgtctcctcagcctccaccaaggcccatccggtcttcccccctggccaccctccctccaacgagccacctctggggcacagcggccctgggctgcctggtcaggactactccacgtagcgtgctgacgcggctggcaaggcgacagtagnangacgnatnannnannnnnnnnnnnnnnnnnnnnnnnnn

SEQ ID NO: 205969 - DNA, 234 bp, Homo sapiens
  misc_feature: GYAE6OF02HT762.30.25.C03.1.454.CMB.1.raw
  modified_base (229)..(234): a, c, t, g, unknown or other
  misc_feature (229)..(234): n is a, c, g, or t
tcagcacgctacgtcacgaccggtgctcgatttagtagtgtagatttgggtttgggtgcccaagctgctggagggcacggtcaccgtctcctcagcctccaccaagggcccatcggtcttccccctggcaccctcctccaagagcacctctgggggcacagcggcctgggctgcctggtcaaggactacttccacgtagcgtgctgagcgggctggcaaggcgcatagnnnnnn

SEQ ID NO: 205970 - DNA, 180 bp, Homo sapiens
  misc_feature: GYAE6OF02IVEJQ.30.25.C03.1.454.CMB.1.raw
  modified_base (166)..(166): a, c, t, g, unknown or other
  misc_feature (166)..(166): n is a, c, g, or t
  modified_base (171)..(180): a, c, t, g, unknown or other
  misc_feature (171)..(180): n is a, c, g, or t
tcagcacgctacgtcacgaccggtgctcgatttagtagtgtagatttgggtttgggggaagaggaagactgacggtcccccaggagttcaggtgctgggcacagcggccctgggctgcctggtcaaggactacttccacgtagctgctgagcgggctggcaaggcncatgnnnnnnnnnn

SEQ ID NO: 205971 - DNA, 186 bp, Homo sapiens
  misc_feature: GYAE6OF02IM741.30.25.C03.1.454.CMB.1.raw
  modified_base (61)..(61): a, c, t, g, unknown or other
  misc_feature (61)..(61): n is a, c, g, or t
  modified_base (174)..(186): a, c, t, g, unknown or other
  misc_feature (174)..(186): n is a, c, g, or t
tcagcacgctacgtcacgaccggtgctcgatttagtagtgtagatttgggtttgggggaanaggaagactgacggtccccccaggagttcaggtgctgggcacagcggccctgggctgcctggtcaaggactacttccacgtagcgtgctgagcgggctggcaaggcgcatagnnnnnnnnnnnnn

SEQ ID NO: 205972 - DNA, 239 bp, Homo sapiens
  misc_feature: GYAE6OF02GJ4ZN.30.25.C03.1.454.CMB.1.raw
  modified_base (228)..(239): a, c, t, g, unknown or other
  misc_feature (228)..(239): n is a, c, g, or t
tcagcacgctacgtcacgaccggtgctcgatttagtagtgtagatttgggtttgggtgcccaagctgctggagggcacggtcaccgtctcctcagcctccaccaagggcccatcggtcttccccctggcaccctcctccaagagcacctctgggggcacagcggccctgggctgcctggtcaaggactacttccacgtagctgctgagcgggctggcaaggcgcatgnnnnnnnnnnnn

SEQ ID NO: 205973 - DNA, 257 bp, Homo sapiens
  misc_feature: GYAE6OF02G5XDZ.30.25.C03.1.454.CMB.1.raw
  modified_base (231)..(257): a, c, t, g, unknown or other
  misc_feature (231)..(257): n is a, c, g, or t
tcagcacgctacgtcacgaccggtgctcgatttagtagtgtagatttgggtttgggtgcccaagctgctggagggcacggtcaccgtctcctcagcctccaccaagggcccatcggtcttcccccctggcaccctcctccaagagcacctctgggggcacagcggccctgggctgcctggtcaaggactacttccacgtagcgtgctgagcgggctggcaaggcgcatagnnnnnnnnnnnnnnnnnnnnnnnnnnn

SEQ ID NO: 205974 - DNA, 251 bp, Homo sapiens
  misc_feature: GYAE6OF02HG8TJ.30.25.C03.1.454.CMB.1.raw
  modified_base (224)..(224): a, c, t, g, unknown or other
  misc_feature (224)..(224): n is a, c, g, or t
  modified_base (230)..(251): a, c, t, g, unknown or other
  misc_feature (230)..(251): n is a, c, g, or t
tcagcacgctacgtcacgaccggtgctcgatttagtagtgtagatttgggtttgggtgcccaagctgctggaggcacggtcaccgtctcctcagcctccaccaagggcccatcggtcttccccctggcaccctcctccaagagcacctcgtgggggcacagcggccctgggctgcctggtcaaggtactacttccacgtagcgtgctgagcggctggcaaggcncatagnnnnnnnnnnnnnnnnnnnnnn

SEQ ID NO: 205975 - DNA, 234 bp, Homo sapiens
  misc_feature: GYAE6OF02IDPLI.30.25.C03.1.454.CMB.1.raw
  modified_base (228)..(234): a, c, t, g, unknown or other
  misc_feature (228)..(234): n is a, c, g, or t
tcagcacgctacgtcacgaccggtgctcgatttagtagtgtagatttgggtttgggtgcccaagctgctggagggcacggtcaccgtctcctcagcctccaccaagggcccatcggtcttccccctggcaccctcctccaagagcacctctggggcacagcggccctgggctgcctggtcaaggactacttccacgtagcgtgctgagcgggctggcaggcgcatagnnnnnnn

SEQ ID NO: 205976 - DNA, 242 bp, Homo sapiens; identical to SEQ ID NO: 205831
  misc_feature: GYAE6OF02JTKEZ.30.25.C03.1.454.CMB.1.raw
  modified_base (230)..(242): a, c, t, g, unknown or other
  misc_feature (230)..(242): n is a, c, g, or t

SEQ ID NO: 205977 - DNA, 271 bp, Homo sapiens
  misc_feature: GYAE6OF02FKB6R.30.25.C03.1.454.CMB.1.raw
  modified_base (135)..(135): a, c, t, g, unknown or other
  misc_feature (135)..(135): n is a, c, g, or t
  modified_base (230)..(271): a, c, t, g, unknown or other
  misc_feature (230)..(271): n is a, c, g, or t
tcagcacgctacgtcacgaccggtgctcgatttagtagtgtagatttgggtttgggtgcccaagctgctggagggcacggtcacccgtctcctcagcctccaccaagggcccatcggtcttcccccctgcacccncctccaagagcacctctgggggcacagcgccctgggctgcctggtcaaggactacttccacgtagcgtgctgagcgggctggcaaggcgcatagnnnnnnnnnnnnnnnnnnnnnnnnnnnnnnnnnnnnnnnnnn

SEQ ID NO: 205978 - DNA, 163 bp, Homo sapiens; identical to SEQ ID NO: 205939
  misc_feature: GYAE6OF02HQJAX.30.25.C03.1.454.CMB.1.raw
  modified_base (156)..(163): a, c, t, g, unknown or other
  misc_feature (156)..(163): n is a, c, g, or t

SEQ ID NO: 205979 - DNA, 240 bp, Homo sapiens
  misc_feature: GYAE6OF02JE3MY.30.25.C03.1.454.CMB.1.raw
  modified_base (231)..(240): a, c, t, g, unknown or other
  misc_feature (231)..(240): n is a, c, g, or t
tcagcacgctacgtcacgaccggtgctcgatttagtagtgtagatttgggtttgggtcgcccaagctgctggagggcacggtcaccggtctcctcagcctccacaagggcccatcggtcttccccctggcaccctcctccaagagcacctcgtggggcacagcgccctgggctgcctggtcaaggactacttccacgtagcgtgctgagcgggctggcaaggcgtcatagnnnnnnnnnn

SEQ ID NO: 205980 - DNA, 246 bp, Homo sapiens
  misc_feature: GYAE6OF02IEONI.30.25.C03.1.454.CMB.1.raw
  modified_base (229)..(246): a, c, t, g, unknown or other
  misc_feature (229)..(246): n is a, c, g, or t
tcagcacgctacgtcacgaccggtgctcgatttagtagtgtagatttgggtttgggtgcccaagctgctggagggcacggtcacgtctcctcagcctccaccaagggcccatcggtcttccccctggcaccctcctccaagagcacctctgggggcacagcggccctgggctgcctggtcaaggactacttccacgtagcgtgctgagcgggctggcaaggcgcatagnnnnnnnnnnnnnnnnnn

SEQ ID NO: 205981 - DNA, 261 bp, Homo sapiens
  misc_feature: GYAE6OF02I0OXJ.30.25.C03.1.454.CMB.1.raw
  modified_base (222)..(222): a, c, t, g, unknown or other
  misc_feature (222)..(222): n is a, c, g, or t
  modified_base (227)..(232): a, c, t, g, unknown or other
  misc_feature (227)..(232): n is a, c, g, or t
  modified_base (234)..(261): a, c, t, g, unknown or other
  misc_feature (234)..(261): n is a, c, g, or t
tcagcacgctacgtcacgaccggtgctcgatttagtagtgtagatttgggtttggggtgcccaagctgctggagggcacggtcaccgtctcctcagcctccaccaagggcccatcggtcttcccccctggcaccctcctccaagagcacctctgggggcacagcggccctgggctgcctgtcaaggctacttcagtagcgtgctgagcgggctggcaaggcncatgnnnnnngnnnnnnnnnnnnnnnnnnnnnnnnnnnn

SEQ ID NO: 205982 - DNA, 178 bp, Homo sapiens
  misc_feature: GYAE6OF02H811L.30.25.C03.1.454.CMB.1.raw
  modified_base (156)..(156): a, c, t, g, unknown or other
  misc_feature (156)..(156): n is a, c, g, or t
  modified_base (164)..(178): a, c, t, g, unknown or other
  misc_feature (164)..(178): n is a, c, g, or t
tcagcacgctacgtcacgaccggtgctcgatttagtagtgtagatttgggtttggggggaagaggaagactgacggtcctgccacagcggccctgggctgcctggtcaaggactacttccacgtagcgtgctgagcgggctggcaaggcgcatagngggggggnnnnnnnnnnnnnnn

SEQ ID NO: 205983 - DNA, 179 bp, Homo sapiens
  misc_feature: GYAE6OF02I0267.30.25.C03.1.454.CMB.1.raw
  modified_base (157)..(179): a, c, t, g, unknown or other
  misc_feature (157)..(179): n is a, c, g, or t
tcagcacgctacgtcacgaccggtgctcgatttagtagtgtagatttgggtttggggggaagaggaagactgacggtcctgccacagcggccctgggctgcctggtcaaggactacttccaacgtagcgtgctgagcgggctggcaaggcgcatagnnnnnnnnnnnnnnnnnnnnnnn

SEQ ID NO: 205984 - DNA, 184 bp, Homo sapiens
  misc_feature: GYAE6OF02GEHSJ.30.25.C03.1.454.CMB.1.raw
  modified_base (169)..(169): a, c, t, g, unknown or other
  misc_feature (169)..(169): n is a, c, g, or t
  modified_base (171)..(171): a, c, t, g, unknown or other
  misc_feature (171)..(171): n is a, c, g, or t
  modified_base (174)..(184): a, c, t, g, unknown or other
  misc_feature (174)..(184): n is a, c, g, or t
tcagcacgctacgtcacgaccggtgctcgatttagtagtgtagatttgggtttggggggaagaggaagactgacggtccccccaggagttcaggtgctgggcacagcggccctgggctgcctggtcaaggactacttccacgtagcggctgagcgggctggcaaggcgnanagnnnnnnnnnnn

SEQ ID NO: 205985 - DNA, 244 bp, Homo sapiens
  misc_feature: GYAE6OF02IKAIF.30.25.C03.1.454.CMB.1.raw
  modified_base (232)..(244): a, c, t, g, unknown or other
  misc_feature (232)..(244): n is a, c, g, or t
tcagcacgctacgtcacgaccggtgctcgatttagtagtgtagatttgggtttgggtgcccaagctgctggagggcacggtcaccgtctcctcagcctccaccaagggcccatcggtcttcccccctggcaccctcctccaagagcacctctgggggcacagcggccctgggctgcctggtcaaggactacttccacgtagcgtgctgacgcgggctggcaaggcgcatagnnnnnnnnnnnnn

SEQ ID NO: 205986 - DNA, 176 bp, Homo sapiens
  misc_feature: GYAE6OF02GELBL.30.25.C03.1.454.CMB.1.raw
  modified_base (157)..(176): a, c, t, g, unknown or other
  misc_feature (157)..(176): n is a, c, g, or t
tcagcacgctacgtcacgaccggtgctcgatttagtagtgtagatttgggtttgggggggaagaggaagactgacggtcctgccacagcggccctgggctgcctggtcaaggactacttccacgtagcgtgctgagcgggctggcaaggcgcatagnnnnnnnnnnnnnnnnnnnn

SEQ ID NO: 205987 - DNA, 567 bp, Homo sapiens
  misc_feature: GYAE6OF02GDQQ5.30.25.C03.1.454.CMB.1.raw
  modified_base (86)..(86): a, c, t, g, unknown or other
  misc_feature (86)..(86): n is a, c, g, or t
  modified_base (141)..(141): a, c, t, g, unknown or other
  misc_feature (141)..(141): n is a, c, g, or t
  modified_base (144)..(144): a, c, t, g, unknown or other
  misc_feature (144)..(144): n is a, c, g, or t
  modified_base (231)..(231): a, c, t, g, unknown or other
  misc_feature (231)..(231): n is a, c, g, or t
  modified_base (234)..(234): a, c, t, g, unknown or other
  misc_feature (234)..(234): n is a, c, g, or t
  modified_base (236)..(236): a, c, t, g, unknown or other
  misc_feature (236)..(236): n is a, c, g, or t
  modified_base (241)..(241): a, c, t, g, unknown or other
  misc_feature (241)..(241): n is a, c, g, or t
  modified_base (259)..(259): a, c, t, g, unknown or other
  misc_feature (259)..(259): n is a, c, g, or t
  modified_base (264)..(264): a, c, t, g, unknown or other
  misc_feature (264)..(264): n is a, c, g, or t
  modified_base (268)..(268): a, c, t, g, unknown or other
  misc_feature (268)..(268): n is a, c, g, or t
  modified_base (279)..(279): a, c, t, g, unknown or other
  misc_feature (279)..(279): n is a, c, g, or t
  modified_base (292)..(292): a, c, t, g, unknown or other
  misc_feature (292)..(292): n is a, c, g, or t
  modified_base (296)..(296): a, c, t, g, unknown or other
  misc_feature (296)..(296): n is a, c, g, or t
  modified_base (301)..(301): a, c, t, g, unknown or other
  misc_feature (301)..(301): n is a, c, g, or t
  modified_base (317)..(317): a, c, t, g, unknown or other
  misc_feature (317)..(317): n is a, c, g, or t
  modified_base (326)..(326): a, c, t, g, unknown or other
  misc_feature (326)..(326): n is a, c, g, or t
  modified_base (333)..(333): a, c, t, g, unknown or other
  misc_feature (333)..(333): n is a, c, g, or t
  modified_base (343)..(343): a, c, t, g, unknown or other
  misc_feature (343)..(343): n is a, c, g, or t
  modified_base (349)..(349): a, c, t, g, unknown or other
  misc_feature (349)..(349): n is a, c, g, or t
  modified_base (373)..(373): a, c, t, g, unknown or other
  misc_feature (373)..(373): n is a, c, g, or t
  modified_base (376)..(376): a, c, t, g, unknown or other
  misc_feature (376)..(376): n is a, c, g, or t
tcagcacgctacgtcacgaccggtgctcgattttagtagtgtagatttggggtttggggtgcccaagctgctcggagggcacggtnaccgtctcctcagcctccacaaggccatcggtcttcccctggcacctcctcaagngcnccgtcgtgggggcacagccgccctgggctgcgtggcaaggactacttccacgtgcgtgcgtggagcgggtctggacaggcacgatgncgncnactgnatcgcttacgctagctcngtacngacncgtccgatccngacgttagccgtncggnttacncgcagcggtaaccggngtagactcncgactcncgtagcagcncacggnacgtcgtcaacgtcacgtttaatnttnttacacgtcgtccttagacgtacgtagtacgtagaccgtcgttacgttcgtccgtaccgtaaccggtacggtacgtacgtagtaacgtacggtacgacggtcgtacgttaccgtacgacgtacgtccgtacgtccgtaccgtacgttactacgtcgtcgtattacgtcgtataccggtactacgtcttcgg

SEQ ID NO: 205988 - DNA, 244 bp, Homo sapiens
  misc_feature: GYAE6OF02JGWGH.30.25.C03.1.454.CMB.1.raw
  modified_base (212)..(212): a, c, t, g, unknown or other
  misc_feature (212)..(212): n is a, c, g, or t
  modified_base (225)..(244): a, c, t, g, unknown or other
  misc_feature (225)..(244): n is a, c, g, or t
tcagcacgctacgtcacgaccggtgctcgatttagtagtgtagatttgggtttgggtgcccaagctgctgggagggcacggtcaccgtctcctcagcctccaccaagggcccatcggtcttcccctggcaccctcctccaagagcacctcgtgggggcacagcggccctgggctgcctggtcaaggctactcacgtagcgtgctgagcgggntggcagcgcatgnnnnnnnnnnnnnnnnnnnn

SEQ ID NO: 205989 - DNA, 261 bp, Homo sapiens
  misc_feature: GYAE6OF02JFENS.30.25.C03.1.454.CMB.1.raw
  modified_base (242)..(244): a, c, t, g, unknown or other
  misc_feature (242)..(244): n is a, c, g, or t
  modified_base (246)..(261): a, c, t, g, unknown or other
  misc_feature (246)..(261): n is a, c, g, or t
tcagcacgctacgtcacgaccggtgctcgatttagtagtgtagatttgggtttgggtgtcccaagctgctggagggcgacggtcaccgtctcctcagcctccaccaagggcccatccggtccttccccctggcaccctcctccaagacgcacctcgtggggcacaggcggccctgggctgcctcggtacaaggaccttactccacgtagcgtgctagacgcgggctgggacaggcgcatagnnnannnnnnnnnnnnnnnn

SEQ ID NO: 205990 - DNA, 217 bp, Homo sapiens
  misc_feature: GYAE6OF02FZVKL.30.25.C03.1.454.CMB.1.raw
  modified_base (104)..(104): a, c, t, g, unknown or other
  misc_feature (104)..(104): n is a, c, g, or t
  modified_base (172)..(172): a, c, t, g, unknown or other
  misc_feature (172)..(172): n is a, c, g, or t
  modified_base (178)..(217): a, c, t, g, unknown or other
  misc_feature (178)..(217): n is a, c, g, or t
tcagcacgctacgtcacgaccggtgctcgatttagtagtgtagatttgggtttggggggaagaggaagactgacggtccccccaggagttcaggtgctgggcanagcggcccttgggctgcctggtcaaggtctacttccacgtagcgtgctggacgcggctaggcaaggcncatagnnnnnnnnnnnnnnnnnnnnnnnnnnnnnnnnnnnnnnnn

SEQ ID NO: 205991 - DNA, 270 bp, Homo sapiens
  misc_feature: GYAE6OF02JOQ9N.30.25.C03.1.454.CMB.1.raw
  modified_base (235)..(270): a, c, t, g, unknown or other
  misc_feature (235)..(270): n is a, c, g, or t
tcagcacgctacgtcacgaccggtgctcgatttagtagtgtagatttgggtttgggtgcccaagctgctggagggcacggtcaccgtctcctcagcctccaccaagggcccatcggtcttccccctggcaccctcctccaagagcactcgtgggggcacagcggccctgggctgcctggtcaacggacttacttccacgtagcgtgctgagcgggctggacgaaggcgacatagnnnnnnnnnnnnnnnnnnnnnnnnnnnnnnnnnnnn

SEQ ID NO: 205992 - DNA, 287 bp, Homo sapiens
  misc_feature: GYAE6OF02HMCIO.30.25.C03.1.454.CMB.1.raw
  modified_base (237)..(239): a, c, t, g, unknown or other
  misc_feature (237)..(239): n is a, c, g, or t
  modified_base (241)..(287): a, c, t, g, unknown or other
  misc_feature (241)..(287): n is a, c, g, or t
tcagcacgctacgtcacgaccggtgctcgatttagtagtgtagatttgggtttgggtgcccaagctgctggagggcacggtcaccgtctcctccagcctccaccaagggcccatcggtcttccccctggcaccctcctccaagagcactctgggggcacagcggccctgggctcgcctggtcaaggactacttccacgtagccgtagctgacgtcgggctggcaaggcgcagtagcnnngnnnnnnnnnnnnnnnnnnnnnnnnnnnnnnnnnnnnnnnnnnnnnnn

SEQ ID NO: 205993 - DNA, 170 bp, Homo sapiens
  misc_feature: GYAE6OF02HK99G.30.25.C03.1.454.CMB.1.raw
  modified_base (156)..(170): a, c, t, g, unknown or other
  misc_feature (156)..(170): n is a, c, g, or t
tcagcacgctacgtcacgaccggtgctcgatttagtagtgtagatttgggtttgggggaagaggaagactgacggtcctgccacagcggccctgggctgcctggtcaaaggactacttccacgtagcgtgctgagcgggctggcaaggcgcatagnnnnnnnnnnnnnnn

SEQ ID NO: 205994 - DNA, 521 bp, Homo sapiens
  misc_feature: GYAE6OF01CG0HB.10.70.G04.1.454.CMB.1.raw
  modified_base (517)..(517): a, c, t, g, unknown or other
  misc_feature (517)..(517): n is a, c, g, or t
tcagcatagtagtgcacgaccggtgctcgatttagtgtagtgtgaagggaaagggggacaatctccagcatggcctggtctcctctcctcctcactctcctcgctcactgcacagggtcctgggcccagtctgtgctgacgcagccgccctcagtgtctgcggccccaggacagagggtcaccgtctcctgctctggaagcgcctccaacattggcacgaattatgtatcctggtaccagcacttccccgggacagcccccaaactcctcatctatgaagattttacgcgaccctcagggattcctggccgattctctggctccaagtcaggcacctctgccaccctggacatcaccggctccagaccggggacgaggccgattatactgcgcaacttgggactcaactgactgttgggctttcggcggaggactaagttgaccgtctacgtcagcccaaggctgcccctggtcactctcgttcccgccctcctccactactatcgctgacgcgggntcgg

SEQ ID NO: 205995 - DNA, 518 bp, Homo sapiens
  misc_feature: GYAE6OF01EHSQU.10.70.G04.1.454.CMB.1.raw
  modified_base (506)..(506): a, c, t, g, unknown or other
  misc_feature (506)..(506): n is a, c, g, or t
tcagcatagtagtgcacgaccggtgctcgatttagtgtagtgtgaagggaaaggggggacaatctccagcatggcctggtctcctctcctcctcactctcctcgctcactgcacagggtcctgggcccagtctgtgctgacgcagccgccctcagtgtctggggccccagggcagagggtcaccatctcctgcactgggagcagctccaacagtcggggcaggttatgatgtacactggtaccagcaacttcccggaacacgcccccacgctcctcatctatggtgacaccaaccggccctcgacggggtccctgagcgattctctggtccaagtctgcacctcgcctccctggccatcactgggctccgaggctgaggatgaggctgtattattactgccacgtcccatgacaacacgcctgagttggtttgggtgttcgggcggacgggaccaagctgaccgtctagtcagcccgaggctcgcccctcggtcactctcgtcccnccctcctctacc

SEQ ID NO: 205996 - DNA, 654 bp, Homo sapiens
  misc_feature: GYAE6OF01BLQP4.10.70.G04.1.454.CMB.1.raw
tcagcatagtagtgcacgaccggtgctcgatttagtgtagtgtgaagggaaaggggggacaatctccagcatggcctggtctcctctcctcctcactctcctcgctcactgcacagggtcctgggcccagtctgtgctgacgcagccgccctcagtgtctggggccccagggcagagggtcaccatctcctgcactgggagcagctccaaacagtcggggcaggttatgatgtacactggtaccagcaacttcccggaacacgcccccacgcctcctcatctatggtgacaccaaccggccctcgacggggtccctgagcgattctcgtgggtaccaagtctggccaccgtcggccctcccgtcggcctactcacgtcggggcctccgaggctaggaggagtggacggtcgtagtaatttattacgtcgcctacgtacccatcgaaccaacagtccctaggtaggttgggttttggggttggttccggggcgggtaacggggaacccgtaacggccgttacggtaaccccggttccgttaacggttaccgacggtaccccgtaaacgggtcccgttacccggcccccccgttcgggttccctaaccgttcccgttacccgtttaccccccacccctttccccgtcccgtaaccc

SEQ ID NO: 205997 - DNA, 564 bp, Homo sapiens
  misc_feature: GYAE6OF01A473D.10.70.G04.1.454.CMB.1.raw
tcagcatagtagtgcacgaccggtgctcgatttagtgtagtgtgaagggaaagggggggacaatctccagcatggcctggtctcctctcctcctcactctcctcgctcactgcacagggtcctgggcccagtctgtgctgacgcagccgccctcagtgtctggggccccagggcagagggtcaccatctcctgcactgggagcagctccaacatcggggcaggttatgatgtacactggtaccagcaacttcccggaacacgcccccacgctcctcatctatggtgaccaccgaaccggccctcgacggggtccctgacgcgtattctcgtgggtccaagtctggccaccgtccggccctcccgtcggccctactccgacgtcgggcctccgaggctggaggatggaggtctgtattattacgtgcctacgtcccatcgaacaacgacgctgagttggtttgggtgttcgggacggtacggaccaagctcgaccgtcgttagtcgacgcccgaggtcctccggcccctcggtccaccgttctccgtcccacccctcctccctac

SEQ ID NO: 205998 - DNA, 672 bp, Homo sapiens
  misc_feature: GYAE6OF01DQP9B.10.70.G04.1.454.CMB.1.raw
  modified_base (154)..(154): a, c, t, g, unknown or other
  misc_feature (154)..(154): n is a, c, g, or t
tcagcatagtagtgcacgaccggtgctcgatttagtgtagtgtgaagggaaagggggggacaatctccagcatggcctggtctcctctcctcctcactctcctcgctcactgcacagggtcctgggcccagtctgtgctgacgcagccgccctnagtgtcgtggggccccagggcagagggtcaccatctcctgcacgtgggagcagctccaaacagtcggggactaggttatgatgtacactggtaccagcaacttacccggaacacgccccagctcctcatctagtggtgacaccgaaccggccctcgaggggtccctgagcgtattctctgggacctaagtctggccaccgtcggccctcccgtggccatccacgtgggccttcgaggtctagggacggtagtaggacggccttagtaactttaattacgtcgaccgtacgtccccaagttacgaaaccaaacgacgtccttaggtacggttgggttttggggtcggtttaccgggcggggtaacgggaacccgtaaaggtccgttacggacccggtttcccgtttaaggtcccgtaacggtaccccgtaaagggtcccttaccggtcccccccgttccgggtaccctaacccgttccgttacccgttcccccggtccccttccccttcccgttaaccc

SEQ ID NO: 205999 - DNA, 696 bp, Homo sapiens
  misc_feature: GYAE6OF01DDUVY.10.70.G04.1.454.CMB.1.raw
tcagcatagtagtgcacgaccggtgctcgatttagtgtagtgtgaagggaaagggggggacaatctccagcatggcctggtctcctctcctcctcactctcctcgctcactgcacagggtcctgggcccagtctgtgctgacgcagcccgccctcagtgtcgtggggccccaggggcaggagggtcaccatctcctgcacgtggggagcagctaccaacagtcgggggcaggttatgatgtacacgtggtaccagcaaccttcccggaacacgcccccacgctcctcatctatggtcaccacccaaccggccctcgacggggtccctgagcgtattctcgtcgggtccaagtctggcaccgtccggccctccgtcggccactccacgtcgggctccgaggtcgtggacggagttggacggcgttacggtaatttactttaccgtacgtccaccggtttccccaagttcgaaaccaacgtacgtcctacgggttaggtttgggttttcggggttcgtttccgggggaccggggtacggggaaccctaaagggtccgttacggtaaccccggtttccgtttaacggttaccgaaccgggtaccccgaaacgggtcccttcccggtaccccccggttcgggtaccctaccgtttccgtttccccgttaccccgtaaccccccttcccttaccctaaccc

SEQ ID NO: 206000 - DNA, 615 bp, Homo sapiens
  misc_feature: GYAE6OF01DUMBC.10.70.G04.1.454.CMB.1.raw
  modified_base (202)..(202): a, c, t, g, unknown or other
  misc_feature (202)..(202): n is a, c, g, or t
  modified_base (287)..(287): a, c, t, g, unknown or other
  misc_feature (287)..(287): n is a, c, g, or t
  modified_base (440)..(440): a, c, t, g, unknown or other
  misc_feature (440)..(440): n is a, c, g, or t
tcagcatagtagtgcacgaccggtgctcgatttagtgtagtgtgaagggaaagggggggacaatctccagcatggcctggtctcctctcctcctcactctcctcgctcactgcacagggtcctgggcccagtctgtgctgacgcagccgccctcagtgtctggggccccagggcagagggtcaccatctcctgcactgggancagctccaacagtcggggcaggttatgatgtacactggtaccagcaacttccggaacacgcccccacgctcctcatctagtggtnaccaccaaccggccctcgacggggtccctggacgcgtatttctcgtcgggtaccaagtctggctacttctcgcctccctgtcatctctggtctccgagggtgaggtatgaggtctgtaactttattacgtcgacctacttcctatcgacaacncgtccttagtacgtttatttcggtcttcgggtccgggtcgggccgggtaacctaaggtttcgacccggttacccgttacgccaccggtccccgtaaggtcccttacccggtccccccgttacgggtccttaacccgttccttacccggttcccctccccttcccgtctaaacccg

SEQ ID NO: 206001 - DNA, 647 bp, Homo sapiens
  misc_feature: GYAE6OF01E0D69.10.70.G04.1.454.CMB.1.raw
  modified_base (357)..(357): a, c, t, g, unknown or other
  misc_feature (357)..(357): n is a, c, g, or t
tcagcatagtagtgcacgaccggtgctcgatttagtgtagtgtgaagggaaagggggggacaatctccagcatggcctggtctcctctcctcctcactctcctcgctcactgcacagggtcctgggcccagtctgtgctgacgcaaccgccctcagtgtctggggccccagggcagagggtcaccatctcctgcactgggagcagctccaacatcggggcaggttatgatgtacactggtaccagcaacttcccggaacacgccccacgctcctcatctatggtgaccaccaaccggcctcgacggggtccctgagcgattctcgtcgggtccaagtctcggcacctcggcctcccnggccatcacgtgggcctccgaaggctggaggagtggaggtctgatttaacttactcgcctacgtcccagtacgaacaaacgagtcccgtaggtacggttgggttttcggggttcgggtttccgggccggggaacggggaaccgaaggtccgtacggtacccgttaccgttaacggtccaaccggaccccgaaacggtcccgttacccggtcccccccggttcgggtaccctaccgttcccgttccggtttccccccgaccccgtttccccttaccccaacgtttaacccg

SEQ ID NO: 206002 - DNA, 852 bp, Homo sapiens
  misc_feature: GYAE6OF01AO6ME.10.70.G04.1.454.CMB.1.raw
tcagcatagtagtgcacgaccggtgctcgatttagtgtagtgtgaagggaaaggggggggacaatctccagcatggcctggtctcctctcctcctcactctcctcgctcactgcacagggtcctgggcccagtctgtgctgacgcagccgccctcagtgtctggggccccagggcaggagggtcaccatctcctgcactgggagcagctccaacagtcggggcaggttatgatgtacacgtggtaccagcaaccttcccggaacacgcccccacgcctcctcatctatggtcgaccaccgaaccggccctcgacggggtccctggacgcgtattctcgtgggtaccaagtcctggccacccgtccggtcccctcccgtcggaccctatccgacggtcggggtacctcccggacgggtccttagggacgggtacgtagggaacgggtcgttaggttaacgttttaacgtttaaaccgtccggtaccccgtaaccggttacccccgtaaacgttaacccggaaacccgtaaacccggtaccggtaccccggtttagggttaacggggtttttcggggtttttaacggggggtttcggggtttacccggggggtaaccgggggtaaaccgggggtaaacccgtaaacgggttacccggttaccgggttaaccccggtttacccgtttacgggttaaccccgtacccgggtaacccccggtaaaccggggtccccgttaccccgggtcccccccccggttaccgggttaacccccgttaccccgtttccccgggtttacccccggtttccccccccgttccccccgtttcccccgttacccccgtttaaaccccgg

SEQ ID NO: 206003 - DNA, 704 bp, Homo sapiens
  misc_feature: GYAE6OF01DAY1X.10.70.G04.1.454.CMB.1.raw
tcagcatagtagtgcacgaccggtgctcgatttagtgtagtgtgaagggaaagggggggacaatctccagcatggcctggtctcctctcctcctcactctcctcgctcactgcacagggtcctgggcccagtctgtgctgacgcagccgccctcagtgtcgtcggggccccagggcaggacgggtcaccatctcctgcacgtgggagcagctaccaacagtcggggcaggttatgatgtacagtggtaccagctaaccgttcccggaaccacgccccacgtcctcctcaacttctagtggtacgaaccaaccgaacccgccctacgacggggtccctgacgtcgtacttcctcgtacgggtacctaaggtcgtcgggccctacccgtccgggaccccttcccgtcggaccctaacgttccgaccggttcgggccctaccggaggtcgtgggagtacggtggacggtccttaggtactttaagtttaccgtcgaccgtacgtacccgatacgaaccaacgtacgccgttggtagggtttggtttcggggttacggttcggggacggggtaacggaacccggtaacgtacggtaccggtaccgtttaccgttacgtcgaccggacccgaacggtcctcccggtcccccgtcggttacctaccgttacccttacccgttacccctacccccttccctcccttaaacg

SEQ ID NO: 206004 - DNA, 660 bp, Homo sapiens
  misc_feature: GYAE6OF01D92XV.10.70.G04.1.454.CMB.1.raw
  modified_base (205)..(205): a, c, t, g, unknown or other
  misc_feature (205)..(205): n is a, c, g, or t
  modified_base (216)..(216): a, c, t, g, unknown or other
  misc_feature (216)..(216): n is a, c, g, or t
  modified_base (231)..(231): a, c, t, g, unknown or other
  misc_feature (231)..(231): n is a, c, g, or t
  modified_base (377)..(377): a, c, t, g, unknown or other
  misc_feature (377)..(377): n is a, c, g, or t
tcagcatagtagtgcacgaccggtgctcgatttagtgtagtgtgaagggaaagggggggacaatctccagcatggcctggtctcctctcctcctcactctcctcgctcactgcacagggtcctgggcccagtctgtgctgacgcagccgccctcagtgtcgtcggggccccagggcagagggtcaccatctcctgcacgtgggancagctccaacngtcggggcaggttangatgtacagtcggtaccagcaaaccttacccggaacacgcccccacgcctcctcattcctagtcggtcgaaccacccgaacccggtccctcggacggggttccccagacgcgtattctcgtcggtcctaagtcgtacggaaaaccnccggccctcccgttagactaacttctcgtcgggtcctccgaggcctggaaccgacgacggacgtagtaaattacgttacgtcgcgtaatcgtactaagtacgttagtacgtagttcgggtcgttaccgtttccgttttacggttaacgggttttaccgggaccggggtagggtaccgacggtcgtacgtacccgttaccgtacgtacgaccgacccgaacggtccgtacccgtccccgtcgtcctaccttccgtccgtacccctcccttccctcctacttacg

SEQ ID NO: 206005 - DNA, 1081 bp, Homo sapiens
  misc_feature: GYAE6OF01DNQQH.10.70.G04.1.454.CMB.1.raw
tcagcatagtagtgcacgaccggtgctcgatttagtgtagtgtgaagggaaagggggggacaatctccagcatggcctggtctcctctcctcctcactctcctcgctcactgcacgagggtcctgggcccagtctgtgctgacgcagccgccctcagtgtctcggggcccccagggcaggagggtccaccatctcctgcacgtgggagctacgcctaccaacgacgtcggggactaggttatgatacgtacgacgtcggtaccagtacctaaccgttacccggaaccaccgaccccccgacgtcccttcctactacgttctacgttcgggtaccgacctaaaccccggaaacccggtcccccgttacgggtaaccgggggttccctagggacggtaccggttacgttttccgttaccggttccggggtacctaaacggttccggtacggtacccctaccgtcccggggttacccctcccggttaccggtaccctacgttcccgtaaccgggttccgggtaccctttaccgggacgggttacccgttaaggggtacgggtaacgttacggggtacgggttaccgtttaacgggttaactttttaaaccggttttaccgtaacccggtaccccggttaaacccggtttacccccgtaaaggttaccgggaaaaacccgtaacccggttaacccgggtttacccggttttaaacggggtttcggggttttttacggggggttttttaacccggggggttttaccggggtttacccccggggggggtaaccgggggttaaaccccggggtaaaaccccggtttaacccgggttacccggtttacccgggttaaacccccgggttttaaccccggttttacccgggtaaaccccggttaaaccccgggaccccccggggttaaaaacccggggtccccccggttttaccccccgggttcccccccccgggttttacccgggttaccccccggtttaacccgttttaccccccggttttacccccggttaacccccccccccttttaacccgtttaccccccccgttaactttttaaaaccccccgg

SEQ ID NO: 206006 - DNA, 732 bp, Homo sapiens
  misc_feature: GYAE6OF01D1WPN.10.70.G04.1.454.CMB.1.raw
  modified_base (155)..(155): a, c, t, g, unknown or other
  misc_feature (155)..(155): n is a, c, g, or t
  modified_base (207)..(207): a, c, t, g, unknown or other
  misc_feature (207)..(207): n is a, c, g, or t
  modified_base (220)..(220): a, c, t, g, unknown or other
  misc_feature (220)..(220): n is a, c, g, or t
  modified_base (236)..(236): a, c, t, g, unknown or other
  misc_feature (236)..(236): n is a, c, g, or t
  modified_base (389)..(389): a, c, t, g, unknown or other
  misc_feature (389)..(389): n is a, c, g, or t
tcagcatagtagtgcacgaccggtgctcgatttagtgtagtgtgaagggaaaggggggacaatctccagcatggcctggtctcctctcctcctcactctcctcgctcactgcacgagggtcctgggcccagtctgtgctgacgcacgccgccctnagtgtcgtcggggcccagggcaggaggtcacctatcctcctgcacgtgggancagtctaccaacnggtcgggctaggttangatgtacacgttcggaaccagactaaccgttacccggaacaccgcccccacgtcctcctacacttctaagtcggtacgaaccaacccgaacccggtccctcggacggggtccctaggacgcgtatttcctcgtcggtaccaagtcgtggaccnccgtccggccctaccgtcggcctaactccgacgtcgggcctccggaggtcgtaggacggtagtggacggtcttagtaacttttaacttcgtaccgtaccgtaccgtacccgtaagtaccggaacaacgtcgtacccgttaggtaggttttgggtttggggttcggttaccggggacggggtaaccggtaaccgtaaggtccgttcggtaacccgttccgtttaacgtaccgaccggtaaccccgacgggttccctccccggttccccccgttacggtacccttaaccggtttcccgtttaccccgttaccccccgttaccccttccccgttaccttaaacccg

SEQ ID NO: 206007 - DNA, 781 bp, Homo sapiens
  misc_feature: GYAE6OF01AW3D3.10.70.G04.1.454.CMB.1.raw
tcagcatagtagtgcacgaccggtgctcgatttagtgtagtgtgaagggaaagggggggacaatctccagcatggcctggtctcctctcctcctcactctcctcgctcactgcacagggtcctgggcccagtctgtgctgacgcagccgccctcagtgtctggggccccagggcagagggtcaccatctcctgcactggggagcagctccaacagtcggggcaggttatgatgtacactggtaccagcaacttcccggaacacgccccacgctcctcatctagtggtcgaccacccgaaccggccctacgacggggtccctggacgcgtactttccgtcgttagggtacccaaggtcctacgggccctacccgtccgggaccccttcccgttcgggccctacttaccgaaccggttcggggaccttacccggagggtccgttaggacgggtagttcgggacggtcttaggtaacttttacgttaccttcggaccctaacgtcccctaagttacgaacccaaacgtaccgtccgtttaggtaacgggttttcggggttttacgggggttacgggtttacccggggacgggggtaacggggtaacccgtaacgggttacccgttaccgggtacccgtttacccggtttacggtacccggtaacccgggtaccccggtaaacgggttcccgtccccgggtcccccccgttacgggttcccctacccgtttacccgtttaccccgtttacccccctaacccctttccccgtacccgttaaacccg

SEQ ID NO: 206008 - DNA, 832 bp, Homo sapiens
  misc_feature: GYAE6OF01DRDO6.10.70.G04.1.454.CMB.1.raw
  modified_base (211)..(211): a, c, t, g, unknown or other
  misc_feature (211)..(211): n is a, c, g, or t
tcagcatagtagtgcacgaccggtgctcgatttagtgtagtgtgaagggaaaggggggacaatctccagcatggcctggtctcctctcctcctcactctcctcgctcactgcacgagggtcctgggcccagtctgtgctgacgcacgcccgcctcgagtgtcgtcggggccccagggcaggacggtcacctatcctcctgcacgtgggacncacgcctaccaacgcggtcggggctaaggttatgagtacgtacacgttacgtacacgtaccgtaacccgttacccggaacctacccgacccccgacgtcccttcctactacgttaccttaggtccggttacgaacccgtaacccgaccccggtacccgtcgggtaccgggtcccgtaggacggtcgttacttccgttacgtacggtaacctacggttcccgtacggaccccgtaccggtcccgtcccgttacccggtcgtaccctaacgttcccggtaacggtcccgggtaccttaccggtacgggtacccgtaaggggacggtacggtacgggtacggttaccggtttaacttacggttttaacttaccggtaacgtaccccgttaacccgtaccctaagttaaccgaaacccgtaaccgtaacggttccgttaagggttacgggttttcggggtttcggttacggggttaccgggaacggggtacggaaacgtacggtccgtaccgttacgttaccggtacgtaccggaccgtacccggacgtcccgtaccccggtaccccgttggtaacccgttccgttcccgttaccccgtccccgtcccttaccgccgttaaaccg

SEQ ID NO: 206009 - DNA, 872 bp, Homo sapiens
  misc_feature: GYAE6OF01A8QQV.10.70.G04.1.454.CMB.1.raw
  modified_base (211)..(211): a, c, t, g, unknown or other
  misc_feature (211)..(211): n is a, c, g, or t
tcagcatagtagtgcacgaccggtgctcgatttagtgtagtgtgaagggaaagggggggacaatctccagcatggcctggtctcctctcctcctcactctcctcgctcactgcacagggtcctgggcccagtctgtgctgacgcacgccgccctcagtgtcgtcggggccccagggcaggacgggtccaccatcctcctcgcacgtgggancacgcctaccaacgtacggtcgggggactaagggtttactaggtattacgtaccgtaccgttacggtaacccgacgtaccgtaaaccgttaccccggaaacctacccgaccccctacgtcctcctactaacttcgttacgtcggtaccgaacccaccccggtaaccccggtcccgtaccggtaccggggttccctacggtaacccgttactttccgtccgttacggtacccttaaccgtacgtcccgtccggaccctacccctaccggtacccgtccccgttccccgtacggtaccctaacgtcccggtaacggggtcccgggtccccggtacccggggttaccggaacgggttacgtacggtaacccggttcgtttaacggttaacttttacggtttacggttacggttacggtaacgtcgttaaggggttacgggtaacgtacgtaaccggtacgtccggttaggtacgttacgttgtttacggttccggttaccgggttaaccgggtaacggtaccggtaaccgttacccggtaccgttacccggttaccgtaccggtaccgaacccggtaaccccgtaaccggaaccccctaacccgtacttaccgacccttacccgttccccgttccccgtaccccgtccccttacccgtaacccg

SEQ ID NO: 206010 - DNA, 790 bp, Homo sapiens
  misc_feature: GYAE6OF01CA5R7.10.70.G04.1.454.CMB.1.raw
  modified_base (196)..(196): a, c, t, g, unknown or other
  misc_feature (196)..(196): n is a, c, g, or t
  modified_base (208)..(208): a, c, t, g, unknown or other
  misc_feature (208)..(208): n is a, c, g, or t
  modified_base (244)..(244): a, c, t, g, unknown or other
  misc_feature (244)..(244): n is a, c, g, or t
  modified_base (562)..(562): a, c, t, g, unknown or other
  misc_feature (562)..(562): n is a, c, g, or t
  modified_base (686)..(686): a, c, t, g, unknown or other
  misc_feature (686)..(686): n is a, c, g, or t
tcagcatagtagtgcacgaccggtgctcgatttagtgtagtgtgaagggaaaggggggacaatctccagcatggcctggtctcctctcctcctcactctcctcgctcactgcacgagggtcctgggcccagtctgtgctgacgcacgccgccctcagtcgtcgtcggggccccagggcaggacggtcaccatctcngcacgtgggacncacgcctaccaacgtaggtccggggataggtttacnggattacggtacacgttagaacccgagaccgaaccgttcccggaacaccgaccccacgtcctacctctaactcgtagttaggaccgaaccaaccgaaccccggtccgtaccggacgggtcccctaggactacgtacgttctacgggtcgtaccgtaactcggttaccgaccgaccccgttccggacccgttcccgacggccctaacgtaccgtacggttcggccttacgaggttaccgagtagggtacgtggtacggtacctaggttaattacggttaccgtcgtaaaccctcgaccgtacgtaacgaaccgtaaccncgtaccggtaggtttaccggttgggtttacgggttgggttaccggggacgggtaaccgggtacgtaaacggtcccggtacggtaccccgttaccggtttagacccggtacccggtaaacccggnggttaccccggtaccccgggttcccccgtacgggttcccttaaccccggttccgtttacccccgggtaccccccttcccttaccccctaacccgtttaacccgg

SEQ ID NO: 206011 - DNA, 899 bp, Homo sapiens
  misc_feature: GYAE6OF01EUKBZ.10.70.G04.1.454.CMB.1.raw
  modified_base (597)..(597): a, c, t, g, unknown or other
  misc_feature (597)..(597): n is a, c, g, or t
tcagcatagtagtgcacgaccggtgctcgatttagtgtagtgtgaagggaaaggggggacaatctccagcatggcctggtctcctctcctcctcactctcctcgctcactgcacgacgggtcctgggcccagtctgtgctgacgcgacgccccgtcctcgagttcgtaccggtccggggccccgagggccgaaggacgggtacccaacctattcccgtccgtcgccgacgggtaggacgaccgacgacctaccaacgtacggtacggggaccttaggttacgtagtaacgttacgtaccgtaacgtaccggtaacctacggaacccgtaacccgttacccggaaaccctaccccggaccccctaccggtccttacctaaccttcgttaccgttacggtttacggggacccaaaaccccggtacccccggtaaccccggtaccccggttacccgggtacccggggttacccgtacggtacggttaccgttaacggtttcccgttcgggttaccgggtaaccttaacggttcccgtccgtacccgtacccgtccgtcccgtccgtcgacctacgtccgtacgacgggtcctacgtacgnggtaacggaggttgaccggtaacggttcgtacttaacgttaacgtacgtcgaccgtacgttcttacgaaacgtttcccgtaaccgacccggtttaacccgggagtttacggggttccggtaggggacccgggttaacggtaacccgggttacgggttaaccggttcccccggttcgggtacccggtaaccggtacccgaaccggttccccgcggttaccccccgtcccgttacgtcctttacccggttccccgtacccgttccccctaccgtttcccaacgtttacccgacgttcgtcccgg

SEQ ID NO: 206012 - DNA, 500 bp, Homo sapiens
  misc_feature: GYAE6OF02HSXLM.10.70.G04.1.454.CMB.1.raw
  modified_base (411)..(411): a, c, t, g, unknown or other
  misc_feature (411)..(411): n is a, c, g, or t
tcagcatagtagtgcacgaccggtgctcgatttagtgtagtgtgaagggaaagggggacaatctccagcatggcctggtctcctctcctcctcactctcctcgctcactgcacagggtcctgggcccagtctgtgctgacgcagccgccctcagtgtctggggccccagggcagagggtcaccatctcctgcactgggagcagctccaacatcgggggcaggttatgatgttcattggtaccgccaggttccaggcacagcccccagactcctcattaatgataacaacaatcggccctcagggtctctgaccgattctctgcctccaagtctggcacttctgcctcctggtcatatctggtctccagggtgaggatgaggctgattattactgccactcctatgacaacngcctgagtattggctgttcggcgagggaccaggctgaccgtctaagtcagcccaaggctgccccctggtccactctcgttccctacccc

SEQ ID NO: 206013 - DNA, 528 bp, Homo sapiens
  misc_feature: GYAE6OF02H4F7X.10.70.G04.1.454.CMB.1.raw
  modified_base (279)..(279): a, c, t, g, unknown or other
  misc_feature (279)..(279): n is a, c, g, or t
  modified_base (319)..(319): a, c, t, g, unknown or other
  misc_feature (319)..(319): n is a, c, g, or t
  modified_base (364)..(364): a, c, t, g, unknown or other
  misc_feature (364)..(364): n is a, c, g, or t
  modified_base (421)..(421): a, c, t, g, unknown or other
  misc_feature (421)..(421): n is a, c, g, or t
  modified_base (442)..(442): a, c, t, g, unknown or other
  misc_feature (442)..(442): n is a, c, g, or t
  modified_base (459)..(459): a, c, t, g, unknown or other
  misc_feature (459)..(459): n is a, c, g, or t
  modified_base (513)..(513): a, c, t, g, unknown or other
  misc_feature (513)..(513): n is a, c, g, or t
tcagcatagtagtgcacgaccggtgctcgattagtgtagtgtgaagggaaaggggggacgaagtctccagcatggcctggtctcctctcctcctcactctcctcgctcactgcacagggtcctgggcccagtctgtgctgacgcagccgccctcagtgtctggggccccagggcaggagggtcaccatctctgcactgggagcagctcaacatcggggcaggttatgactgtacatggtacagcaacttccggaacagccccagctctcatcgtatggnacaccaaccggtccctcgaggggtccctggagcgtattcncgttgggaccaaggtcctggcaccctcggcccttccaggcctaanccactggggcctccgaggctggagatgaggctgattagtactgccagtcccagtcanaacagctgacgttgttgggtntcggcggagggaaccanccgtgacctcttagctagccaaggcctcgccccttcggcactccttgtaccccncctccctctaacccg

SEQ ID NO: 206014 - DNA, 910 bp, Homo sapiens
  misc_feature: GYAE6OF02G5NJK.10.70.G04.1.454.CMB.1.raw
tcagcatagtagtgcacgaccggtgctcgatttagtgtagtgtgaagggaaaggggggacaagtctccagcgatggcctggtctccgtactcctcctcactcgtcctcgcctcactgcaccacggtcctgggtcccagtctgtgctgacgcacgccgccctcagtgtctgggccccagggccaggagggtcaccgatcctccgtgcactgggacgcgagcctaccaacagtccggggcagggttatgatgtactacgtcggtaaccaagtcctaaaccgttccccggaaactaccggaccccccaacgcctaacccgtccaacgttcctaacgtccggtacgtaaccctacccgtaaacccggcccttacgaacgggggttcccctaggacgaccgtaacgttcccgtaccgttcggggtaccctaaggttccgtaggacctaacccgttccgaacggtcccccttccccgtacgggcccctaacgttaccggaacgggttccgggggtcccgttaccccggggttacccggtaagggtaaccttcgggaacccggtcggttacggggtaaaccgttttaacgggtttacccgttagggttacgggttaaccgggtaccgtaagggttacgggggtaactttacgggtaaccgttaccgggtccccgttaggtaacgggtttcgttaccgttttaacggttcgggttttaaccgttttaccggggaaccgtttcgggggaaaccccgtaaacggggttacccgaaccccggtttaccgttaccggttaccgaacccgggtaccccccgtaaacgggtacccccctaaacccccgtacggttacccggtacccgtaacccgttccccgtttaccccggtttccccccaaccccgtttccccgttaaccccg

SEQ ID NO: 206015 - DNA, 523 bp, Homo sapiens
  misc_feature: GYAE6OF02HH73J.10.70.G04.1.454.CMB.1.raw
tcagcatagtagtgcacgaccggtgctcgatttagtgtagtgtgaagggaaagggggggacaatctccagcatggcctggtctcctctcctcctcactctcctcgctcactgcacagggtcctgggcccagtctgtgctgacgcagccgccctcagtgtctggggccccagggcagagggtcaccatctcctgcactgggagcagctccaacatcggggcaggttatgatgtacactggtaccagcaacttcccggaacagcccccacgctcctcatctatggtgacaccaaccggccctcaggggtccctgagcgattctctgggtccaagtctggcacctcggcctcctggccatcactgggctccaggctgaggatgaggctgattattactgccagtcccatcgacaacagcctgagttgtttgggtgttcgggcggagggaccaagctgaccgtcttagtcagcccgaaggcctcgcccctcggtccacttcctccgttccccgcccttcctcctacc

SEQ ID NO: 206016 - DNA, 552 bp, Homo sapiens
  misc_feature: GYAE6OF02IW7C4.10.70.G04.1.454.CMB.1.raw
  modified_base (346)..(346): a, c, t, g, unknown or other
  misc_feature (346)..(346): n is a, c, g, or t
  modified_base (429)..(429): a, c, t, g, unknown or other
  misc_feature (429)..(429): n is a, c, g, or t
tcagcatagtagtgcacgaccggtgctcgatttagtgtagtgtgaagggaaagggggggacaatctccagcatggcctggtctcctctcctcctcactctcctcgctcactgcacagggtcctgggcccagtctgtgctgacgcagccgccctcagtgtctggggccccagggcagagggtcaccatctcctgcactgggagcagctccaacatcggggcaggttatgatgtacactggtaccagcaacttcccggaacacgcccccacgctccctcatctatggtgacacccaaccggccctcgacggggtccctggagcgattctcgtgggtccaagtctggcncctcggcctcctggccatcactgggcctccgaggctggaggagtggaggctgatttattactgaccacgtcccatcgacaacncgcctgagttgtttgggtgttcggcgggagggaccaagcgtagtaccgttcgttagtacacgcccgaaggtcctcggccccgtcggtccacttccgtccgttccccgcccttccctacctacc

SEQ ID NO: 206017 - DNA, 597 bp, Homo sapiens
  misc_feature: GYAE6OF02FXSLE.10.70.G04.1.454.CMB.1.raw
tcagcatagtagtgcacgaccggtgctcgatttagtgtagtgtgaagggaaagggggggacaatctccagcatggcctggtctcctctcctcctcactctcctcgctcactgcacagggtcctgggcccagtctgtgctgacgcagccgccctcagtgtctggggccccagggcagagggtcaccatctcctgcactgggagcagctccaacatcggggcaggttatgatgtacactggtaccagcaacttcccggaacacgcccccacgctcctcatctatggtagacaccaaccggccctcgacgggtccctgacgcgattctcgtgggtccaagtctggcaccgtcggcctccgtggccatcacgtgggctccgaggctggagatgaggctgtattattacgtcgccacgtcccatacgacaacacgtcctgtaggttggttttggggttcggttccggggacggggacgggaaccgaaggtccgtacggtacccgttaccgtttacgtccgacggacccgaacggccttaccggtccccccgttcggttcctaccgttccgttccgttcccctaccccttccctaccctaacc

SEQ ID NO: 206018 - DNA, 742 bp, Homo sapiens
  misc_feature: GYAE6OF02GLLVZ.10.70.G04.1.454.CMB.1.raw
tcagcatagtagtgcacgaccggtgctcgatttagtgtagtgtgaagggaaagggggggacaatctccagcatggcctggtctcctctcctcctcactctcctcgctcactgcacagggtcctgggcccagtctgtgctgacgcagccgccctcagtgtctggggccccagggcagagggtcaccgtctcctgctctggaagcgcctccaacattggcacgaattatgtatcctggtaccagcacttccccgggacacgcccccaaactcctcatctatgaagtattttacgcgtaccctcgagggtacttccgtggccgtattcctctggctccaagtcaggccacctctcgccctacccgtggaccagtaccgacccgggctacccgaacggacccgggggacgacggccgtaatttacgttaccgtcggaccgaccgtaaacggtttcggggaccttacccgaaaccgttggtaaccgttgggtttcgggggtccgttttccggggacgggtaacggggtaacgtttaacggtttcgggtaacccggtttcccgtaacggttcccgaaccggtaccccgaaagggtcccttacccggtcccccccgttacgggttaccctacccgtttccgtttacccggtttaccccccgtaacccctttaccccgttacccctaaccctttaaccttacgttccggtaccgttccggacggtcccggggtaccgttcgggaacccgg

SEQ ID NO: 206019 - DNA, 685 bp, Homo sapiens
  misc_feature: GYAE6OF02I301V.10.70.G04.1.454.CMB.1.raw
  modified_base (212)..(212): a, c, t, g, unknown or other
  misc_feature (212)..(212): n is a, c, g, or t
tcagcatagtagtgcacgaccggtgctcgatttagtgtagtgtgaagggaaaggggggacaatctccagcatggcctggtctcctctcctcctcactctcctcgctcactgcacagggtcctgggcccagtctgtgctgacgcagccgccctcagtgtctggggccccagggcagagggtcaccatctcctgcactgggagcagctccaacngtcggggcaggttatgatgtacactggtaccagcaacttcccggaacacgccccacgcctcctcatctagtggtcgaccaccgaacccggccctcgacggggtccctgacgcgtattctcgtggtaccaagtctggccaccgtcgcctcccgtggcctatcgacgtcgggcctccgaggtcctagaggatggagtctagtatttacttacgtcgtacctacgtccctaagtacgaaccaacgtacgtccgtaggtacgggtttgggttttaggggttcggtttacggggaccgggtaacggggtaaccctaacgggtccgttacggtaacccggtttaccgtttacggtacccgaccggtaaccccggtaacgggtcccgttacccggtacccccccgtttacggtacccttacccgtttcccgtttaccccggtttaccccccgaccccctttcccgttaccccttaacccg

SEQ ID NO: 206020 - DNA, 520 bp, Homo sapiens
  misc_feature: GYAE6OF02F7L2H.10.70.G04.1.454.CMB.1.raw
  modified_base (415)..(415): a, c, t, g, unknown or other
  misc_feature (415)..(415): n is a, c, g, or t
  modified_base (514)..(514): a, c, t, g, unknown or other
  misc_feature (514)..(514): n is a, c, g, or t
tcagcatagtagtgcacgaccggtgctcgatttagtgtagtgtgaagggaaagggggggacaatctccagcatggcctggtctcctctcctcctcactctcctcgctcactgcacagggtcctgggcccagtctgtgctgacgcagccgccctcagtgtctggggccccagggcagagggtcaccatctcctgcactgggagcagctccaacatcggggcaggttatgatgtacactggtaccagcaacttcccggaacagcccccacgctcctcatctatggtgacaccaaccggccctcaggggtcccctgacgcgattctctgggtccaagtctggcacctcggcctccctggccatcactgggctccagctgaggatgaggctgattattactgccagtcccatgacaacngcctgagtgtttgggtgttcggcggagggaccaagctgaccgtcttagtcagcccgaaggctcgcccccttcggtccactcctgttccccacccttccnctaacc

SEQ ID NO: 206021 - DNA, 535 bp, Homo sapiens
  misc_feature: GYAE6OF02IG9D6.10.70.G04.1.454.CMB.1.raw
  modified_base (421)..(421): a, c, t, g, unknown or other
  misc_feature (421)..(421): n is a, c, g, or t
  modified_base (441)..(441): a, c, t, g, unknown or other
  misc_feature (441)..(441): n is a, c, g, or t
  modified_base (525)..(525): a, c, t, g, unknown or other
  misc_feature (525)..(525): n is a, c, g, or t
  modified_base (531)..(531): a, c, t, g, unknown or other
  misc_feature (531)..(531): n is a, c, g, or t
tcagcatagtagtgcacgaccggtgctcgatttagtgtagtgtgaagggaaaggggggacaatctccagcatggcctggtctcctctcctcctcactctcctcgctcactgcacagggtcctgggcccagtctgtgctgacgcagccgccctcagtgtctggggccccagggcagagggtcaccatctcctgcactgggagcagctccaacatcggggcaggttatgatgtacactggtaccagcaacttcccggaacacgcccccacgctcctcatctatggtcgacaccaaccggcctcgacggggtccctgacgcgtattctcgtgggtccaagttctggccaccgtcggccctccccgtggcccatccacgtcgggcctccgaggcctggaggagtggaggctgtactttattacgngccagtcccattcgacaacngcctgagttggtttggtggtcggcggacggacagtctcgaccgttcttagcacgccgaggctcgccccgtgcactctcgtcccncctccnctac

SEQ ID NO: 206022 - DNA, 798 bp, Homo sapiens
  misc_feature: GYAE6OF02JMAAV.10.70.G04.1.454.CMB.1.raw
  modified_base (358)..(358): a, c, t, g, unknown or other
  misc_feature (358)..(358): n is a, c, g, or t
tcagcatagtagtgcacgaccggtgctcgatttagtgtagtgtgaagggaaaggggggacgaatctccagcatggcctggtctcctctcctcctcactctcctcgctcactgcacagggtcctgggcccagtctgtgctgacgcagccgccctcagtgtcgtcggggccccagggcgaggagggtcaccatcctcctgccacgtgggacgcgagcctaccaacaggtccgggggctagggttatagattcggtaccagttcggtaccagactaaccgttacccggaaccaccggacccctaccgcctcctcactctatgtagacgacccgtaaccggccctcgacgggtccctgacgngtacttctcgtcggtaccgaagtcgtcggaccaccctcgggtccctcccgtacgggccctagtccgtacgtccggggtcccttccggacggtcgttgggaacggtacgtacgggtagccgttcggtaatttacgtttaactacggaccctacgttccctacgttaacgaaccctaaaacgtacggtaccttagggtaaccgtttgggttttccggggtttacgggtttacccggggacgggggtaaccggggtaaccgtaaccgggtacggttaccggttaacccgttccggtttaacccgttcggtaacccggtacccgggtaacccggttacccggtcccgggtaccccccgtttaccgggggtacccttacccgggttacccctttcccggttacccccgttacccccccgtttcccgtaccccgtttaacccccgg

SEQ ID NO: 206023 - DNA, 661 bp, Homo sapiens
  misc_feature: GYAE6OF02IQVE7.10.70.G04.1.454.CMB.1.raw
  modified_base (344)..(344): a, c, t, g, unknown or other
  misc_feature (344)..(344): n is a, c, g, or t
tcagcatagtagtgcacgaccggtgctcgatttagtgtagtgtgaagggaaagggggggacaatctccagcatggcctggtctcctctcctcctcactctcctcgctcactgcacagggtcctgggcccagtctgtgctgacgcagccgccctcagtgtctggggccccagggcagagggtcaccatctcctgcactgggagcagctcaacatcggggcaggttatgatgtacactggtaccagcaacttcccggaacacgcccccacgctcctcactctatggtacgaccaccaaccggccctcgacggggtccctgacgcgtattctcgtgggtaccagtcnggcacctcggcctccgtggccatcacgtgggcctcgaggctggaggtatggaacggcttaggtatttaacttacgtcggaccctacgtcccctaagttacgaaaccaaaccgacggtcccgttaggacgggttttgggtttggggttcggtttccggggacggggtaacgggaacccgtaaaggtcgttaccccccggaggtttacccgtagggtaccaacggaccccggtaaagggtccctaccggtccccccgttcggttacctacccgttccgttacccggttacccccacccctttcccgtacccttaacccg

SEQ ID NO: 206024 - DNA, 815 bp, Homo sapiens
  misc_feature: GYAE6OF02F83K0.10.70.G04.1.454.CMB.1.raw
tcagcatagtagtgcacgaccggtgctcgatttagtgtagtgtgaagggaaagggggggacaatctccagcatggcctggtctcctctcctcctcactctcctcgctcactgcacagggtcctgggcccagtctgtactgacgcagccgccctcagtatcgtggggccccagggcagagggtctcatctctgcactgggagcagaaccagcatcggggcaggttatgatgttacagttacggtaccgaccgtacggttccgacgggcaacgaccgcccccgagacctcctactaacttaagtagaactaaaccaaacaaacgtccggcccttacggacggggttctccgtacggaccgtactttctccgtcgtacccttaccgtaagtcctacggacctactttctccgtcccttccccgttggttacctaactttacgttacccgttcgggttccgttacccgggaacggggttacggaaggttacgtagggaacgggtcgttagtaattttaacgtttaccgttaccgacccttacctaccgttaagttaaccggaacctaaaccgtacggtaccgttacggttaagttttacgtttccggggtactttcgggggtttaccggggtaccggggtaaccggggtaacccttaaacgggtttccggtaaccccgtttaccgttacccggtaccgtaaccggtaccccggtaaacggtcccgttaccccggtaccccccgtttacccgggttaccgtaaccccgtttcccggtttacccgtttcccccccggttccccgttacccccgttaacccg

SEQ ID NO: 206025 - DNA, 558 bp, Homo sapiens
  misc_feature: GYAE6OF02FZ8IQ.10.70.G04.1.454.CMB.1.raw
  modified_base (375)..(375): a, c, t, g, unknown or other
  misc_feature (375)..(375): n is a, c, g, or t
  modified_base (381)..(381): a, c, t, g, unknown or other
  misc_feature (381)..(381): n is a, c, g, or t
  modified_base (411)..(411): a, c, t, g, unknown or other
  misc_feature (411)..(411): n is a, c, g, or t
tcagcatagtagtgcacgaccggtgctcgatttagtgtagtgtgaagggaaagggggacaatctccagcatggcctggtctcctctcctcctcactctcctcgctcactgcacagggtcctgggcccagtctgtgctgacgcagccgccctacagtgtctggggccccagggcagagggtcaccatctcctgcactgggagcagctccaacatcggggcaggttatgatgtacactggtaccagcaacttcccggaacagcccccacgctcctcatctatggtgacaccaaccggccctcaggggtccctgagcgattctctgggtccaagtctggcacctcggcctcctggccatcactggctccaggctgagntgaggntgattatactgcctagtcccatcgacaacngcctgagttgtttgggtgttcggcggtagggaccaagtctaggaccgttccgttagtccacggcccgtaaaggccttaccggccccccgttcggtccctaccgttccgttcccggttaccccccgccccgttccctaccctaacccg

SEQ ID NO: 206026 - DNA, 856 bp, Homo sapiens
  misc_feature: GYAE6OF02I6NPB.10.70.G04.1.454.CMB.1.raw
  modified_base (211)..(211): a, c, t, g, unknown or other
  misc_feature (211)..(211): n is a, c, g, or t
tcagcatagtagtgcacgaccggtgctcgatttagtgtagtgtgaagggaaagggggggacaatctccagcatggcctggtctcctctcctcctcactctcctcgctcactgcacagggtcctgggcccagtctgtgctgacgcacgcccgccctcagtcgtcgtcggggaccccagggcaggacggtcaccatctccgtgcacgtgggancacgtcctacaaactacggtccggggacttaaggttacgtggtatacgtaaccaccgttcggaaccacggaccttaacccggttacccggaaaccacccgacccccaccgtcctaccctactacttacgtagtacgggtaccaacccgtaccccgaaccccggtcccgtacggtaccgggtccctaggaccggtccttactccgttaccgtacgggtactaacgtcgtacccggacctacccggtccggtcccctaccgtacggaccctacgtaccgtaccggtcggggccctaaccggacggtctaaggggacggtacggtacggtacgggtaccgttaactttaacgttaacggtttaccggtcccgtaaccgtaccgtacccgtacgtaacggaacctaaacggtaccgtaccggttagggtttacgggtttacgggttttcgggggttacgggttccggggtaacggggtaccgggtaacccggtaacgtacccggttacggttacccgggttacccgttacggtaccggtaaccggtacccgggtaaccggtcccgttaccccggtccccgttaccggttacccgtacccgtttcccgttacccgtacccccttaccccgttaccctacccgttaacccg

SEQ ID NO: 206027 - DNA, 745 bp, Homo sapiens
  misc_feature: GYAE6OF02JI4B9.10.70.G04.1.454.CMB.1.raw
  modified_base (116)..(116): a, c, t, g, unknown or other
  misc_feature (116)..(116): n is a, c, g, or t
  modified_base (215)..(215): a, c, t, g, unknown or other
  misc_feature (215)..(215): n is a, c, g, or t
  modified_base (251)..(251): a, c, t, g, unknown or other
  misc_feature (251)..(251): n is a, c, g, or t
tcagcatagtagtgcacgaccggtgctcgatttagtgtagtgtgaagggaaagggggacaatctccagcatggcctggtctcctctcctcctcactcctcctcgctcactgcacgngggtcctgggcccaggtctgtcgctgacgcaacgcccgtcctcagtcgtcgtcggggccccagggcaggacggtccacattcctcctgcacgtgggacncagtccaccgaagtacggtccggggataaggttacngacgtacggtaccaacgttcggtaaccagtacctaaccgttacccggaaaccaccgccccgacgcttcctagtattactagtacggtaccaacccgacccgtaaccggcccgtacggaccgggttccctaggaacgtccgtttaacgttccggttaccgtacgggttaacctacggttcgtacggccctaccggtccggtcccgtccgtacgcacgtcgaccgtcggacctacgaggcgtaggtaaggcgttcgaacgggtcttacgtaaactttcgtaacgtcgtaccgtaccgttacctacgtacgaaacctaacgccgcgttaaggtcggttggtttacggtccggttacgggaaccggaacggttaacgtaccggacgttccggtaaccgttcgtaccggcgttaacccgaccgtacggtcccgtaccggtcccgttaacgtccgttaccgttaccgtacccggtccccctaacccttcccactttaccg

SEQ ID NO: 206028 - DNA, 482 bp, Homo sapiens
  misc_feature: GYAE6OF01EH90P.17.25.C03.1.454.CMB.1.raw
tcagcgtagactagcacgaccggtgctcgatttagtagtgtagatttgggtttggggagtcagtctcagtcaggacacagcatggacatgagggtccccgctcagctcctggggctcctgctactctggctccgagctgccagatgtgacatccagatgacccagtctccatcctccctgtctgcctctgtgagggtcagagtcaccatcacttgccggacaagtcacggcattaaaacctattaaattggtatcagcagaaacctggaaaagccccagacctcctgatctctggtgcatccactctgcgaagtggcgtccatcgagttcagtgcagtgatctgggacagatttcaatctcaccatcaccactctgcaactgagtattgtgcaatctactactgtacaacagagttactacgttccctcgctactttggcctagggaccaagttgagatacaaacgactgtgctagcacatc

SEQ ID NO: 206029 - DNA, 526 bp, Homo sapiens
  misc_feature: GYAE6OF01C4V3H.17.25.C03.1.454.CMB.1.raw
  modified_base (227)..(227): a, c, t, g, unknown or other
  misc_feature (227)..(227): n is a, c, g, or t
  modified_base (303)..(303): a, c, t, g, unknown or other
  misc_feature (303)..(303): n is a, c, g, or t
  modified_base (354)..(354): a, c, t, g, unknown or other
  misc_feature (354)..(354): n is a, c, g, or t
  modified_base (387)..(387): a, c, t, g, unknown or other
  misc_feature (387)..(387): n is a, c, g, or t
  modified_base (399)..(399): a, c, t, g, unknown or other
  misc_feature (399)..(399): n is a, c, g, or t
tcagcgtagactagcacgaccggtgctcgatttagtagtgtagatttgggtttgggggtaggtcagtctcagtcaggacacagcatggacactgaggtccccgctcagctcctgggctcctgctactctggctccgagctgaccagatgtgacatccagatgacccagtcttccactccgtccctgtcctgcctctggtggggtcagagtcaccatcacttgccganaagtcacgacgttaaactattaaattggtatcagcaagaaacctggaaaacgcccagacctcctgatctctggtcncatccgactctgacgaagtcgcgtcccatcgagttcagtgcagtggatcgnggacagtatttcaatctcaccatccaccactcngacactgaggtnttgtgacaatctactactgtactaacagtagttacctacgttcccctagacctacgtttcggaccgtaacggggaaccaaagttgagactacaaacgtaactgtcgctcgacacctactcctgtacc

SEQ ID NO: 206030 - DNA, 522 bp, Homo sapiens
  misc_feature: GYAE6OF01AQ80W.17.25.C03.1.454.CMB.1.raw
  modified_base (331)..(331): a, c, t, g, unknown or other
  misc_feature (331)..(331): n is a, c, g, or t
  modified_base (427)..(427): a, c, t, g, unknown or other
  misc_feature (427)..(427): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaanactggtgtcacagtgtcttcacccatcctccgggacagacttaccatgaccacgaacctcctaccaataaacacagcctaacatggagttgaggancctgacatctgacacacggtcctatattactgtcgcgagacgtcccaggactccgggtgacgccctacggcacgcggtcctttgcgttcgcgggg

SEQ ID NO: 206031 - DNA, 528 bp, Homo sapiens
  misc_feature: GYAE6OF01CRWVJ.17.25.C03.1.454.CMB.1.raw
  modified_base (282)..(282): a, c, t, g, unknown or other
  misc_feature (282)..(282): n is a, c, g, or t
  modified_base (430)..(430): a, c, t, g, unknown or other
  misc_feature (430)..(430): n is a, c, g, or t
tcagcgtagactagcacgaccggtgctcgatttagtagtgtagatttgggtttgggggactacaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacacgacctgagtggatgggatgggcaaaccctaacactggtgtcacagtgtcttcacccatccgtcgggacagaccttaccatcgaccacgaactcctaccaataaaccacagcctaacatggagttgaggancctgacatctgacgacgacggcctatacttactgcgcgagacgtcccgacgcgtccggtgacgcccgtacggcacggcgtcctttggcttcggcgggg

SEQ ID NO: 206032 - DNA, 561 bp, Homo sapiens
  misc_feature: GYAE6OF01CO7QN.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgttttacctcctatagtatcaactggtgcgccaggccgctggacaacgacctgagtggatgggatgggacgaaccctaacactggtcgtcacgagtgtcttcaccccatccgtccgggacagtacttaccatgaccacgaacctcctaccaataaaccacacgcctaacatggagttgaggacgcctgacatctgaacgacaaccggtccgtactattactgtgcgtagacgtcccaacggtactcccgggtgacggccccgtaacgggccgacggccggtacccttttggaccgtttccggtcggggg

SEQ ID NO: 206033 - DNA, 594 bp, Homo sapiens
  misc_feature: GYAE6OF01BYWA3.17.25.C03.1.454.CMB.1.raw
  modified_base (279)..(279): a, c, t, g, unknown or other
  misc_feature (279)..(279): n is a, c, g, or t
tcagcgtagactagcacgaccggtgctcgatttagtagtgtagatttggggtttgggggggagtcagtctcagtcaggacacagcatggacatgagggtccccgcgtcagctcctggggctcctgctactctggctccgaactgccagatgtgacgagtccagatgacccagtctccatcctcctgtctgcctctgtggggtcagacgtcacatcacttgccggacaagtcacggtacgttaaaacctatttaaatggtatcagcagaacctggaaacncccagacctctgactctctggtgcactccactcgtgacgaagtcgcgtccatcgtagttcagtggctaggtggactcgtagggactaggtatttacaaattctacacctatcctacctactctacgacctaaacccgtggaacggtacttcgtacgactaagttccttaactacttgtacaacgtagtaacgttaccacgtttccccgtacgtaccttacgtttcggaccgtaacggggtacctaaaggttgaagtacgtaccgaaacgtacgttcggtacggctacgacctaacctattcctggttccttaccg

SEQ ID NO: 206034 - DNA, 517 bp, Homo sapiens
  misc_feature: GYAE6OF01A8P0W.17.25.C03.1.454.CMB.1.raw
  modified_base (435)..(435): a, c, t, g, unknown or other
  misc_feature (435)..(435): n is a, c, g, or t
  modified_base (479)..(479): a, c, t, g, unknown or other
  misc_feature (479)..(479): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatggggcgaaccctaacactggtgtcacagtgtcttcacccatcctcgggacagacttaccatcgaccacgaactcctccaataaacacagcctacatggagttgaggagcctgacatcngacgacacggccgtctatactgtgcgagacgtcccagctccggngacgccgtacggcacggcggtcctttgcgttcgcgggg

SEQ ID NO: 206035 - DNA, 548 bp, Homo sapiens
  misc_feature: GYAE6OF01CP7YZ.17.25.C03.1.454.CMB.1.raw
tcagcgtagactagcacgaccggtgctcgatttagtagtgtagatttgggtttggggactcaaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagccgtggggcctcagtgaaggtctcctgcaaggcttctggattcacgtttacctcctatagtatcaactgggtgcgccaggccgctggacaacgacctgagtggatgggatgggacgaaccctaacacgtggtgtcacgagtgtcttcacccatccgtccgggacagacttaccatcgaccacgaactcctaccaataaacacacgcctaacataggagttaggaggagcctgacatctagacgacgaccggtcctacttattacgtgtcgcgagtacgtcccacgcgtccggtggacgcccgtacggcgacggccggtccgtttcgcgttcggtcgggg

SEQ ID NO: 206036 - DNA, 552 bp, Homo sapiens
  misc_feature: GYAE6OF01BHBP0.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctccttatagtatcaacgtgggtgcgccaggccgctggacaacgacctgagtggatggggatggggaccgaaaccctaacgacgtggtgtcacagtgtcttcaccccatcccgtccgggacacgtaccttaccatcgaccacgaactccctaccaataaacacacgacctacatggagttgagacgcctgacatcgtagacgacgacggcctctatactgtcgcgagtacgtcccgacgtacgtccggagacgccgtacggcgtacggtccgtcctttcgtcgttcggtcgggg

SEQ ID NO: 206037 - DNA, 624 bp, Homo sapiens
  misc_feature: GYAE6OF01DXZQP.17.25.C03.1.454.CMB.1.raw
  modified_base (444)..(444): a, c, t, g, unknown or other
  misc_feature (444)..(444): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctgggctgaggtgaagagcctggggcctcagtgaaggtctcctgcaaggcttctggattcacgtttacctcctatagtatcaactgggtgcgccaggccgctggaccaacgacctggagtggatgggatgggacgaaaccctaacacgtggtcgtcacagtgtcttcacccatccgtccgggacagaccttaccatcgacccacgtaacctccctaccaataaaccacacgcctaacagtgggagttggaaggacnccctagactagtccgtaggaaccgaccgaccggggtcccttacttaacgtttacgtggttacgaccggaagtaccgtacccccgaacggtacgttcccggggtagtacccggaccccgtaaccgggccgtacgggtccccggttacccgtttttcggaccgttttccggtaccggggggg

SEQ ID NO: 206038 - DNA, 529 bp, Homo sapiens
  misc_feature: GYAE6OF01B7THB.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaaccctaacacgtggtgtcacagtgtcttcacccatcctccgggacagacttaccatgaccacgaactcctccaataaacacagcctaacagtggagttgagagcctgacatctgaccgacacggccgtactattactgtgcgagacgtcccacgtacgtccggtgcgcccgtacggcacggcgtcctttgaccgtttcgtcgggg

SEQ ID NO: 206039 - DNA, 511 bp, Homo sapiens
  misc_feature: GYAE6OF01D6SVY.17.25.C03.1.454.CMB.1.raw
  modified_base (277)..(277): a, c, t, g, unknown or other
  misc_feature (277)..(277): n is a, c, g, or t
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggacgttaaaacctatttaaattggtatcagcagaaacctggaaaacnccccagacctcctgatctctggtgcatccactctgcgaagtggcgtcccatcgaggttcagtggcagtggatcgtgggacagtatttcaatctacaccatcaccactctgacaactgagattgtgcaatctactactgtacaacagtagttacacgttcccctcgtctacgtttcggaccgtagggaccaaagttgagtatacaaacgtactgtggctgacactactctgttcc

SEQ ID NO: 206040 - DNA, 502 bp, Homo sapiens
  misc_feature: GYAE6OF01A241I.17.25.C03.1.454.CMB.1.raw
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggcgttaaaacctatttaaattggtatcagcagaaacctggaaaacgccccagacctcctgatctctggtgcatccactctgcgaagtggctccatcgaggttcagtggcagtggatcgtgggacagtatttcaatctcaccatcaccactctgcaacctgagattgtgacaatctactactgtacaacagagttactacgttcccctcgtctactttcggccgtagggacctaaagttgagtactacaaacgtactgtgctgacaccatctgtc

SEQ ID NO: 206041 - DNA, 517 bp, Homo sapiens
  misc_feature: GYAE6OF01ACX3P.17.25.C03.1.454.CMB.1.raw
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggcgttaaaacctatttaaatggtatcagcagaaacctggaaaagccccagacctcctgatctctggtgcatccactctgcgaagtggcgtccatcgaggttcagtggcagtggatcgtgggacagatttcaatctcacatcaccactctgcaacctgaggtattgtgcaatctactactgtacaacagtagttacacgttcccctcgtcctacgttttcggaccgtaggggacctaaaggttgaagtactacaaacgtacgtgtggctcgacaccacttcgtgttcc

SEQ ID NO: 206042 - DNA, 549 bp, Homo sapiens
  misc_feature: GYAE6OF01B2QK3.17.25.C03.1.454.CMB.1.raw
  modified_base (222)..(222): a, c, t, g, unknown or other
  misc_feature (222)..(222): n is a, c, g, or t
  modified_base (300)..(300): a, c, t, g, unknown or other
  misc_feature (300)..(300): n is a, c, g, or t
  modified_base (407)..(407): a, c, t, g, unknown or other
  misc_feature (407)..(407): n is a, c, g, or t
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccgganaagtcacggacttaaaacctatttaaattggtatcagcaagaaacctggaaaacgcccagacctcctgatctctggtncatccactctgcgaagtggcgtcccagtcgaggttcagtggcaggtggatcgtgggactagtatttacaatctacactatcaccactctcgacaacctgagtattgngactaactctactactgtacaaacagtaacttactacgttcccctacgtcttacgtttcggaccgtaagggtaaccaaaggttgaagtaactacgaaaacgtacgtaggtacggactacggaccaaccattccgtgtttacc

SEQ ID NO: 206043 - DNA, 492 bp, Homo sapiens
  misc_feature: GYAE6OF01DYZZR.17.25.C03.1.454.CMB.1.raw
  modified_base (242)..(242): a, c, t, g, unknown or other
  misc_feature (242)..(242): n is a, c, g, or t
tcagcgtagactagcacgaccggtgctcgatttagtagtgtagatttgggtttggggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggcgttaaaacctntttaaattggtatcagcagaaacctggaaaagccccagacctcctgatctctggtgcatccactctgcgaagtggcgtcccatcgaggttcagtggcagtggatctgggacagatttcaatctcaccatcaccactctgcaacctgaggattgtgcaatctactactgtcaacagagttacagttcccctcgctacttttggccagggaccaaagttgagatacaaacgaactgtgctgacacatctgtc

SEQ ID NO: 206044 - DNA, 537 bp, Homo sapiens
  misc_feature: GYAE6OF01A2HIY.17.25.C03.1.454.CMB.1.raw
  modified_base (280)..(280): a, c, t, g, unknown or other
  misc_feature (280)..(280): n is a, c, g, or t
  modified_base (331)..(331): a, c, t, g, unknown or other
  misc_feature (331)..(331): n is a, c, g, or t
  modified_base (433)..(433): a, c, t, g, unknown or other
  misc_feature (433)..(433): n is a, c, g, or t
  modified_base (494)..(494): a, c, t, g, unknown or other
  misc_feature (494)..(494): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacaacgacctgagtggatgggatgggcgaaccctaanacgtggtgtcacgagtgtcttcgacccatccctccgggacagaccttaccatcgaccacgaacctcctaccaataaacacagccctacatgagttgaggacncctagacatctgacgacacggccgtatacttactgtcgcgagacgtcccgagactccgggngcgccctacgggcacggccggtcctttggcctttggtacgggg

SEQ ID NO: 206045 - DNA, 522 bp, Homo sapiens
  misc_feature: GYAE6OF01EGJXP.17.25.C03.1.454.CMB.1.raw
  modified_base (452)..(452): a, c, t, g, unknown or other
  misc_feature (452)..(452): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactggtgcgccaggccgctggacaacgacctgagtggatgggatgggcgaaccctaacactggtgtcacagtgtcttcacccatcctcgggacagacttaccatgaccacgaactcctccataaacacagcctacatggagttgagagcctgacatctgacgacacggccgtctattacngtgcgagacgtcccacgactccgggtgcgcccgtacgggcaggcggccctttggaccgttcgtacggggg

SEQ ID NO: 206046 - DNA, 569 bp, Homo sapiens
  misc_feature: GYAE6OF01ADION.17.25.C03.1.454.CMB.1.raw
  modified_base (304)..(304): a, c, t, g, unknown or other
  misc_feature (304)..(304): n is a, c, g, or t
  modified_base (408)..(408): a, c, t, g, unknown or other
  misc_feature (408)..(408): n is a, c, g, or t
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctgtggggtcagagtcacatcacttgccggacaagtcacggtacgttaaaacctatttaaattggtatcagcaagaaacctaggaaaacgccccagacctcctgactctcgtggtncatccactctgacgaagtcggctccatcgaggttcagtgcagtggatcgtaggacagtatttcaatctcaccatacaccactctcgacaacctgagtattgtanactaatctaactactagtacaaacgtacgtaacgttacctacgtttcccctcgtacttacgtttacggaccgtaaggggtaacctaaaggttagaacgtaacgtaaccgtaaaacggtacgttaggtcggtacctacgaccctaactacttcgttcgttcc

SEQ ID NO: 206047 - DNA, 512 bp, Homo sapiens
  misc_feature: GYAE6OF01EA3OO.17.25.C03.1.454.CMB.1.raw
  modified_base (275)..(275): a, c, t, g, unknown or other
  misc_feature (275)..(275): n is a, c, g, or t
  modified_base (503)..(503): a, c, t, g, unknown or other
  misc_feature (503)..(503): n is a, c, g, or t
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggcgttaaaacctatttaaattggtatcagcagaaacctggaaaancccagacctcctgatctctggtgcatccactctgcgaagtggcgtccatcgagttcagtggcagtggatcgtggacagtatttcaatctacaccatcaccactctgacaacctgaggtattgtgacaatctactactgtacaacagtagttacacgttcccctcgctacgtttcggaccgtaggggacctaaagttgaagtactacaaacgtactggtgctgaccacntcgtgttcc

SEQ ID NO: 206048 - DNA, 525 bp, Homo sapiens
  misc_feature: GYAE6OF01DWJTC.17.25.C03.1.454.CMB.1.raw
  modified_base (401)..(401): a, c, t, g, unknown or other
  misc_feature (401)..(401): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacncagcctacatggattgagagcctgacatctgacgacacggccgtctattactgtgacgagacgtccccagtacgtcccggtgacgccctaggcctaggccggccttttggcctttcgtcggggg

SEQ ID NO: 206049 - DNA, 618 bp, Homo sapiens
  misc_feature: GYAE6OF01EP0UL.17.25.C03.1.454.CMB.1.raw
  modified_base (311)..(311): a, c, t, g, unknown or other
  misc_feature (311)..(311): n is a, c, g, or t
  modified_base (372)..(372): a, c, t, g, unknown or other
  misc_feature (372)..(372): n is a, c, g, or t
  modified_base (449)..(449): a, c, t, g, unknown or other
  misc_feature (449)..(449): n is a, c, g, or t
  modified_base (461)..(461): a, c, t, g, unknown or other
  misc_feature (461)..(461): n is a, c, g, or t
  modified_base (482)..(482): a, c, t, g, unknown or other
  misc_feature (482)..(482): n is a, c, g, or t
  modified_base (559)..(559): a, c, t, g, unknown or other
  misc_feature (559)..(559): n is a, c, g, or t
tcagcgtagactagcacgaccggtgctcgatttagtagtgtagatttgggtttgggggtacgtcaacaaccacgatctgtccctctagaggaaaacccttcgtagagtcactagctcctcaccatggactggacctggaggatcctcttcttggtggtcgagcagctacgaagttgcccgactcccaggttagtcagctggtgcagtctgggctgaggtgagagcctggggactcagtgaacgtctctgcaggcttctggtattcgacgtttacctcctatagtatcaactgggtgacgccgtaggcccgngtcggaccaacgggaccgtggacggtggagttggggactgggacaaacccgtaagactggngtcgacgagtgtcttcacccatccctccggggacaggacttacattcgaccctacgaacctcctaccaattaaaccnctacgccttaanattcggacgtttgacggtacncctagaccaatcgtgacgaccacgggccgttactaattacgtgtacgcgtagtaccgtacccagtactcccgggtanaccgtcccgttacgggcctaacggcccggtacccttttggaccgtttcggacggggggg

SEQ ID NO: 206050 - DNA, 515 bp, Homo sapiens
  misc_feature: GYAE6OF01CHH41.17.25.C03.1.454.CMB.1.raw
  modified_base (280)..(280): a, c, t, g, unknown or other
  misc_feature (280)..(280): n is a, c, g, or t
  modified_base (290)..(290): a, c, t, g, unknown or other
  misc_feature (290)..(290): n is a, c, g, or t
  modified_base (329)..(329): a, c, t, g, unknown or other
  misc_feature (329)..(329): n is a, c, g, or t
  modified_base (340)..(340): a, c, t, g, unknown or other
  misc_feature (340)..(340): n is a, c, g, or t
  modified_base (481)..(481): a, c, t, g, unknown or other
  misc_feature (481)..(481): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccnctggacacgacctgagtggatgggatgggcaaccctaanactggtgccanagtgtcttcacccatcctcgggacagacttaccatcgaccacgaactcctccaataaacacagcctaacatcgagttgaggagcctgacatctgacgacacggtcctactattactgtgcgagacgtcccagacgtccggngacgcctacggcacggcgtctttgcttcgcgggg

SEQ ID NO: 206051 - DNA, 523 bp, Homo sapiens
  misc_feature: GYAE6OF01CWJGV.17.25.C03.1.454.CMB.1.raw
  modified_base (338)..(338): a, c, t, g, unknown or other
  misc_feature (338)..(338): n is a, c, g, or t
  modified_base (487)..(487): a, c, t, g, unknown or other
  misc_feature (487)..(487): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggacaaccctaacactggtntcacagtgtcttcaccctatccctacgggacagacttaccatcgaccaacgaactcctaccaataaacacagacctacatggagttgaggacgcctgacatctagacgacacggccgtctattactgtgcgagacgtcccagactcggngacgcctacggcacgcggtccttgcgttcgtcgggg

SEQ ID NO: 206052 - DNA, 500 bp, Homo sapiens
  misc_feature: GYAE6OF01AZ2D3.17.25.C03.1.454.CMB.1.raw
  modified_base (494)..(494): a, c, t, g, unknown or other
  misc_feature (494)..(494): n is a, c, g, or t
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggcgttaaaacctatttaaattggtatcagcagaaacctggaaaagccccagacctcctgatctctggtgcatccactctgcgaagtggcgtccatcgaggttcagtggcagtggatcgtgggacagatttcaatctcacatcaccactctgcaacctgagtattgtgcaatctactactcgtacaacagtagttactacgttcccctcgtctactttcggccgagggacctaaagttgagtactacgaaacgactgtgctgacacntctgtc

SEQ ID NO: 206053 - DNA, 514 bp, Homo sapiens
  misc_feature: GYAE6OF01CRK6X.17.25.C03.1.454.CMB.1.raw
  modified_base (278)..(278): a, c, t, g, unknown or other
  misc_feature (278)..(278): n is a, c, g, or t
  modified_base (325)..(325): a, c, t, g, unknown or other
  misc_feature (325)..(325): n is a, c, g, or t
  modified_base (332)..(332): a, c, t, g, unknown or other
  misc_feature (332)..(332): n is a, c, g, or t
  modified_base (394)..(394): a, c, t, g, unknown or other
  misc_feature (394)..(394): n is a, c, g, or t
  modified_base (402)..(402): a, c, t, g, unknown or other
  misc_feature (402)..(402): n is a, c, g, or t
  modified_base (415)..(415): a, c, t, g, unknown or other
  misc_feature (415)..(415): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaaggcttctggattcacgtttacctctatagtatcaactgggtncgcaggccgctgacaacgacctgagtggatgggatgggcaaccctanactggtntcacagtgtcttcacccatcctccgggacagacttacatgaccacgaactcctacataaacncagcctanatggattgagacncctgacatctgacgacacggcctatattactgcgcgagacgtcccagtactccggtgacgcccgtacggctacggccggtcctttgcgttcggtcgggg

SEQ ID NO: 206054 - DNA, 518 bp, Homo sapiens
  misc_feature: GYAE6OF01CRQBE.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatggggcgaaccctaacactggtgtcacagtgtcttcacccatcctccgggacagacttaccatgaccacgaactcctccataaacacagcctacatggagttgaggagcctgacatctgacgacacggccgtctattacctgtgcgagacgtcccacgactccgggtgacgcctacggcaggcggcctttgcttcgtcgggg

SEQ ID NO: 206055 - DNA, 540 bp, Homo sapiens
  misc_feature: GYAE6OF01CN1KR.17.25.C03.1.454.CMB.1.raw
  modified_base (277)..(277): a, c, t, g, unknown or other
  misc_feature (277)..(277): n is a, c, g, or t
tcagcgtagactagcacgaccggtgctcgatttagtagtgtagatttgggtttggggggaggtcagtctcagtcaggacacagcatggacatgagggtccccgctcagctcctgggctcctgctactctggctccgagctgccaggatgtgacatccagatgacccagtctccatcctccctgtctgcctctgtgggggtcagagtcaccatcacttgccggacaagtcacggcgttaaaacctatttaaattggtatcagcagaaacctggaaaanccccagacctcctgatctctggtgcatccactctgcgaagtggcgtccatcgaggttcagtggcagtggatctgggacagatttcaatctcaccatcacactctgcaactgagtattgtgcaatctactactgtacaacagagttacacgtttcccctacgtccttacttttcggaccctaaagggtacctaaaaggttggaagtaactacgaaaacgtaacgttaggtacggctacggaccaacctaacttcgttcgttccc

SEQ ID NO: 206056 - DNA, 515 bp, Homo sapiens
  misc_feature: GYAE6OF01EZLCQ.17.25.C03.1.454.CMB.1.raw
  modified_base (332)..(332): a, c, t, g, unknown or other
  misc_feature (332)..(332): n is a, c, g, or t
  modified_base (393)..(393): a, c, t, g, unknown or other
  misc_feature (393)..(393): n is a, c, g, or t
  modified_base (482)..(482): a, c, t, g, unknown or other
  misc_feature (482)..(482): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaaggcttctggattcacgtttacctcctatagtatcaactgggtgcgccaggccgctggacaacgacctgagtggatgggatggggcgaaccctaacnctggtgtcacagtgtcttcacccatccctccgggacagacttaccatgaccacgaactccncataaacacagcctacatggagttgaggagcctgacatctgacgacacggccgtctattactgtgcgagacgtcccaggctccgggtgngccctacggcaggcggcctttgccttgtcgggg

SEQ ID NO: 206057 - DNA, 515 bp, Homo sapiens
  misc_feature: GYAE6OF01B3559.17.25.C03.1.454.CMB.1.raw
  modified_base (477)..(477): a, c, t, g, unknown or other
  misc_feature (477)..(477): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctcgggacagacttacatgaccacgaactcctccataaacacagcctacatggagttgaggagcctgacatctgacgacacggcctctattactgtgcgagcgtcccacgtatcccggngcgccctacggcaggcggtcctttggcttcgtcggggg

SEQ ID NO: 206058 - DNA, 533 bp, Homo sapiens
  misc_feature: GYAE6OF01A5SCA.17.25.C03.1.454.CMB.1.raw
  modified_base (464)..(464): a, c, t, g, unknown or other
  misc_feature (464)..(464): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtacccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatggggcgaaccctaacacgtggtgtcacagtgtcttcacccatcctccgggacagaccttaccatcgaccacgaacctcctaccaataaacacacgcctacatggagttgaggacgcctgacatctgacgacacggccgtctattacngtgcgagacgtcccacggctccgggtgcgccgtacggcacggcggtcctttgacgtttcgcggggaccg

SEQ ID NO: 206059 - DNA, 511 bp, Homo sapiens
  misc_feature: GYAE6OF01EG6NI.17.25.C03.1.454.CMB.1.raw
  modified_base (280)..(280): a, c, t, g, unknown or other
  misc_feature (280)..(280): n is a, c, g, or t
  modified_base (337)..(337): a, c, t, g, unknown or other
  misc_feature (337)..(337): n is a, c, g, or t
  modified_base (409)..(409): a, c, t, g, unknown or other
  misc_feature (409)..(409): n is a, c, g, or t
  modified_base (455)..(455): a, c, t, g, unknown or other
  misc_feature (455)..(455): n is a, c, g, or t
  modified_base (463)..(463): a, c, t, g, unknown or other
  misc_feature (463)..(463): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacaacgacctgagtggatgggatgggcgaaccctaacactggngtcacagtgtcttcacccatcctcgggacagacttaccatcgaccacgaactcctccataaacacagcctanatggagttgaggagcctgacatctgacgacacgggcctctattacngtgcgagngtcccagactccggtgagccctaggcagcggcctttgcttcgtcgggg

SEQ ID NO: 206060 - DNA, 552 bp, Homo sapiens
  misc_feature: GYAE6OF01B2GUX.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggcccgcgtggacaacgacctgaggtggatgggatcgggaccgaaaccctaacgacgtggtcgtacacgaggtcgtccttcaccccagtcccgtaccgggacagacttaccatcgaccacgaactcctaccaataaacacagcctaacatcgggattgaggacgcctagacatcgtgacgacacggcctatattactgtcgcgagacgtcccagtacgtccggtgacgcccgtaggctacggccgtcctttgccgttcggtacgggg

SEQ ID NO: 206061 - DNA, 541 bp, Homo sapiens
  misc_feature: GYAE6OF01B30K3.17.25.C03.1.454.CMB.1.raw
  modified_base (411)..(411): a, c, t, g, unknown or other
  misc_feature (411)..(411): n is a, c, g, or t
  modified_base (426)..(426): a, c, t, g, unknown or other
  misc_feature (426)..(426): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacacgtggtgtcacagtgtcttcacccatcctcgggacagacttaccatcgaccacgaactcctaccataaacacagcctanatggagttgaggacncctagacatctagacgacgacggtccgttctattacgtgtcgcgagacgtcccacggtactccgggtagacgcccgtaacggcacggccggtacctttcggccttcggtcggggg

SEQ ID NO: 206062 - DNA, 525 bp, Homo sapiens
  misc_feature: GYAE6OF01C9G1G.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggagtgggatgggacgaaccctaacacgtggtgtcacagtgtcttcacccatccctccgggacagacttaccatcgaccacgaactcctaccataaacacagcctacagtggagttgaggagcctgacatctgacgataccggctctattactgtgcgagacgtcccacgactccggtgcgccgtacggcacggccggtcctttgccttcggcgggg

SEQ ID NO: 206063 - DNA, 546 bp, Homo sapiens
  misc_feature: GYAE6OF01CZTAN.17.25.C03.1.454.CMB.1.raw
  modified_base (330)..(330): a, c, t, g, unknown or other
  misc_feature (330)..(330): n is a, c, g, or t
  modified_base (429)..(429): a, c, t, g, unknown or other
  misc_feature (429)..(429): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacacgacctgagtggatgggatgggcgaaccctaanactggtgtcacagtgtcttcacccatcccgtccgggacagacttaccatcgaccacgaactcctaccaataaaccacagcctaacatgggattgaggancctgacatctgacgacacggctctattactgtgcgagacgtcccaacgtacgtccgggtagacgcccgtaacgggcgaacggtccggtaccttttcggaccgtttcgggtccggggg

SEQ ID NO: 206064 - DNA, 517 bp, Homo sapiens
  misc_feature: GYAE6OF01D2RO2.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctcgggacagacttaccatgaccacgaactcctccataaacacagcctacatggagttgaggagcctgacatctgacgacacggcctctacttactgtgcgtagcgtacccacgtactccggtgacgccgtacggcaggcgtcctttgcttcgtcgggg

SEQ ID NO: 206065 - DNA, 517 bp, Homo sapiens
  misc_feature: GYAE6OF01A84HR.17.25.C03.1.454.CMB.1.raw
  modified_base (412)..(412): a, c, t, g, unknown or other
  misc_feature (412)..(412): n is a, c, g, or t
  modified_base (426)..(426): a, c, t, g, unknown or other
  misc_feature (426)..(426): n is a, c, g, or t
  modified_base (458)..(458): a, c, t, g, unknown or other
  misc_feature (458)..(458): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctcgggacagacttaccatgaccacgaactcctccaataaaccacagccctaanatggagttgaggancctgacatctgacgacacggcagtctattacngtgcgagacgtcccagatcccgggtgacgccgtacggcaggccggtcctttgacttcgg

SEQ ID NO: 206066 - DNA, 526 bp, Homo sapiens
  misc_feature: GYAE6OF01D4O0F.17.25.C03.1.454.CMB.1.raw
  modified_base (459)..(459): a, c, t, g, unknown or other
  misc_feature (459)..(459): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacgactggtgtcacagtgtcttcacccatcctccgggacagacttaccatcgaccacgaactcctaccataaacacagcctacatggagttgaggagcctgacatctgacgacaccggccgtctattacngtgcgagacgtcccacggactccgggtgacgccctacgggcagcggccttttggacttcgtcggggg

SEQ ID NO: 206067 - DNA, 521 bp, Homo sapiens
  misc_feature: GYAE6OF01B6SYN.17.25.C03.1.454.CMB.1.raw
  modified_base (280)..(280): a, c, t, g, unknown or other
  misc_feature (280)..(280): n is a, c, g, or t
  modified_base (330)..(330): a, c, t, g, unknown or other
  misc_feature (330)..(330): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacaacgacctgagtggatgggatgggcaaccctaanactggtgtcacagtgtcttcacccatcctcgggacagacttaccatcgaccacgaactcctaccataaacacagcctacatggagttgaggagcctgacatctgacgacacggtccgtctattactgtgcgagacgtcccacgctcccggtgacgccctacggcacggcggtcctttgcgttcgtcggggg

SEQ ID NO: 206068 - DNA, 534 bp, Homo sapiens
  misc_feature: GYAE6OF01DBE6Q.17.25.C03.1.454.CMB.1.raw
  modified_base (306)..(306): a, c, t, g, unknown or other
  misc_feature (306)..(306): n is a, c, g, or t
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctggtgggggtcagagtcaccatcacttgccggacaagtcacggacgttaaaactatttaaattggtatcagcaagaaaacctggaaaacgccccaagaccctcctgactctctggtncatccactctgcgaagtggcgtccatcgagttcagtggcagtggatcgtgggacagtatttcaatctcaccatcaccactctgacaacctgaggtattgtgacaactcttactactgtacaacagtaagttactacgttcccctacgtctacgttttcggaccgtagggaacctaaagtagacgtaactacgaaacgtacgtgtagacgtcgacaccatcgtgttacc

SEQ ID NO: 206069 - DNA, 517 bp, Homo sapiens
  misc_feature: GYAE6OF01B2B7Q.17.25.C03.1.454.CMB.1.raw
  modified_base (275)..(275): a, c, t, g, unknown or other
  misc_feature (275)..(275): n is a, c, g, or t
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggacgttaaaacctatttaaattggtatcagcagaaacctggaaaacnccccagacctcctgatctctggtgcatccactctgcgaagtcggcgtcccatcgaggttcagtggcagtgatcgtgggacagtatttcaatctacaccatcaccactctgacaacctgaggtattgtgactaatctactactgtacaacagtacgttactacgttccctcgtctacgtttcggccgtacgggaacctaaagttagaagtactacaaacgactgtgactcgacacatcgtgtc

SEQ ID NO: 206070 - DNA, 518 bp, Homo sapiens
  misc_feature: GYAE6OF01BGRHL.17.25.C03.1.454.CMB.1.raw
  modified_base (466)..(466): a, c, t, g, unknown or other
  misc_feature (466)..(466): n is a, c, g, or t
  modified_base (481)..(481): a, c, t, g, unknown or other
  misc_feature (481)..(481): n is a, c, g, or t
  modified_base (487)..(487): a, c, t, g, unknown or other
  misc_feature (487)..(487): n is a, c, g, or t
tcagcgtagactagcacgaccggtgctcgatttagtagtgtagatttgggtttgggactcaacaaccacatctgtcctctagagaaaaccctagtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggacgaaccctaacactggtgtcacagtgtcttcacccatccgtccgggacagacttaccatgacccacgaacctcctaccaactaaacacagcctacatggagttgaggacgcctgacatctgaccgacacggcctactattactgngcgagtcgtcccagntccggnacgcctacggcagcgcctttgcttcgcgggg

SEQ ID NO: 206071 - DNA, 528 bp, Homo sapiens
  misc_feature: GYAE6OF01C8T0L.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacacgacctgagtggatgggatgggacgaaccctaacactggtgtcacagtgtcttcacccatcctccgggacagacttaccatcgaccacgaactcctaccaataaacacacgcctaacatggagttgaggagcctgacatctgacgacacggcgtctattactgtcgcgagacgtccccgacgctaccgggtgacgcctaagtgggccaggccggtcctttggcctttcggg

SEQ ID NO: 206072 - DNA, 554 bp, Homo sapiens
  misc_feature: GYAE6OF01BIP6U.17.25.C03.1.454.CMB.1.raw
  modified_base (329)..(329): a, c, t, g, unknown or other
  misc_feature (329)..(329): n is a, c, g, or t
  modified_base (438)..(438): a, c, t, g, unknown or other
  misc_feature (438)..(438): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgagagcctggggcctcagtgaaggtctcctgcaaggcttctggattcacgtttacctcctatagtatcaactgggtgcgccaggccgctggacaacgacctgagtggatgggatgggcgaaccctaanactggtgtcacagtgtcttcacccatcctccgggacacgacttaaccatcgaaccaacgaacctcctacccaataaaccacacgaccctaacagtggagttgaaggacnccgtagacatcgagacgacacggtccgtcttatcgtgtgcgtagacgtacccaggtactcccgggtgacgcccgtacgggctacggccggttacctttgaccgttcgggtacgggg

SEQ ID NO: 206073 - DNA, 543 bp, Homo sapiens
  misc_feature: GYAE6OF01C5LTC.17.25.C03.1.454.CMB.1.raw
  modified_base (278)..(278): a, c, t, g, unknown or other
  misc_feature (278)..(278): n is a, c, g, or t
  modified_base (302)..(302): a, c, t, g, unknown or other
  misc_feature (302)..(302): n is a, c, g, or t
  modified_base (350)..(350): a, c, t, g, unknown or other
  misc_feature (350)..(350): n is a, c, g, or t
  modified_base (383)..(383): a, c, t, g, unknown or other
  misc_feature (383)..(383): n is a, c, g, or t
  modified_base (393)..(393): a, c, t, g, unknown or other
  misc_feature (393)..(393): n is a, c, g, or t
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggacgttaaaacctatttaaattggtatcagcaagaaacctggaaaacnccccagacctcctgatctctggtncatccactctgcgaagtggcctccatcgagttcagtgcagtggatcgnggacagtattcaatctacaccatccaccactcnacaactgagnttgtgacaatctactactgtacaacagtaagttacctacgttcccctcgtcttacgttttcggccgtaacggggtaacctaaaggttagaacgtaactaacgaaaacgtaacgttcggtaggacgtcgacctacctactcgttcgttacc

SEQ ID NO: 206074 - DNA, 821 bp, Homo sapiens
  misc_feature: GYAE6OF01CO1GW.17.25.C03.1.454.CMB.1.raw
  modified_base (278)..(278): a, c, t, g, unknown or other
  misc_feature (278)..(278): n is a, c, g, or t
  modified_base (328)..(328): a, c, t, g, unknown or other
  misc_feature (328)..(328): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaaggcttctggattcacgtttacctctatagtatcaactgggtncgccaggccgctggacacgacctgagtggatgggatgggaccaaccctanacgtggtcgtcacgtagttcgtccttccgaacccctacgttcccgttacccgggggaacctaacgggtaaccccttttaacccgaacgtttaccgggaaaccccctaacccgggtaaaacccctttacccccgttaaccccctaaaacgtttaaaaaaccccaaaccccgtaaaccgggtacccccttaaaaccgtaacgtttacgggggtaaacggttttacgggaaacggggtaaccgtaccccgtttaacggtaaacctaacgtttacccgttacgggtaaaccggtaacgttaaccccggggtccccggtttaacctttaaacgtttttacccgttgggttaccggtaccggtaacggtaccgggtttacccccgaaacgggtaccggtttaccccggggtaggacccggttacccccgttaaacggggcccgtaacgggtcccgggttaccccgtttttagggacccgttttcccgggtaccgggggg

SEQ ID NO: 206075 - DNA, 646 bp, Homo sapiens
  misc_feature: GYAE6OF01D7WZB.17.25.C03.1.454.CMB.1.raw
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctggtggggtcagagtcaccatcacttgccggacaagtcacggacgttaaaacctatttaaattggtatcagcaagaaacctggaaaacgccccagacctctgatctctggtgcatccactctgcgaagtggccgtccatcggaggttcaggtggcaggtggatcgtgggactagtatttcaaattcctacaaccctattaccaaccctaccttctacgaccctaaaccgttggaaggttaactttggtacgtacctaaacttccttaacttacgttcgtaaccaaacgtaggttaacgtttaaccgtaccggtttacccccctacgtacctttaaccggtttttccgggacccggtaaacgggggtaacccttaaaagggtttacggaacggtaacttaaccgaaaaccggtacgtggtacggtcgtacgacctaacctacttccgtcggtttaccc

SEQ ID NO: 206076 - DNA, 513 bp, Homo sapiens
  misc_feature: GYAE6OF01AIYUV.17.25.C03.1.454.CMB.1.raw
  modified_base (330)..(330): a, c, t, g, unknown or other
  misc_feature (330)..(330): n is a, c, g, or t
  modified_base (472)..(472): a, c, t, g, unknown or other
  misc_feature (472)..(472): n is a, c, g, or t
  modified_base (478)..(478): a, c, t, g, unknown or other
  misc_feature (478)..(478): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctanactggtgtcacagtgtcttcacccatcctccgggacagacttaccatgaccacgaactcctccataaacacagcctacatggagttgaggagcctgacatctgacgacacggccgtctattactgtgcgagacgtcccacgntccggngacgcctacggcagcggcctttgccttcgtcgggg

SEQ ID NO: 206077 - DNA, 513 bp, Homo sapiens
  misc_feature: GYAE6OF01D9N9W.17.25.C03.1.454.CMB.1.raw
  modified_base (319)..(319): a, c, t, g, unknown or other
  misc_feature (319)..(319): n is a, c, g, or t
  modified_base (348)..(348): a, c, t, g, unknown or other
  misc_feature (348)..(348): n is a, c, g, or t
  modified_base (498)..(498): a, c, t, g, unknown or other
  misc_feature (498)..(498): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggaggcaccttcagcgactatagtttcaattgggtgcgacgggcctctggacaaggccttgagtggatgggaagntcgtcctatcgtgacacaccaaatcccgnacagaagttccagggcagactcaccataaccgcgacaaattaacgaacacagttaatctaggagactagaacagcctgtcatctgaggacacggcttctacttctgtgcgaggagtaatactataacatgtcttcctttacaccttcctntacttctgggctacg

SEQ ID NO: 206078 - DNA, 507 bp, Homo sapiens
  misc_feature: GYAE6OF01D006R.17.25.C03.1.454.CMB.1.raw
  modified_base (361)..(361): a, c, t, g, unknown or other
  misc_feature (361)..(361): n is a, c, g, or t
  modified_base (390)..(390): a, c, t, g, unknown or other
  misc_feature (390)..(390): n is a, c, g, or t
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggcgttaaaacctatttaaattggtatcagcagaaacctggaaaagccccagacctctgatctctggtgcatccactctgcgaagtggctccatcgagttcagtgcagtgatctgggacagtatttcaatcncacatcaccactctgcaactgagtattgngcaatctactactgtcaacagagttacacgttcccctcgtctactttcggccgtaaggggaacctaaaggttgagtaactacaaacgtaacgtgtggctcgaccaccatctggttcc

SEQ ID NO: 206079 - DNA, 572 bp, Homo sapiens
  misc_feature: GYAE6OF01CW0HA.17.25.C03.1.454.CMB.1.raw
  modified_base (259)..(259): a, c, t, g, unknown or other
  misc_feature (259)..(259): n is a, c, g, or t
  modified_base (277)..(277): a, c, t, g, unknown or other
  misc_feature (277)..(277): n is a, c, g, or t
  modified_base (286)..(286): a, c, t, g, unknown or other
  misc_feature (286)..(286): n is a, c, g, or t
  modified_base (442)..(442): a, c, t, g, unknown or other
  misc_feature (442)..(442): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctgggcctcagtgaaggtctcctgcaaggcttctggattcacgtttaccnctatagtatcaactggtncgcaggccntggacaacgctgagtggatgggatcgggacgaaccctaagacgtggtcgtcacgagtgtcttccacccgtatcccgtccgggacacgtacttaccgatcggaaccaacgaacctcctaccaataaaccacagtacctacatgggagttagacggancccgtagacatctgaaccgacgaacgggtcctactattaacgtgtgcgaagacctcccgaacgtacgtcccgggtgaacgcccgtaacggcgtaacggtccgtacccttttgacccgtttggaccggggg

SEQ ID NO: 206080 - DNA, 552 bp, Homo sapiens
  misc_feature: GYAE6OF01CO8QX.17.25.C03.1.454.CMB.1.raw
  modified_base (295)..(295): a, c, t, g, unknown or other
  misc_feature (295)..(295): n is a, c, g, or t
  modified_base (379)..(379): a, c, t, g, unknown or other
  misc_feature (379)..(379): n is a, c, g, or t
  modified_base (430)..(430): a, c, t, g, unknown or other
  misc_feature (430)..(430): n is a, c, g, or t
  modified_base (436)..(436): a, c, t, g, unknown or other
  misc_feature (436)..(436): n is a, c, g, or t
tcagcgtagactagcacgaccggtgctcgatttagtagtgtagatttgggtttgggggaacgtcgaacaaccacatctgtcctcgtagagaaaaccctgtgagcacagctcctcaccactggactggacctggaggatcctcttcttggtggcagcagctacaagtgcccactcccaggtcgcagctggtgccagtctggggctgaggtgaagaagccgtggggcctcgagtgaaggtctcctgacaaggcttctggattctacgtttaacctcctatagtatcaacgtgggtcncgccaggccgctaggaacaacgcctgagtggatgggatgggaccaaccctaacgacgtggtgtcacgtagtgtccttcaccctntcccgtcgggacacgacttacatcgaccacgaactcctaccaataacacanacctanagtggagttgagagtctagacatcagacacgacggtctactattacgtgtgcgagacgccgacgtacgtcggtagacgccgtacggcgtacgccggtactttcgcgttcggtcggg

SEQ ID NO: 206081 - DNA, 531 bp, Homo sapiens
  misc_feature: GYAE6OF01D2ZA3.17.25.C03.1.454.CMB.1.raw
  modified_base (308)..(308): a, c, t, g, unknown or other
  misc_feature (308)..(308): n is a, c, g, or t
  modified_base (516)..(516): a, c, t, g, unknown or other
  misc_feature (516)..(516): n is a, c, g, or t
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctgtggtgggggtcagagtcaccatcacttgccggacaagtcacggacgttaaaacctatttaaattggtatcagacaagaaacctaggaaaacgccccaagaccctctgactctcgtggtncactccactctgacgaagtcgcgtccagtcgagttcaggtgacagtgatcgtggacagtatttcaattctacacctatccacctactctgacaacgtggagtattgcgactaatctactactgtacaagtagtacttacgtacgttccctcgtacttacgtttggaccgagggaacctaagtgagtactacgaaacgactcgcgaccncacatctgtcttacg

SEQ ID NO: 206082 - DNA, 550 bp, Homo sapiens
  misc_feature: GYAE6OF01CIID4.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggagtcgggacgaaccctaacacgtggtgtcacgagtgtcttcacccatcctccgggacacgacttaccatcgaccacgaactccctaccaactaaacacacgcctaacagtaggagttgaggacgcctgacatctgacgacaccggccttactacttacgtgtcgacgtagacgtcccacgtacgtccggtgacgccgtacggcacggccggtactttcgtacgttcggtacgggg

SEQ ID NO: 206083 - DNA, 532 bp, Homo sapiens
  misc_feature: GYAE6OF01D0OJW.17.25.C03.1.454.CMB.1.raw
  modified_base (280)..(280): a, c, t, g, unknown or other
  misc_feature (280)..(280): n is a, c, g, or t
  modified_base (291)..(291): a, c, t, g, unknown or other
  misc_feature (291)..(291): n is a, c, g, or t
  modified_base (337)..(337): a, c, t, g, unknown or other
  misc_feature (337)..(337): n is a, c, g, or t
  modified_base (410)..(410): a, c, t, g, unknown or other
  misc_feature (410)..(410): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgntggacaacgcctgagtggatgggatgggcgaaccctaacactggtntcacagtgtcttcaccctatcctccgggacagacttaccatgaccacgaactcctaccataaacacagcctanatggagttgacggagcctgacatctagacgacacggcctctattactgtgcgagacgtcccagctccgggtgacggcccgtacggcctacggccggtcccttttggcgtttcggtacggggg

SEQ ID NO: 206084 - DNA, 534 bp, Homo sapiens
  misc_feature: GYAE6OF01DVA4V.17.25.C03.1.454.CMB.1.raw
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatcctccctgtctgcctctggtgggggtcagagtcaccatcacttgccggacaagtcacggacgttaaaacctatttaaattggtatcagcagaaacctggaaaagcccagacctcctgatctctggtgcatccactctgcgaagtggctccatcgaggttcagtgcagtgatcgtggacagtatttcaattctacaccatcacctactctgacaactgagattgtgctaatctactactgtacaactagtacgttactacgttcccctcgtctacgttttcggaccgtacggggtaacctaaaggttgaacggtactaaccgaaacggtaacgttaggtcggctcgaccactactcttgttacc

SEQ ID NO: 206085 - DNA, 556 bp, Homo sapiens
  misc_feature: GYAE6OF01CY172.17.25.C03.1.454.CMB.1.raw
  modified_base (331)..(331): a, c, t, g, unknown or other
  misc_feature (331)..(331): n is a, c, g, or t
  modified_base (477)..(477): a, c, t, g, unknown or other
  misc_feature (477)..(477): n is a, c, g, or t
  modified_base (484)..(484): a, c, t, g, unknown or other
  misc_feature (484)..(484): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagagcctggggcctcagtgaaggtctcctgcaaggcttctggattcacgtttacctctatagtatcaactgggtgcgccaggccgctggacaacgacctgagtggatgggatgggacgaaccctaanacgtggtgtcaactagtcgtccttcaacccctatcccgtccgggactacgacctttaccagtcgaacccacgtaacctccctaccaataaacacacgacctaacagtggagttgacgagcctagacatctagacgacacggtcctntattacngtgacgagcgtacccgagtacgtccggtgacgccgtacggcgtacggccggtcctttcgcgttcggtcgggg

SEQ ID NO: 206086 - DNA, 530 bp, Homo sapiens
  misc_feature: GYAE6OF01EI6GY.17.25.C03.1.454.CMB.1.raw
  modified_base (519)..(519): a, c, t, g, unknown or other
  misc_feature (519)..(519): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctgggacaacgacctgagtggatgggatgggcgaaccctaacactggtgtcacagtgtcttcacccatcctccgggacagacttaccatgaccacgaactcctccataaacacagcctacatgggagttggggagcctagacatcgtgacgacacggccgtctattactgtgcgagagtcccagactccggtgacggcctacggcacggccggcctttggaactttcgngggggtacccg

SEQ ID NO: 206087 - DNA, 515 bp, Homo sapiens
  misc_feature: GYAE6OF01AUL6O.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcaaccctaacactggtgtcacagtgtcttcacccatcctcgggacagacttaccatcgaccacgaactcctccataaacacagcctacatggagttgaggagcctgacatctgacgacacggcctctattactgtgcgagacgtcccgacgctcccggtgacgccgtacggcaggcggcctttgcgttcgcgggg

SEQ ID NO: 206088 - DNA, 526 bp, Homo sapiens
  misc_feature: GYAE6OF01CWTV0.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatggggacaaccctaacactggtgtcacagtgtcttcaccctatccgtccgggacagacttaccatcgaccacgaactcctaccaataaacacagcctacatggagttgaggagcctgacatctgacgacacggtccgtctattactgtgcgagacgtcccacgcgtccggtgcgccgtacggcacggcgtcctttcgccgttcgtcgggg

SEQ ID NO: 206089 - DNA, 568 bp, Homo sapiens
  misc_feature: GYAE6OF01DIQNW.17.25.C03.1.454.CMB.1.raw
  modified_base (331)..(331): a, c, t, g, unknown or other
  misc_feature (331)..(331): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgcaggccgctggacaacgacctgagtggatgggatgggcgaaaccctaanactggtgtcacagtgtcttcaaccctatcccgtaccggggactacggactttaaccagtcgaccaacgtaacctcctaccaataaacacacgacctaacataggagttgaggacgcctagacatctgacgacgacggtccgtatattactgtgcgagacgtcccacggtactcccgggtagacgacccgtacgggaccacgggtcccggtccttttaggaccgttcggtaccggggg

SEQ ID NO: 206090 - DNA, 519 bp, Homo sapiens
  misc_feature: GYAE6OF01BO3MB.17.25.C03.1.454.CMB.1.raw
  modified_base (330)..(330): a, c, t, g, unknown or other
  misc_feature (330)..(330): n is a, c, g, or t
  modified_base (424)..(424): a, c, t, g, unknown or other
  misc_feature (424)..(424): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgcctgagtggatgggatgggacaaccctaanactggtgtcacagtgtcttcactcatcctccgggacagacttaccatcgaccacgaactcctaccataaacacacgcctacatggagttgaggncctgacatctgacgacacggcctctattactgtgcgagacgtcccgacgagtccggtgacgccctacggcacggccggtcctttggaccgttcgg

SEQ ID NO: 206091 - DNA, 515 bp, Homo sapiens
  misc_feature: GYAE6OF01B7FX3.17.25.C03.1.454.CMB.1.raw
  modified_base (331)..(331): a, c, t, g, unknown or other
  misc_feature (331)..(331): n is a, c, g, or t
  modified_base (424)..(424): a, c, t, g, unknown or other
  misc_feature (424)..(424): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaanactggtgtcacagtgtcttcacccatcctccgggacagacttaccatgaccacgaactcctcataaacacacgcctacatggagtttgaggancctgacatctgacgacacgggccgtctattactgtgcgagacgtcccagctccggtgacgcctacggctagccggcctttgcttcgcgggg

SEQ ID NO: 206092 - DNA, 527 bp, Homo sapiens
  misc_feature: GYAE6OF01BEZ89.17.25.C03.1.454.CMB.1.raw
  modified_base (435)..(435): a, c, t, g, unknown or other
  misc_feature (435)..(435): n is a, c, g, or t
  modified_base (442)..(442): a, c, t, g, unknown or other
  misc_feature (442)..(442): n is a, c, g, or t
  modified_base (519)..(519): a, c, t, g, unknown or other
  misc_feature (519)..(519): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtacccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcaacctaacacgtggtgtcacagtgtcttcacccatccgtccgggacagacttaccatcgaccacgactcctaccaataacacacgcctacactggagttgaggagctgacatcngacgacncggcgtctacttctgtgcgagcgtcccagacgtccggtagacgcccgtacggcacggtccgtcctttgaccttcggnggggaccg

SEQ ID NO: 206093 - DNA, 672 bp, Homo sapiens
  misc_feature: GYAE6OF01CYVSS.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattctaccgtttacctcctatagtatcaacgtgggtgcgccgaggcccgcgtggaacaacgacctggagtgggatggggatcggggacgaaccctaacgacgttggtacgttcaactagttgtcctttaccgaacccctaactcccgtacccggggactaacggtaacctttaccaatcgaacccaacgtaaccctcctaacctaataaaacccactaacgtaccctaacaattcgggaacgttaggaacggactcccgtagaacctatcgtacgaaccgacccgtaccgggtcccgttactaactttaccgtggttacgacggtaacggaccgttaccccaacggtacgtcccgggttagaaccggtcccgtaacgggccgtaacggcccggtaccgttttacggacgtttccgggtaccggggg

SEQ ID NO: 206094 - DNA, 523 bp, Homo sapiens
  misc_feature: GYAE6OF01DLA6Y.17.25.C03.1.454.CMB.1.raw
  modified_base (333)..(333): a, c, t, g, unknown or other
  misc_feature (333)..(333): n is a, c, g, or t
  modified_base (439)..(439): a, c, t, g, unknown or other
  misc_feature (439)..(439): n is a, c, g, or t
  modified_base (471)..(471): a, c, t, g, unknown or other
  misc_feature (471)..(471): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctgggggcctcagtgaaggtctcctgcaaggcttctggattcacgtttacctcctatagtatcaactgggtgcgccaggccgctggacaacgacctgagtggatggggatgggacaaccctaanactggtgtcacagtgtccttcacccatccctccgggacagacttaccatcgaccacgaacctcctaccaataaacacagacctacatggagttgaggagcctgacntctgacgacacggccgtctattactgtgcgancgtcccacgtactccgggtgacgccgtacggcagccgtctttgcttgcgggg

SEQ ID NO: 206095 - DNA, 538 bp, Homo sapiens
  misc_feature: GYAE6OF01BDY4O.17.25.C03.1.454.CMB.1.raw
  modified_base (280)..(280): a, c, t, g, unknown or other
  misc_feature (280)..(280): n is a, c, g, or t
  modified_base (331)..(331): a, c, t, g, unknown or other
  misc_feature (331)..(331): n is a, c, g, or t
  modified_base (338)..(338): a, c, t, g, unknown or other
  misc_feature (338)..(338): n is a, c, g, or t
  modified_base (404)..(404): a, c, t, g, unknown or other
  misc_feature (404)..(404): n is a, c, g, or t
  modified_base (468)..(468): a, c, t, g, unknown or other
  misc_feature (468)..(468): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgcaggccgctggacaacgacctgagtggatgggatgggacgaaccctaanactggtntcacagtgtcttcacccatcctccgggacaggacttaccatcgaccacgaactcctaccataaacncagcctaacatcggagttagaggagcctgacatctagaccgacgacgggcccgttatacttacnggtgcgagacgtacccaggtactccggtgcgccctaggcacggccggtactttcggacgttcgtcggggg

SEQ ID NO: 206096 - DNA, 562 bp, Homo sapiens
  misc_feature: GYAE6OF01AJQFZ.17.25.C03.1.454.CMB.1.raw
  modified_base (330)..(330): a, c, t, g, unknown or other
  misc_feature (330)..(330): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgcctgagtggatgggatgggcgaaccctaanactggtgtcacagtgtcttcacccatcctccgggacagacttaccatcgaccacgaacctcctaccaataaaccacacgcctacatggagttgaggagcctgacatctgaccgacgaccggtccgttactattaccgtgtcgcgagtaccgtccccacggtacgttcccgggtagaccgcccgtacgggccacgggtcccggtaccttttcggaccgtttcggtaccggggg

SEQ ID NO: 206097 - DNA, 535 bp, Homo sapiens
  misc_feature: GYAE6OF01B2PYK.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctaccaataaacacacgcctaacatggagttgaggacgcctgacatctgacgacgacggtccgtctaattactgtcgcgacgtacgtcccacggctccgggtgacgccgtacggcacggccggtcctttcgccgttcggtcgggg

SEQ ID NO: 206098 - DNA, 524 bp, Homo sapiens
  misc_feature: GYAE6OF01CALKA.17.25.C03.1.454.CMB.1.raw
  modified_base (331)..(331): a, c, t, g, unknown or other
  misc_feature (331)..(331): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaanactggtgtcacagtgtcttcacccatcctcgggacagacttaccatcgaccacgaactcctaccataaacacagcctacatggagttgaggagcctgacaatctgacgacgacggcctctattactgtgcgagacgtcccagacgtccggtgacgcccgtacggcacggcggtcctttgccgttcgtcggggg

SEQ ID NO: 206099 - DNA, 667 bp, Homo sapiens
  misc_feature: GYAE6OF01B9EIV.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagccgtggggcctcagtgaaggtctcctgcaaggcttctggattcacgtttacctctatagtatcaactggtgcgccaggccgctggacacgacctgagtggatgggatgggccaacctagactggtgtcacagtcgtcttcaccctatccgtacgggacagtacttaccatcgaaccacgtaacctcctaccaactaaacaccacgtacctaacagtgggtaacgttggaacggtacgcccttaggaactacgttcgtaggaaccggaccgtaccgggtacccgttacttaacgtttaccgtcggttacggaccggtaacggtaccggttacccccgaacgggttaccggttacccggggttaggaacccgggtaccccggttaaacgggcccggtaacgggttaccccgggttacccgttttttacgggaacccggttttccggggtaacccgggggggg

SEQ ID NO: 206100 - DNA, 527 bp, Homo sapiens
  misc_feature: GYAE6OF01DRX23.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactggtgcgccaggccgctggacaacgacctggagtggatgggatgggcgaaaccctaacgactggtgtcacagtgtcttcacccatccgtccgggacagacttaccatcgaccacgaacctcctaccataaacacacgcctacatgagttgaggagcctgacatctgacgacacggccgtctattactgtgcgagacgtcccacgcgtccggtgacggcctacggcgacgcggtcctttcgcgttcggtcgggg

SEQ ID NO: 206101 - DNA, 529 bp, Homo sapiens
  misc_feature: GYAE6OF01BWVOG.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacacgtggtgtcacagtgtcttcacccatcctcgggacagacttaccatgaccacgaactcctccaataaacacagcctacatgagttgagagcctgacatctgacgacacggtccgtctattactgtgcgagacgtcccagtacgtccggtagcgcccgtacggcgacggtccggtccttttcgcgttcggtacggggg

SEQ ID NO: 206102 - DNA, 527 bp, Homo sapiens
  misc_feature: GYAE6OF01EWF2G.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcaaccctaacactggtgtcacagtgtcttcacccatcctccgggacagacttaccatcgaccacgaactcctaccataaaccacacgcctaacatggagttgacggagcctgacatctgacgacacggcctctattactgtgcgagacgtcccgagactccgggtgacgcccgtacggcacggcggtcctttggccttcgtcggggg

SEQ ID NO: 206103 - DNA, 569 bp, Homo sapiens
  misc_feature: GYAE6OF01BITV2.17.25.C03.1.454.CMB.1.raw
  modified_base (281)..(281): a, c, t, g, unknown or other
  misc_feature (281)..(281): n is a, c, g, or t
  modified_base (354)..(354): a, c, t, g, unknown or other
  misc_feature (354)..(354): n is a, c, g, or t
  modified_base (423)..(423): a, c, t, g, unknown or other
  misc_feature (423)..(423): n is a, c, g, or t
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctcgtggtgggggtcagagtcaccatcacttgccggacaagtcacggacgttaaaacctatttaaattggtatcagcaagaaacctaggaaaacncccaagacctctgatctcgtggtgcactccactctgcgaagtcgccgtccatcgagttcagtgcagtgatcgnggacagtatttcaatcacacatcacctactctacacaaccgtgaggtattgtgactaactctactactntacaacagtacttactacgttcccctacgtacttacgtttcggaccgtaacggggtaacctaaaggttcgaacgtaacgttaaccgaaaacggtaacgttacggtacggtaccgtacgaccctaacctacgttccgttcgttaccc

SEQ ID NO: 206104 - DNA, 671 bp, Homo sapiens
  misc_feature: GYAE6OF01C18AU.17.25.C03.1.454.CMB.1.raw
  modified_base (218)..(218): a, c, t, g, unknown or other
  misc_feature (218)..(218): n is a, c, g, or t
  modified_base (280)..(280): a, c, t, g, unknown or other
  misc_feature (280)..(280): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctgggctgaggtgaagaagcctggggcctnagtgaaggtctcctgcaaggcttcgtggattcacgtttacctcctatagtatcaactgggtncgcaggccgctgacaacgctgagtggatgggatgggacgaaccctaagactggtactcacgagttcgtccttcaacccctatcccgtcccgggacagtaccttacatcgaccacgaacctcctaccaataaaccacacgaccctaacagtgggtaacgtttggaacggtacgcccgttaggaacctacgttacgtacggaaccggaacccgtaaccgggtcccggttacttaaacgttttacccgtgggttccggaccgggtaaacggtaccggttacccccgaacgggtaaccgttccccggggttaggaacccggtaccccgtaaaccgggccgtaaacgggtcccgggttacccttttacgggacccgtttcgggtaacccggggggg

SEQ ID NO: 206105 - DNA, 800 bp, Homo sapiens
  misc_feature: GYAE6OF01BNZFW.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctgggctgaggtgaagagccgtggggctcagtgaaggtctcctgcaaggcttctggattctacgtttacctctatagtatcaacgtgggtgaccgccgaggtcccgctggaccaacgcctggacgtggatggggatcggggaccgtaaccctaagaccgttgggtcgtacacgtaaggttcgtacctttacgaacccctaagttccccgttaaccgggggacctaacgggtaacccttttaacccgaacgttaccggaaaccccgtaaccggtaaaccccttccccttaaccccgtaaacttaaaaacccgacccgtaaaccgtaccccgttaaacgaacggtttacggggttaacgtttacgggaaacgggtaacccgccccggttaaaggtaccctaacgttcccgtaacgggaacccggtaacccggacccggggttaccccgtttactttaaacggtttaccgtacggttacggaccggtaacggtaccccggttaccccgaaccgggtacggttacccgggttaggaacccgaccccgggttaaggccccggtaaacggttcccgggttaccccttttagggaacccgttttccgggaaccgggggg

SEQ ID NO: 206106 - DNA, 535 bp, Homo sapiens
  misc_feature: GYAE6OF01BHY6O.17.25.C03.1.454.CMB.1.raw
  modified_base (427)..(427): a, c, t, g, unknown or other
  misc_feature (427)..(427): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggacgaaccctaacgactggtgtcacagtcgtcttcacccatcctccgggacagactaccatcgaccacgaactcctaccataaacacagcctacatggagttgaggancctgacatctgacgacgacggcctactattactgtgcgagcgtcccacgacgtcccgggtagacgcccgtacggcgacggtccggtaccttttggccgttggtcgggg

SEQ ID NO: 206107 - DNA, 552 bp, Homo sapiens
  misc_feature: GYAE6OF01EXEO7.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctggagtggagtgggatcgggacgaaccctaacacgtaggtgtcacagtgtcttcacccatcctcgggacagactaccatcgaccacgaacctcctaccaataaacacacgccctacagtggagttagaggacgcctgacatctgacgacgacggtccgtactattactgtgcgacgacgtacccgacgtacgtccgggtcgcgcccgtacggccgtacggccggttaccgtttcgcgttcggtccgggg

SEQ ID NO: 206108 - DNA, 550 bp, Homo sapiens
  misc_feature: GYAE6OF01CUGJZ.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaggtctcctgcaaggcttctggattcacgtttacctcctatagtatcaacgtgggtgcgccaggccgctggacaacgacctgagtggatgggatgggaccgaaccctaacacgtggtcgtcacgtagtcgtccttacgaccctatcccgtaccggggacacgtacttaccatcgaccacgacctcctacaataacacacgcctacatcggagttgaggacgccgtgacatcgtgaccgacgacggtccgttactacttacgtgtgcgagacgtacccacgcgtccggtgacgccgtacggcacggcgtcctttcggcgttcgtcgggg

SEQ ID NO: 206109 - DNA, 586 bp, Homo sapiens
  misc_feature: GYAE6OF01BB765.17.25.C03.1.454.CMB.1.raw
  modified_base (280)..(280): a, c, t, g, unknown or other
  misc_feature (280)..(280): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgcaggccgctggacaacgacctgagtggatgggatgggccgaaccctaacactggtgtcacagtcgtcttcacccatccgtccgggacacgacttaccatcgaccacgaacctcctaccaataaacacacgcctacatggagttgaggagcctgacactcgtagaccgacgaccgggtcccgttactaacgtttacgtaggtcgaccgtaggtaccgtaccccacggtacgttcccgggtaggaccggacccgtaacgggccaacgggtcccggtacctttcggtacccgttcgggtaccggggg

SEQ ID NO: 206110 - DNA, 620 bp, Homo sapiens
  misc_feature: GYAE6OF01DUZ43.17.25.C03.1.454.CMB.1.raw
  modified_base (274)..(274): a, c, t, g, unknown or other
  misc_feature (274)..(274): n is a, c, g, or t
  modified_base (301)..(301): a, c, t, g, unknown or other
  misc_feature (301)..(301): n is a, c, g, or t
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatcctccctgtctgcctctggtggggtcagagtcaccatcacttgccggacaagtcacggacttaaaactatttaaattggtatcagcaagaaacctggaaaacncccagacctcctagactctcgtggtcncactccactctggaccgaagtcggccgtccagtcgaggttcagtcggcaggtggatcgtggggaactagtacttttacgaattcctactaaccactacctaaccctaccttactcgtaacctaaccgtcggtaaggtacgtttcgtaggtactaaattccttaacttaactacggtaaccaaacgtacggtaacgtttacctaccgttccccttacgtccttaccgttttacggacccgtaagggaacctaaacggttagaacgtaacgtacaaacggtacgtacggtacggccgtacgactaaccacgttctgttacc

SEQ ID NO: 206111 - DNA, 592 bp, Homo sapiens
  misc_feature: GYAE6OF01B4QJI.17.25.C03.1.454.CMB.1.raw
  modified_base (296)..(296): a, c, t, g, unknown or other
  misc_feature (296)..(296): n is a, c, g, or t
tcagcgtagactagcacgaccggtgctcgatttagtagtgtagatttgggtttgggagtcagttcgtctagtcaggacacagcatggacatgagggtaccccgactcagctcctggggctcctgctactctggctccgagctgccagatcgtgacatccagatgacccagtctccatcctcctgtcctgcctctgtggggtcagagtcaccatcacttgccggacaagtccacggacgttaaaacctatttaaattggtatcagcagaaacctggaaaacgccccagacccgtcgngatctgtggtgcatccactctgacgagtcggctcccagtcgaggttcagtggacaggtgatcgtaggacagtactttcgaaacttcctaccacgactcaccctactctagcctaaccgtgtagtattcgtacgtacaacttcctactacgttcgttacaactagtacgttacctacgttaccccctcgtacttacgtttcgggaccggtaacggggtaaccttaaggttgaacgtacttaccgaaaacggtcttacggttagcgttacgaccgaaccgtacgttccgtggttaccc

SEQ ID NO: 206112 - DNA, 538 bp, Homo sapiens
  misc_feature: GYAE6OF01EN19Y.17.25.C03.1.454.CMB.1.raw
  modified_base (442)..(442): a, c, t, g, unknown or other
  misc_feature (442)..(442): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaaggcttctggattcacgtttacctcctatagtatcaactgggtgcgccaggccgctggacaacgacctgagtggatgggatggggacgaacccctaaacgacctggtgtcacagtgtcttcacccatccctcgggacagacttaccatcgaccacgaactcctaccataaacacacgcctacatggagttgagtacgcctgacatcngaccgacgacggccgtctattactgtgcgagacgtacccacggactccggtgcggcctacggcgacggtcggacctttgaccgttcggtaccgggg

SEQ ID NO: 206113 - DNA, 553 bp, Homo sapiens
  misc_feature: GYAE6OF01D3I0T.17.25.C03.1.454.CMB.1.raw
  modified_base (331)..(331): a, c, t, g, unknown or other
  misc_feature (331)..(331): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaaatgggtgcgccaggccgctggacaacgcctgagtggatgggatgggacgaaccctaanactggtgtcacagtgtcttcacccatccgtcgggacagacttaccatcgaccacgaactcctaccaataaacacacgcctacagtcggtagttgaggtacgcccgtagacatcgtacgaacgaccgaccggtccgttactattactgtcgcgtagacgtcccacgtacgtccggtagacgcccgtacggcacggtccggtcctttgaccgttcggtacgggg

SEQ ID NO: 206114 - DNA, 541 bp, Homo sapiens
  misc_feature: GYAE6OF01D2RSC.17.25.C03.1.454.CMB.1.raw
  modified_base (250)..(250): a, c, t, g, unknown or other
  misc_feature (250)..(250): n is a, c, g, or t
  modified_base (286)..(286): a, c, t, g, unknown or other
  misc_feature (286)..(286): n is a, c, g, or t
  modified_base (433)..(433): a, c, t, g, unknown or other
  misc_feature (433)..(433): n is a, c, g, or t
tcagcgtagactagcacgaccggtgctcgatttagtagtgtagatttgggtttgggggacgtcaacaaccacatctgtcctctagagaaaaccctgtgagcacagctccttcaccatggactggacctggaggatcctcgttcttggtggcagcagctacaagtgcccactccccaggtgcagctggtcgcagtctggggctgaggtgaagagcctggggcctcgagtgaaggtctcctgcaaggcttcnggattcacgtttacctcctatagtatcaactgggtncgccaggccgctggacaacgacctgagtggatgggatgggcaaccctaacactggtgtcacagtgtcttcaccccatccctcgggacagacttaccatcgaccacgaactccctaccataaacacagacctacatggagttgaggancctgacatctgacgacacggtccgtactacttacgtgtcgacgagacgtccccacgactcccgggtgacgccctacggcacggccggcctttgccttcggtacggggg

SEQ ID NO: 206115 - DNA, 550 bp, Homo sapiens
  misc_feature: GYAE6OF01DVEH6.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatccctccgggacagacttaccatacgaccacgaactcctaccactaaacacagacctacatggagttgaggagcctgacatctagacgacgaccggccgtactattacctgtcgcgagtacgtcccacgactccgggtggtacggcccgtacggacgacggccggtcccgtttacgccgtttcggtaccggggg

SEQ ID NO: 206116 - DNA, 520 bp, Homo sapiens
  misc_feature: GYAE6OF01BE0D5.17.25.C03.1.454.CMB.1.raw
  modified_base (280)..(280): a, c, t, g, unknown or other
  misc_feature (280)..(280): n is a, c, g, or t
  modified_base (409)..(409): a, c, t, g, unknown or other
  misc_feature (409)..(409): n is a, c, g, or t
  modified_base (423)..(423): a, c, t, g, unknown or other
  misc_feature (423)..(423): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacaacgacctgagtggatgggatgggcaaccctaacactggtgtcacagtgtcttcacccatcctccgggacagacttaccatgaccacgaactcctaccataaacacagcctanatggagttgaggancctgacatctagacgacacggccgttctattactgtgcgagacgtcccagactccgggtgacgcctacggcaggccggtcctttgacttcgtcgggg

SEQ ID NO: 206117 - DNA, 593 bp, Homo sapiens
  misc_feature: GYAE6OF01ECN1O.17.25.C03.1.454.CMB.1.raw
  modified_base (187)..(187): a, c, t, g, unknown or other
  misc_feature (187)..(187): n is a, c, g, or t
  modified_base (340)..(340): a, c, t, g, unknown or other
  misc_feature (340)..(340): n is a, c, g, or t
  modified_base (455)..(455): a, c, t, g, unknown or other
  misc_feature (455)..(455): n is a, c, g, or t
  modified_base (553)..(553): a, c, t, g, unknown or other
  misc_feature (553)..(553): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctgggtacngtctgggcggtgaggtggaagaaagactcggggcggtccagtgaaggtacgtcctcgcgaaggacgttcttggagttctacgttaaccttcctactagtatcaactaggtgcgccacgcgcctgagaacgaacctcgagtggagtggagtggnggaaccctaaacaactggtggtcacagtggtcttctacccaactctcccgggacgacacgttacctaactgaccaaccgaactacctccaataaacaacaacgctaaccataggngttgaggaggcctgacaatctgacgaaccacggccggtccttaattaactgtgtcgaacgagtcccaccgaagttcccgtcggagccctaacccgggngacgacgggtcccgtttagtacttcgttggggaccccggg

SEQ ID NO: 206118 - DNA, 532 bp, Homo sapiens
  misc_feature: GYAE6OF01D6KD3.17.25.C03.1.454.CMB.1.raw
  modified_base (291)..(291): a, c, t, g, unknown or other
  misc_feature (291)..(291): n is a, c, g, or t
  modified_base (405)..(405): a, c, t, g, unknown or other
  misc_feature (405)..(405): n is a, c, g, or t
  modified_base (413)..(413): a, c, t, g, unknown or other
  misc_feature (413)..(413): n is a, c, g, or t
  modified_base (458)..(458): a, c, t, g, unknown or other
  misc_feature (458)..(458): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgntggacaacgacctgagtggatgggatgggcgaaccctaacacgtggtgtcactagtcgtcttcacccatccgtccgggacagacttaccatgaccacgaactcctacataaacncagcctanatgagttgaggagcctgacatctgacgacacgggcctctattacngtgcgagcgtcccgacgtactccgggtagcggaccgtacggcacggaccggtcctttcggcgttcggtcggggg

SEQ ID NO: 206119 - DNA, 547 bp, Homo sapiens
  misc_feature: GYAE6OF01DATSN.17.25.C03.1.454.CMB.1.raw
  modified_base (281)..(281): a, c, t, g, unknown or other
  misc_feature (281)..(281): n is a, c, g, or t
  modified_base (331)..(331): a, c, t, g, unknown or other
  misc_feature (331)..(331): n is a, c, g, or t
  modified_base (406)..(406): a, c, t, g, unknown or other
  misc_feature (406)..(406): n is a, c, g, or t
  modified_base (416)..(416): a, c, t, g, unknown or other
  misc_feature (416)..(416): n is a, c, g, or t
  modified_base (453)..(453): a, c, t, g, unknown or other
  misc_feature (453)..(453): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgttttacctcctatagtatcaactgggtncgccaggccgctggacaacgcctgagtggatgggatgggcgaaccctaanactggtgtcacgagtgtcttcaccccatcctccgggactagacttaccatcgaccacgacctctaccataaaccncacgcctaanatggtagttgaggacgcctagacatcgtacgacgacnccgggtaccgtctactttacgtgtgacgagacgttcccagtacgtcccggtgacgtccctaggcacggcgtcctttcggccgttggtccggggg

SEQ ID NO: 206120 - DNA, 530 bp, Homo sapiens
  misc_feature: GYAE6OF01D497U.17.25.C03.1.454.CMB.1.raw
  modified_base (280)..(280): a, c, t, g, unknown or other
  misc_feature (280)..(280): n is a, c, g, or t
  modified_base (333)..(333): a, c, t, g, unknown or other
  misc_feature (333)..(333): n is a, c, g, or t
  modified_base (403)..(403): a, c, t, g, unknown or other
  misc_feature (403)..(403): n is a, c, g, or t
  modified_base (425)..(425): a, c, t, g, unknown or other
  misc_feature (425)..(425): n is a, c, g, or t
  modified_base (432)..(432): a, c, t, g, unknown or other
  misc_feature (432)..(432): n is a, c, g, or t
  modified_base (435)..(435): a, c, t, g, unknown or other
  misc_feature (435)..(435): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacaacgacctggagtggatgggatgggacgaaccctaanactggtgtcacagtgtcttcacccatcctcgggacagacttaccatcgaccacgaactcctacataaacncagcctacatggagttgaggancctgacntcngacgataccggcgttctattctgtgacgagacgtacccaggtactccgggtgacgccctacggcacggcggtaccttttggccttcggtacgggg

SEQ ID NO: 206121 - DNA, 674 bp, Homo sapiens
  misc_feature: GYAE6OF01DWMZ3.17.25.C03.1.454.CMB.1.raw
  modified_base (288)..(288): a, c, t, g, unknown or other
  misc_feature (288)..(288): n is a, c, g, or t
  modified_base (348)..(348): a, c, t, g, unknown or other
  misc_feature (348)..(348): n is a, c, g, or t
  modified_base (448)..(448): a, c, t, g, unknown or other
  misc_feature (448)..(448): n is a, c, g, or t
tcagcgtagactagcacgaccggtgctcgatttagtagtgtagatttgggtttggggactcaacaaccacatctgtcctctagagaaaaccctgtgagcacagctccctcaccatggactggacctggaggatcctcttcttggtgcagcagctacaagtcgcccactcccaggtgcagctggtgcagtcgtggggctggaggtgaagaagccgtggggcctcagtgaggtctcctgacaaggcttcgtggattctacgtttacctcctatagtatcaacgtgggtcncgccgacggccgcgtggaacaaccgccgtgagtggagtgggagtcgggacgaaccctaancgtggtcgtcacgtagtgtccttccacctatcccgtcgggacagtaccttacatacgaccaacgtaacctccctaccaactaaaccacgtacgaccctanacgttgggtagttaggaacggacgtcctagaacctatccgtacggaaccggaacccgtaccgggtaccccgtttacttaacgttttacccgttaggttaccggaccggtaaacgtaccccggttacccccgaacggtaaccggttcccggggttaggacccggtaccccgttaccgggacgtaaccgggccggttccttttacggccgtttccgggtaccgggggg

SEQ ID NO: 206122 - DNA, 532 bp, Homo sapiens
  misc_feature: GYAE6OF01COHJK.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacacgacctgagtggatgggatgggaccgaaaccctaacacgtggtgtcacagtgtcttcacccatccctccgggacacgacttaccatcgaccacgaactcctaccaataaacacacgcctacatggagttgaggagcctgacatctgacgacgacggtcctctattactgtgcgagacgtcccacgtctccgggtagcgccgtacggcgacggccggtcctttgcttcggtcgggg

SEQ ID NO: 206123 - DNA, 635 bp, Homo sapiens
  misc_feature: GYAE6OF01DEHTB.17.25.C03.1.454.CMB.1.raw
  modified_base (526)..(526): a, c, t, g, unknown or other
  misc_feature (526)..(526): n is a, c, g, or t
  modified_base (627)..(627): a, c, t, g, unknown or other
  misc_feature (627)..(627): n is a, c, g, or t
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatcgacccagtcctccatccctccctgtctcgcctcgtggtgggggtcagacgtcaccatcacttcggaccggacaacgtccgaacggtaccgtttaaaaaccttattttaaagttggtatcagacaagaaaccgtaggaaaacgccccaagaccctctagacttctcgtggtcacctactcccactcgtaggacgaaggtcggaccgtaccagtcggtaggttcaggtggctaggtggactcgtagggacagttactttacaattcctacacctataccacctacctctcgacctaacgtggaagttattgacgtactaacttactactacgtacgtaacaacgtagtaccgttactacccgtttccccncgtactttacggttacgggaccgtaagggtaacctaaaggttacgaacgtaactaaccgaaacgtcgttggtacgtacctacgaccctaactacttccgtntttacccg

SEQ ID NO: 206124 - DNA, 561 bp, Homo sapiens
  misc_feature: GYAE6OF01E0XK1.17.25.C03.1.454.CMB.1.raw
  modified_base (301)..(301): a, c, t, g, unknown or other
  misc_feature (301)..(301): n is a, c, g, or t
  modified_base (425)..(425): a, c, t, g, unknown or other
  misc_feature (425)..(425): n is a, c, g, or t
  modified_base (433)..(433): a, c, t, g, unknown or other
  misc_feature (433)..(433): n is a, c, g, or t
  modified_base (451)..(451): a, c, t, g, unknown or other
  misc_feature (451)..(451): n is a, c, g, or t
  modified_base (479)..(479): a, c, t, g, unknown or other
  misc_feature (479)..(479): n is a, c, g, or t
tcagcgtagactagcacgaccggtgctcgatttagtagtgtagatttgggtttgggggtactcaacaaccacattcctgtcctctagtagaaaaccctgtgagcacagctcctcaccatggactggacctgggaggatcctcttcttggtgggcagcagctacaagtgcccactcccaggtgcagctggtgcagtctggggctgaggtgaagaagcctggggcctcaggtgaaggtctccgtgcaaggtcttctggattcacgtttacctctaatagtatcaactgggtgcgccaggccgntggacaacgcctgagtggatgggatgggaccgaaacccctaacacgtggtgtcactagtgtaccttacacccatcccgtcgggacaggacttaccatacgaccacgaacctccctacataaacncagcctanatggattgagagctgacntcgtgacgacgaccggtcctcttatcgngtcgcgacgtacgtccccagtcgtccggtgacggtacctacggcctacggtccggtaccctttcggaccttcgggtccgggg

SEQ ID NO: 206125 - DNA, 629 bp, Homo sapiens
  misc_feature: GYAE6OF01C5C9D.17.25.C03.1.454.CMB.1.raw
  modified_base (279)..(279): a, c, t, g, unknown or other
  misc_feature (279)..(279): n is a, c, g, or t
  modified_base (291)..(291): a, c, t, g, unknown or other
  misc_feature (291)..(291): n is a, c, g, or t
  modified_base (330)..(330): a, c, t, g, unknown or other
  misc_feature (330)..(330): n is a, c, g, or t
  modified_base (438)..(438): a, c, t, g, unknown or other
  misc_feature (438)..(438): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctctatagtatcaactgggtncgccaggcccgngtggacaacgacctgagtggatgggatgggcaacctaancgtggtgtacacagtgtcttcacccatccgtcgggacagaccttacatcgaccacgtaactcctaccaataaacacacgacctaacagtcgggaagttgaacgggacnccgtagactatcgtacgaccgaccgaaccgggtcccgttacttacgtttaccgtggtacgtaccggtaacggtaccgtaccccgaacgggttaccgtcccgggttaggaccggtaccccggtaaccgggacccgtaacggggtacccggttacccgttttcgggtaacccgtttcgggtaaccccgggggg

SEQ ID NO: 206126 - DNA, 608 bp, Homo sapiens
  misc_feature: GYAE6OF01DN8S8.17.25.C03.1.454.CMB.1.raw
  modified_base (291)..(291): a, c, t, g, unknown or other
  misc_feature (291)..(291): n is a, c, g, or t
  modified_base (335)..(335): a, c, t, g, unknown or other
  misc_feature (335)..(335): n is a, c, g, or t
  modified_base (449)..(449): a, c, t, g, unknown or other
  misc_feature (449)..(449): n is a, c, g, or t
  modified_base (501)..(501): a, c, t, g, unknown or other
  misc_feature (501)..(501): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattctacgtttacctcctatagtatcaactgggtgcgccaggccncgtggacaacgacctgagtggatgggatgggaccgaaccctaanacgtggtgtacacagtgtcttaccaccctatccgtccgggacacgtacttaccatcgaccacgaacctcctaccaataaaccacacgcctactagtggtaagttaggacggacncccgttagaactacgtcgtacgaaccgacgaccgggtcccttatacgttacnggtacgacggacgtaccgtcccgaagtcgttccgggagacccggtcccgtaccgggacgtacgggtcccggttaccttttcgggtaaccgttccgggtaccgggggg

SEQ ID NO: 206127 - DNA, 737 bp, Homo sapiens
  misc_feature: GYAE6OF01DTOL0.17.25.C03.1.454.CMB.1.raw
  modified_base (221)..(221): a, c, t, g, unknown or other
  misc_feature (221)..(221): n is a, c, g, or t
  modified_base (283)..(283): a, c, t, g, unknown or other
  misc_feature (283)..(283): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagagccgtggggcctnagtgaaggtctcctgcaggcttcgtggattcacgtttacctcctatagtatcaacgtgggtnccgccgaggcccgcgtaggaaccaacgaccgtggacggtgggaagtggggagtcggggaccgtaaacccgtaacgaccgttgggtcgtacgaacgtaggttcgtccttaccacccctacgttcccgtaccggggaactaacggtaaccctttaccgaagttaccggaacccgtaaccgtaaacccttacccgttaaccctaaacttaaaacccgaacctaaaccggtacccttaaaccgtaaggttacggggtaacggtttacgggaaacgggtaccgacccgttacggaacctaacgttccgtaacggtaacccgaccggacccgggtcccgttaacttacgtttaaccgtggtacgaccggtaacgtacccgtacccgacggtacgtacccgggtacgaccgtccgtacggcgtacggtccggtaccgtttcgaccggttcggtaccggggg

SEQ ID NO: 206128 - DNA, 523 bp, Homo sapiens
  misc_feature: GYAE6OF01EXX7T.17.25.C03.1.454.CMB.1.raw
  modified_base (291)..(291): a, c, t, g, unknown or other
  misc_feature (291)..(291): n is a, c, g, or t
  modified_base (336)..(336): a, c, t, g, unknown or other
  misc_feature (336)..(336): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgntggacaacgcctgagtggatgggatgggcaaccctaacactggtntcacagtgtcttcacccatcctccgggacagacttaccatcgaccacgaactcctaccataaacacagcctacatggagttgaggagcctgacatctgacgacacggtcctctattactgtgcgagacgtcccacggacgtccggtgacgccgtacggcaggccggtctttcgacgttcggtcgggg

SEQ ID NO: 206129 - DNA, 526 bp, Homo sapiens
  misc_feature: GYAE6OF01EJ2BI.17.25.C03.1.454.CMB.1.raw
  modified_base (331)..(331): a, c, t, g, unknown or other
  misc_feature (331)..(331): n is a, c, g, or t
  modified_base (413)..(413): a, c, t, g, unknown or other
  misc_feature (413)..(413): n is a, c, g, or t
  modified_base (450)..(450): a, c, t, g, unknown or other
  misc_feature (450)..(450): n is a, c, g, or t
  modified_base (481)..(481): a, c, t, g, unknown or other
  misc_feature (481)..(481): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaanactggtgtcacagtgtcttcaccccatcctccgggacagaccttaccatcgaccacgaacctcctacataaacacagcctanatggagttgagagcctgacatctgacgacacggcctntatctgtgcgagcgtcccagtacgtccgggngcgcccgtacggctacggccgtcctttggaccgttggtccggggg

SEQ ID NO: 206130 - DNA, 567 bp, Homo sapiens
  misc_feature: GYAE6OF01B6K2F.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctggagtggatgggatcgggacgaaaccctaacacgtggtgtcacagtgtcttcacccatccctccgggacagacttaccatcgaccacgaacctccctaccaataaaccacaacgccctaacagtagggagttggagggacgccctgaccatctgaaccgactaccgggccgttactacttacgtgttcgcgtagacgtccccaacgcgttccggtgacgccgtacgggctacggcccggttcctttggccgtttcggcggggg

SEQ ID NO: 206131 - DNA, 561 bp, Homo sapiens
  misc_feature: GYAE6OF01CISPP.17.25.C03.1.454.CMB.1.raw
  modified_base (219)..(219): a, c, t, g, unknown or other
  misc_feature (219)..(219): n is a, c, g, or t
  modified_base (473)..(473): a, c, t, g, unknown or other
  misc_feature (473)..(473): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctnagtgaaggtctcctgcaaggcttctggattcacgtttacctctatagtatcaacgtgggtgcgccaggccgctggacaacgacctgagtggatgggatgggcgaacctacacgtggtcgtacacgagtgtcttacaccctatccgtcgggacagacttaccatcgaccacgaactcctaccaataaacacagcctacagtaggagttagaggtacgcctgacagtctgacgacgaccggccgttactattacgngtacgcgacgacgtcccaggtacgtccgggtgtacggcccgttacgggctacggtccggtaccttttcggaccgttcggtaccggggg

SEQ ID NO: 206132 - DNA, 526 bp, Homo sapiens
  misc_feature: GYAE6OF01AOZUH.17.25.C03.1.454.CMB.1.raw
  modified_base (456)..(456): a, c, t, g, unknown or other
  misc_feature (456)..(456): n is a, c, g, or t
  modified_base (464)..(464): a, c, t, g, unknown or other
  misc_feature (464)..(464): n is a, c, g, or t
  modified_base (487)..(487): a, c, t, g, unknown or other
  misc_feature (487)..(487): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacacgtggtgtcacagtgtcttcacccatcctccgggacagtacttaccatcgaccacgaactcctccaataaacacagcctaacatgggagttagaggagcctagacatctgacgacacggtcctntatactgngcgagacgtcccgacgctccggngagccgacggtcaggcggtccgtttcgcgttcggtcggg

SEQ ID NO: 206133 - DNA, 528 bp, Homo sapiens
  misc_feature: GYAE6OF01BD8XP.17.25.C03.1.454.CMB.1.raw
  modified_base (291)..(291): a, c, t, g, unknown or other
  misc_feature (291)..(291): n is a, c, g, or t
  modified_base (457)..(457): a, c, t, g, unknown or other
  misc_feature (457)..(457): n is a, c, g, or t
  modified_base (467)..(467): a, c, t, g, unknown or other
  misc_feature (467)..(467): n is a, c, g, or t
  modified_base (489)..(489): a, c, t, g, unknown or other
  misc_feature (489)..(489): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgntggacacgacctgagtggatgggatgggacgaaccctaacacgtggtgtcacgtagtgtcttcacccatccgtccgggacagacttaccagtcgaccacgaacctcctaccaataaacacacgcctacatggagttgaggcgctgacatctgacgacacggtcctntatctgtcgngagacgtcccgagtcgtccggngacgccgtacggcacggccggtctttcgcttcggtcggg

SEQ ID NO: 206134 - DNA, 556 bp, Homo sapiens
  misc_feature: GYAE6OF01C3GFJ.17.25.C03.1.454.CMB.1.raw
  modified_base (282)..(282): a, c, t, g, unknown or other
  misc_feature (282)..(282): n is a, c, g, or t
  modified_base (437)..(437): a, c, t, g, unknown or other
  misc_feature (437)..(437): n is a, c, g, or t
  modified_base (452)..(452): a, c, t, g, unknown or other
  misc_feature (452)..(452): n is a, c, g, or t
  modified_base (459)..(459): a, c, t, g, unknown or other
  misc_feature (459)..(459): n is a, c, g, or t
  modified_base (462)..(462): a, c, t, g, unknown or other
  misc_feature (462)..(462): n is a, c, g, or t
  modified_base (511)..(511): a, c, t, g, unknown or other
  misc_feature (511)..(511): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagaagcctgggggcctcagtgaaggtctcctgcaaggcttctggattcacgtttacctcctatagtatcaactgggtncgccaggccgctggacaacgacctggagtggatgggatggggaccgaaccctaacgacctgggtcgtcacgtagttgtcctttccaaccctatcccgtacccggggacacgaccttaccatcgaccaacgaactcctacaataaacacagcctanagtggagttgaggancctgacntcngacgacacggccttctattactgtcgcgagacgtcccaagcgtccgggngacggccgtacggctacgggccgtcctttgcgtttcggacggggg

SEQ ID NO: 206135 - DNA, 541 bp, Homo sapiens
  misc_feature: GYAE6OF01ASHXN.17.25.C03.1.454.CMB.1.raw
  modified_base (329)..(329): a, c, t, g, unknown or other
  misc_feature (329)..(329): n is a, c, g, or t
  modified_base (439)..(439): a, c, t, g, unknown or other
  misc_feature (439)..(439): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaaggcttctggattcacgtttacctcctatagtatcaaatgggtgcgccaggccgctggacaacgacctggagtggatgggatgggcaaccctanactggtgtcacagtgtcttcacccatccgtccgggacacgtacttaccatcgacccacgaactcctccaataaacacacgacctacatggagttgagagcctagacatcngacgacgacggtccgtctacttactgtagcgacgacgtacccgagtacgtccggtagcgccgtacggctacggccggtacctttgaccgtttcggtacgggg

SEQ ID NO: 206136 - DNA, 531 bp, Homo sapiens
  misc_feature: GYAE6OF01ETF1Z.17.25.C03.1.454.CMB.1.raw
  modified_base (277)..(277): a, c, t, g, unknown or other
  misc_feature (277)..(277): n is a, c, g, or t
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggcgttaaaaacctatttaaattggtatcagcagaaacctggaaaacnccccagacctcctgatctctggtgcatccactctgcgaagtggcgtccatcgaggttcagtgcagtggatcgtgggacagtattttacaattctacaccactaccaccactctagacaacctgaggtattgtgacaatctactactgtacaacagtacgttactacgttcccctcgtctacgtttcggaccgtagggacctaaaggtagagtactacaaacgtaacgtgtcggacgtcgacaccactctgttcc

SEQ ID NO: 206137 - DNA, 671 bp, Homo sapiens
  misc_feature: GYAE6OF01DKKTP.17.25.C03.1.454.CMB.1.raw
  modified_base (260)..(260): a, c, t, g, unknown or other
  misc_feature (260)..(260): n is a, c, g, or t
  modified_base (280)..(280): a, c, t, g, unknown or other
  misc_feature (280)..(280): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttaccncctatagtatcaactgggtncgccaggccgcgtggacaacgacctgagtggagtgggagtgggcgaaccctaagcgtggtgtaccacgtagttcgtcctttccaaccccactcccgtacccggggaactacggtaaccttaccagtacgaacccacgtaaccctccctaccaaactaaaccaccgaacgtccctaacgaagtcgggtaagtttacggaacgggacgtcccgtaggaacctagttccgtaaggaacccggtaacgtacccgggtcccgttacgttaactttaaccgtggttacgaccggtaagtaccggttaccccaacgggtacgtcccggggttagaccggtacccgtacgggctacgggtacccgggttcccttttcggaccgtttcggtaccgggggg

SEQ ID NO: 206138 - DNA, 557 bp, Homo sapiens
  misc_feature: GYAE6OF01A3J12.17.25.C03.1.454.CMB.1.raw
  modified_base (441)..(441): a, c, t, g, unknown or other
  misc_feature (441)..(441): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaaggcttctggattcacgtttacctcctatagtatcaactgggtgcgccaggccgctggacaacgcctgagtggatgggatgggaccgaaccctaacacgtggtcgtcacagtgtcttcaccctatcccgtccgggacacgacttaccatcgaccacgaacctcctacaataaacacagcctacatggagttgagagcctgacatcngacgacacggtccgttactattactgtcgacgtacgacgtaccccgacgtacgtccgggtagccgtaccgtaccgggcacgggtccggtcctttcggaccgtttcggtaccggggg

SEQ ID NO: 206139 - DNA, 571 bp, Homo sapiens
  misc_feature: GYAE6OF01DJBUD.17.25.C03.1.454.CMB.1.raw
  modified_base (367)..(367): a, c, t, g, unknown or other
  misc_feature (367)..(367): n is a, c, g, or t
  modified_base (404)..(404): a, c, t, g, unknown or other
  misc_feature (404)..(404): n is a, c, g, or t
  modified_base (425)..(425): a, c, t, g, unknown or other
  misc_feature (425)..(425): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctggggtgagaagcctggggcctcagtgaaggtctcctgcaaggcttctggattcacgtttacctcctatagtatcaactgggtgcgccaggccgctggacaacgcctgagtggatgggatgggcgaaccctaacacgtggtgtcacagtgtcttcgacccatcctccggganagaccttacatcgaccacgaactcctaccaataaacncagcctacatggagtgaaggncctgacatcgtagaccgaacgccggtccgttactaatttacgtgtcggacgtagacgtaccccacggtaagttcccgggagacgccccgttacgggctaacggtccgggtcccttttaggacccgttttcggtcgggggaccccgg

SEQ ID NO: 206140 - DNA, 554 bp, Homo sapiens
  misc_feature: GYAE6OF01BMLGY.17.25.C03.1.454.CMB.1.raw
  modified_base (279)..(279): a, c, t, g, unknown or other
  misc_feature (279)..(279): n is a, c, g, or t
  modified_base (419)..(419): a, c, t, g, unknown or other
  misc_feature (419)..(419): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaaggcttctggattcacgtttacctcctatagtatcaactgggtncgccaggccgctggacaacgacctgagtggatgggatgggacgaaccctaacacgtggtgtcacgagtgtccttcacccatcccgtccgggacacgtaccttaccatcgaccacgaactcctacaataaacacagcctanatggagttgaggagcctgacatctgaccgacgacggtcctacttattactgtcgcgagacgtcccaggtacgtccgggtgacggtccctaacgggcgacggcccggtaccgttttcgaccgtttcggtacggggg

SEQ ID NO: 206141 - DNA, 547 bp, Homo sapiens
  misc_feature: GYAE6OF01DPG1Q.17.25.C03.1.454.CMB.1.raw
  modified_base (221)..(221): a, c, t, g, unknown or other
  misc_feature (221)..(221): n is a, c, g, or t
  modified_base (283)..(283): a, c, t, g, unknown or other
  misc_feature (283)..(283): n is a, c, g, or t
  modified_base (294)..(294): a, c, t, g, unknown or other
  misc_feature (294)..(294): n is a, c, g, or t
  modified_base (334)..(334): a, c, t, g, unknown or other
  misc_feature (334)..(334): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagaagccgtggggcctnagtgaaggtctcctgcaaggcttctggattcacgttttacctcctatagtatcaactgggtncgccaggccgntggacaacgcctgagtggatgggatgggacgaaccctaanacgtggtgtcagagttgtactttccaacccatcccgtacgggacagactttaccatcgaccacgaactcctacaactaaacacacgacctacagtggtagttcgaggagcctgacatctagacgacgaccggtccgtctattactgtgacgagacgtacccaggtcgtaccggtgcgccgtacggcctaggccgtcgtttcgcgttcgcgggg

SEQ ID NO: 206142 - DNA, 592 bp, Homo sapiens
  misc_feature: GYAE6OF01DP729.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctggagtggatgggatgggacgaaccctaacactggtcgtcacagtcgtcttcacccatcccgtccgggacacgacttaccatcgaccaaccgaacctcctaccaataaacacacgacctaacagtagggtagttcgaggacgcctgactatcgtagaccgacaccgggtcctacttacttactggtcgaccgaagccgtaccccgacggtacgtcccgggtaggaaccggcccgttacgggccgtacgggtacccggttcccgttttcggaccgtttcgggtacggggg

SEQ ID NO: 206143 - DNA, 663 bp, Homo sapiens
  misc_feature: GYAE6OF01A09QQ.17.25.C03.1.454.CMB.1.raw
  modified_base (587)..(587): a, c, t, g, unknown or other
  misc_feature (587)..(587): n is a, c, g, or t
  modified_base (618)..(618): a, c, t, g, unknown or other
  misc_feature (618)..(618): n is a, c, g, or t
tcagcgtagactagcacgaccggtgctcgatttagtagtgtagatttgggtttgggggaccatatttggactcaactctcttgtccaccttggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttggagacgtctagactacttcgagaaccgaaccgaccggtccgttacttaactttacgtggtcggacggaaggtaccgtaccccaagtaccgtccgggtagaccgtccgtacgggcacgggccggttccgtttgaccgtttcggtccggggaccgaggggacccgtcccggttcggtacccacccggtcgtaccgtccgacgttccccttacccgaaccggtaccgggtccctacgtttccccgttccccgttcccccgngggcccctcccgtcgcccgtaccgagggccncccacccgtccgagaccgccacgaccggccccgtccgtcgggtcc

SEQ ID NO: 206144 - DNA, 571 bp, Homo sapiens
  misc_feature: GYAE6OF01A2R5G.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagccgtggggcctcagtgaaggtctcctgcaaggcttctggattcacgtttacctcctatagtatcaactgggtgcgccaggccgctggacaacgacctgagtggatgggatgggacaacccctaacacgtggtgtcacgagtcgtcttccacccactcccgtaccgggacacgaccttaccagtcgacccacgaacctccctaccaactaaaccacacgacctacagtgggtagttaggaggacgcctgacatcgtgaacgacgaccggtccgtactattacgtgtcgcgagccgtacccgacggtctccgggtgacgacccgtacgggctacggccggtccgtttgtacccgttggtccgggg

SEQ ID NO: 206145 - DNA, 522 bp, Homo sapiens
  misc_feature: GYAE6OF01CKLLO.17.25.C03.1.454.CMB.1.raw
  modified_base (466)..(466): a, c, t, g, unknown or other
  misc_feature (466)..(466): n is a, c, g, or t
  modified_base (489)..(489): a, c, t, g, unknown or other
  misc_feature (489)..(489): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatccgtcgggacagacttaccatcgaccacgaactcctaccaataaaccacagacctaacagtggagttgaggagcctgacatctagacgacacggccgttctattactgngcgagactccccgaagctccggngacgcctacggcaggcgctttgccttggcgggg

SEQ ID NO: 206146 - DNA, 573 bp, Homo sapiens
  misc_feature: GYAE6OF01EIXO5.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacgactggtgtcacagtgtcttcacccatcccgtcgggacagaccttaccatacgaccacgaacttccctaccaataaaccacagcctaacatgggagttgaacggagccgtgacatctagaccgacaccgggtccgttactacttacgtgtgaccgagacgtacccgaccggtagttcccgggtgacggccctaacgggccgtacggaccggtccgttttcggaccttccgggtaccgggggg

SEQ ID NO: 206147 - DNA, 524 bp, Homo sapiens
  misc_feature: GYAE6OF01BC8D1.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgcctgagtggatgggatgggcaaccctaacactggtgtcacagtgtcttcacccatcctccgggacagacttaccatcgaccacgaactcctaccataaacacagcctacatggagttgagagcctgacatctgaccgacacggccttactattactgtcgcgagacgtccccagcgtccggtgacgcccgtacggcaggccggtacctttggcttcggacgggg

SEQ ID NO: 206148 - DNA, 540 bp, Homo sapiens
  misc_feature: GYAE6OF01CXOVF.17.25.C03.1.454.CMB.1.raw
  modified_base (281)..(281): a, c, t, g, unknown or other
  misc_feature (281)..(281): n is a, c, g, or t
  modified_base (337)..(337): a, c, t, g, unknown or other
  misc_feature (337)..(337): n is a, c, g, or t
  modified_base (435)..(435): a, c, t, g, unknown or other
  misc_feature (435)..(435): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctgggggctgaggtgaagaagcctggggcctcagtgaaggtctcctgcaaggcttctggattcacgtttacctcctatagtatcaactgggtncgccaggccgctggacacgacctgagtggatgggatgggcgaacctaacactggtntcacagtgtccttcaccctatccctccggggacagacttaccatgaccaacgaacctcctaccaataaaccacacgacctaacatgggagttgaggancctagactatctgaccgacgaccgggccgtctacttacgtgtagcgagacgtcccgaggactccggtgacgcctacggcacgcggtcctttggcgttcgccgggg

SEQ ID NO: 206149 - DNA, 632 bp, Homo sapiens
  misc_feature: GYAE6OF01B6CA7.17.25.C03.1.454.CMB.1.raw
  modified_base (280)..(280): a, c, t, g, unknown or other
  misc_feature (280)..(280): n is a, c, g, or t
  modified_base (330)..(330): a, c, t, g, unknown or other
  misc_feature (330)..(330): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagaagcctggggcctcagtgaaggtctcctgcaaggcttctggattcacgtttacctctatagtatcaactgggtncgccaggccgctggacaacgacctgagtggatgggatgggacaaccctanacgtggtcgtcacagtcgtcttacacccgtatcccgtcgggacagtaccttaccatcgaccacgaacctcctaccaataaacacacgacctacagttacggagttcgaaggtacgacctgactagttcgtagaacttcggaaccgtacccgggacccgtttacttaacgtttacgtcggtacgaccggtaagtacccggtaccccgaacgggtaacgtcccggggttgacccgtacccgtaacggggtaccgtaacgggtcccgggtttaacccgtttttcgggacccgtttacccgggggg

SEQ ID NO: 206150 - DNA, 680 bp, Homo sapiens
  misc_feature: GYAE6OF01AORTR.17.25.C03.1.454.CMB.1.raw
tcagcgtagactagcacgaccggtgctcgatttagtagtgtagatttgggtttgggtagtcgagtctcagtcaggacacagcatggacatgagggtccccgcgtccagctcctggggctcctgctactctggctccggagctgccagatgtgacatccagatgacccagtctccactcctcccgtgtctgcctctgtgggggtaccaggagtcacctatccacttcggccggacaaaggtccacgggtaccgtttaaaaaccatttttaaaattggttaatcgagtccaaggaaaaccctgggaaaactccccaaggtaaccctcccgtgtaactcctaccgtggtgaccaagttcccaaccttctgacgaacggtcggccgttcccattcgggaacgtttcgagtcgggacaggtcggacttcgtaggggaccaggtatttcgaaatcgtccaacactcacctactctacgtccaaaccgttagcggtaagtttacgcgtactaactttctaactaccttggtacccaaactcggtaacttaccggaccttttacccccgtcttaccgttactttcgggaccccagggtaaacccgttaaggtacccgtaagggtaacttaaccgaaaggtaaacctgggttacggctttccggactaaacctcctagttccgttaccg

SEQ ID NO: 206151 - DNA, 530 bp, Homo sapiens
  misc_feature: GYAE6OF01C2FYW.17.25.C03.1.454.CMB.1.raw
  modified_base (337)..(337): a, c, t, g, unknown or other
  misc_feature (337)..(337): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgactgagtggatgggatgggacaaccctaacactggtntcacagtgtcttcaccctatcccgtccgggacagacttaccatcgaccacgaactcctaccaataaacacagcctaacagtggagttgaggagcctgacatctgaccgacgacggccgtctattactgtgcgagacgtcccaacggcgtccggtgacgccctacggcaggccggtcctttggcttcggcgggg

SEQ ID NO: 206152 - DNA, 615 bp, Homo sapiens
  misc_feature: GYAE6OF01CQ5ZX.17.25.C03.1.454.CMB.1.raw
  modified_base (290)..(290): a, c, t, g, unknown or other
  misc_feature (290)..(290): n is a, c, g, or t
  modified_base (361)..(361): a, c, t, g, unknown or other
  misc_feature (361)..(361): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgcaggccgntggacaacgcctgagtggagtgggatggggaccaaccctacactggtcgtcacagtcgtcttccaaccctntcccgtccgggacacgtaccttacatcgaccaacgtaacctcctaccaataaaccactacgaccctaacacgtagggtagttggaaggcgtacccgtagaacctatccgtagaaccgtaaccgaccggtcccgttacttacgttactgtggaccgtaacggaccgtccccaacggtacgttcccgggtagtaccggcccgtaacgggaccacgggtcccggtacccgttttacgccgtttccgggtaccggggg

SEQ ID NO: 206153 - DNA, 536 bp, Homo sapiens
  misc_feature: GYAE6OF01A5DOQ.17.25.C03.1.454.CMB.1.raw
  modified_base (244)..(244): a, c, t, g, unknown or other
  misc_feature (244)..(244): n is a, c, g, or t
  modified_base (434)..(434): a, c, t, g, unknown or other
  misc_feature (434)..(434): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttcnggattcacgtttacctcctatagtatcaactgggtgcgccaggccgctggacaacgacctgagtggatgggatgggcgaaccctaacactggtgtccacgagtcgtcttcacccctatcctccgggacagtaccttaccatcgaccacgaactcctaccataaacacacgcctacatggagttagagganccgtgacatcgtagacgacaccggtccgtacttattactgtgcgagacgtcccagtactccggtgacgcctaacggctacgccgtctttgcttcggtcgggg

SEQ ID NO: 206154 - DNA, 623 bp, Homo sapiens
  misc_feature: GYAE6OF01BLVVJ.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagccgtggggcctcgagtgaaggtctcctgcaaggtcttcgtggattctacgtttacctcctatagtatcaacgtgggtgcgccaggccgctaggaccaacgccgtggagtggagtgggagtcgggaccgaaaccctaacgacgtggtcgtacacgtaggtcgtccttccaccctacgtcccgtaccgggacacggtacttaccagtcgaaccacgtaacctcctaccaactaaacacacgtacctaacgagtaggagttggagtacgcctagactatcgtagaaccgacgaccggtccttacttacttacgtgtgacgtacgacgtacccgaacggtcgtcccgggtagaccggacccgtacgggaccgtacgggtacccggttccgtttacggtccgttccgggtaccggggg

SEQ ID NO: 206155 - DNA, 539 bp, Homo sapiens
  misc_feature: GYAE6OF01AWA85.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggcccgctggacaacgacctgagtggatggggatggggaccgaaccctaacactggtgtcacagttgtccttcacccctatcccgtccggggacagtaccttaccatcgaccacgaactccctcaactaaacacacgcctacatcgggagttgaggagcctgacatcagacgacaccgggcctactattactgtgcgagaactcccgacgctccggtgacgcctacggcaggccggtctttgcgttcggcgggg

SEQ ID NO: 206156 - DNA, 527 bp, Homo sapiens
  misc_feature: GYAE6OF01BYEBK.17.25.C03.1.454.CMB.1.raw
  modified_base (481)..(481): a, c, t, g, unknown or other
  misc_feature (481)..(481): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcaccccatcctccgggacacgacttaccatgaccacgaactcctccataaacacagcctacatggattgaggagcctgacatctgacgacacggccgtctattactgtgcgagcgtcccaggctcccgggngacggccctacgggcacggcggtccctttggaccgttcgtcggggg

SEQ ID NO: 206157 - DNA, 517 bp, Homo sapiens
  misc_feature: GYAE6OF01A4ZUI.17.25.C03.1.454.CMB.1.raw
  modified_base (299)..(299): a, c, t, g, unknown or other
  misc_feature (299)..(299): n is a, c, g, or t
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggcgttaaaacctatttaaattggtatcagcagaaacctggaaaagccccagacctcctgatctctggtncatccactctgcgaagtggcgtccatcgaggttcagtgcagtgatctgggacagatttcaatctcaccatcaccactctgacaacctgagtattgtgactaatctactactgtacaacagtagttacacgttcccctcgtcctacgttttacggccgtaacgggtaacctaaaggttgaagtactacaaacgtactgtgctgaccacactcgtgttcc

SEQ ID NO: 206158 - DNA, 565 bp, Homo sapiens
  misc_feature: GYAE6OF01ARGXW.17.25.C03.1.454.CMB.1.raw
  modified_base (284)..(284): a, c, t, g, unknown or other
  misc_feature (284)..(284): n is a, c, g, or t
  modified_base (332)..(332): a, c, t, g, unknown or other
  misc_feature (332)..(332): n is a, c, g, or t
  modified_base (474)..(474): a, c, t, g, unknown or other
  misc_feature (474)..(474): n is a, c, g, or t
  modified_base (516)..(516): a, c, t, g, unknown or other
  misc_feature (516)..(516): n is a, c, g, or t
tcagcgtagactagcacgaccggtgctcgatttagtagtgtagatttgggtttgggggactcaacaaccacatctgtcctctagagaaaaccctgtgagccacagctcctcaccatggactggacctggaggatcctcttcgttggtggcagcagctacaagtgcccactcccaggtgcagctggtgcagtctggggctgaggtgaagaagcctggggcctcagtgaaggtctcctgcaagggcttctggattcacgtttacctcctatagtatcaactgggtncgccaggccgctggacacgacctgagtggatgggatgggcaaccctanactggtgtcacagtgtacttcaccctatcccgtccggggacacgtaccttaccatcgaacccacgtaacctccctaccaactaaaccacacgccctaacatcgggagttgaggagcctgacatctgacgacacgggcccttntacttactgtacgcgagacgtccccgagtacgtcccgggtancgcccgtacggcacggtccgggtaccttttggccgtttcggtacggggg

SEQ ID NO: 206159 - DNA, 724 bp, Homo sapiens
  misc_feature: GYAE6OF01BKEZL.17.25.C03.1.454.CMB.1.raw
  modified_base (332)..(332): a, c, t, g, unknown or other
  misc_feature (332)..(332): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactggtgcgccaggccgctggacaacgacctggagtggatgggatgggacgaaccctaanacgtggtgtcacagtcgtcttcacccatccgtccgggacagacttaccatcgaacccacgaacctccctaccaactaaaccaacacgtaccctaactacgtagggtaacgtttaggaacgggtacgtcccgtaggtaacctaacgttccgtaacgggtaacccggtaaacccgtaacccgggggtaccccgtttaacctttaaaccgttttaacccgttcgggtttaaccggaccgggtaaacggtaaccgggttaacccccccgtaacgggtaaccggtttccccggggttacgggaacccgggtaccccgttaacccggggacgtaaccggggacccggggttaccccttttttacgggtaccccggttttccgggtaacccgggggggg

SEQ ID NO: 206160 - DNA, 541 bp, Homo sapiens
  misc_feature: GYAE6OF01CKPVB.17.25.C03.1.454.CMB.1.raw
  modified_base (279)..(279): a, c, t, g, unknown or other
  misc_feature (279)..(279): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaggtctcctgcaaggcttctggattcacgtttacctcctatagtatcaactgggtncgccaggccgctggacacgacctgagtggatgggatcgggcgaaccctaacacgtggtcgtcacgagttgtccttcacccatccgtccgggacagacttaccatcgaccacgactcctaccataaacacacgcctacatggagttggagacgcctagacatctgaccgacgacggtccgtactattacgtgtacgcgagacgtccccaggtctccggtggcgcccgtacggcgacgtcggtcctttcggcgtttcggcgggg

SEQ ID NO: 206161 - DNA, 592 bp, Homo sapiens
  misc_feature: GYAE6OF01BNPP3.17.25.C03.1.454.CMB.1.raw
  modified_base (309)..(309): a, c, t, g, unknown or other
  misc_feature (309)..(309): n is a, c, g, or t
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatccctccctgtctgcctcgtggtgggggtcagagtcaccatcacttgccggacaagtcacggtacgttaaaactatttaaatggtatcagcaagaaacctggaaaacgccccagaccctcctagactcgtctggtcnctactccactcgtgacgaagtcggaccgtcccagtccggaggttcaggtgcaggtggatcgtagggactagtactttacaatcctacaccatcacctctctacgaccaacctgaaggtattcgtagactaatcctaactactagtaccaacgtacgtaacgttacctaccgtttcccctacgtacttaccgtttaggacccgtaaacggggtaaccctaaaggtttacgaagtaactaaccgaaacgtaacgtgtacggactcgacctactcttcgtgttacc

SEQ ID NO: 206162 - DNA, 527 bp, Homo sapiens
  misc_feature: GYAE6OF01BMV6I.17.25.C03.1.454.CMB.1.raw
  modified_base (456)..(456): a, c, t, g, unknown or other
  misc_feature (456)..(456): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctacactggtgtcacagtgtcttcacccatcctccgggacagacttaccatgaccacgaactcctccataaacacagcctacactggagttgaggagcctgacatctgacgacacggtccgtctattacngtgcgagacgtcccacgactccgggtagacgcccgtacggcacggcggtaccctttgaccgttgtccgggg

SEQ ID NO: 206163 - DNA, 518 bp, Homo sapiens
  misc_feature: GYAE6OF01CGIND.17.25.C03.1.454.CMB.1.raw
  modified_base (270)..(270): a, c, t, g, unknown or other
  misc_feature (270)..(270): n is a, c, g, or t
  modified_base (293)..(293): a, c, t, g, unknown or other
  misc_feature (293)..(293): n is a, c, g, or t
  modified_base (370)..(370): a, c, t, g, unknown or other
  misc_feature (370)..(370): n is a, c, g, or t
  modified_base (429)..(429): a, c, t, g, unknown or other
  misc_feature (429)..(429): n is a, c, g, or t
  modified_base (487)..(487): a, c, t, g, unknown or other
  misc_feature (487)..(487): n is a, c, g, or t
  modified_base (507)..(507): a, c, t, g, unknown or other
  misc_feature (507)..(507): n is a, c, g, or t
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatcctccctgtctgcctctgtggggtcagagtcacatcacttgccggacagtcacggacgttaaaactatttaaattggtatcagcaagaacctggaaacnccccagacctctgatctctggtncactccactctgcgaagtggcctccagtcgaggttcagtgcagtggatcgtggacagtattcaatctcacatcaccntctgccaacgtgagtattgagcaatctatactgaccaacagtaattacaccgttccccncgtacttacgtttcggacccgtaagggaacctaaagttgaagacctagaaaaccgtcngttacggactgaccaacctntacttgttacc

SEQ ID NO: 206164 - DNA, 531 bp, Homo sapiens
  misc_feature: GYAE6OF01ADRVU.17.25.C03.1.454.CMB.1.raw
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatcctccctgtctgcctctgtggggtcagagtcaccatcacttgccggacaagtcacggacgttaaaacctatttaaattggtatcagcagaaacctggaaaagccccagacctcctgatctctggtgcatccactctgcgaagtggcgtccatcgaggttcagtggcagtggatcgtgggacagatttcaatctacaccatcaccactctgacaacctgaggtattgtgcaatctactactgtacaacagacgttacacgttcccctcgtctacgttttcggaccgtaggggacctaaaggttgaagtaacgtacgaaaacggtacttggtaggtacctacgaccaaccattcgtgttccc

SEQ ID NO: 206165 - DNA, 643 bp, Homo sapiens
  misc_feature: GYAE6OF01EZD7F.17.25.C03.1.454.CMB.1.raw
  modified_base (296)..(296): a, c, t, g, unknown or other
  misc_feature (296)..(296): n is a, c, g, or t
  modified_base (493)..(493): a, c, t, g, unknown or other
  misc_feature (493)..(493): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagagccgtggggcctcagtgaaggtctcctgcaggtcttcgtggtacttcacgttttacctctatagtatcaacgtgggtgccgcaggccgngtcggaccaacggcctggacggtggagtgggtagtcggggacctaaaccctaacgacgtggtacgtcacgtagtcgtccttaccaccctagtcccgtacgggacacgtaaccttaccatccgaacctacgaaccttccctaaccaactaaaccacaacgacctaagagtaggtagttacgaacggcaccgtagactntacgtacgaccggaccgtaccggtaccgttacttacgttacgtggtacgacggtacgtaccgtacccgagtaccgttcgggacgtaaccgtccggtacggaccgtacgggttcccggtaccctttagggtccgttcggggtacccggggg

SEQ ID NO: 206166 - DNA, 656 bp, Homo sapiens
  misc_feature: GYAE6OF01EQOY7.17.25.C03.1.454.CMB.1.raw
  modified_base (277)..(277): a, c, t, g, unknown or other
  misc_feature (277)..(277): n is a, c, g, or t
  modified_base (288)..(288): a, c, t, g, unknown or other
  misc_feature (288)..(288): n is a, c, g, or t
  modified_base (299)..(299): a, c, t, g, unknown or other
  misc_feature (299)..(299): n is a, c, g, or t
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctggtgggggtcagagtcaccatcacttgccggacaagtcacggtacttaaaacctatttaaatggtatcagcagaaacctggaaaacncccagacctcngatctctggtncatccactctgcgaaggtcggccgtccagtcggtaggttcaggtggctaggtcggtatcgtaggggactaggtacttttaccgaaattcctacaacctactacccaaccctactctacggtacctaaccgtaggtaaggtactttggtacgtacctaaacgttaccttaacttaacgtcgtaacaaacgtaaggttaaccgttaacctaccgtttaccccccgtacgttaccgttaaccggttttcgggaacccggtaacggggtaaccctaaaaggttcggaacgtaacgtaaccgtaaaacggtaacgttggtacggaccgttacgacctaacccgtacttcgttacgttacccg

SEQ ID NO: 206167 - DNA, 598 bp, Homo sapiens
  misc_feature: GYAE6OF01DP4QO.17.25.C03.1.454.CMB.1.raw
  modified_base (282)..(282): a, c, t, g, unknown or other
  misc_feature (282)..(282): n is a, c, g, or t
  modified_base (306)..(306): a, c, t, g, unknown or other
  misc_feature (306)..(306): n is a, c, g, or t
tcagcgtagactagcacgaccggtgctcgatttagtagtgtagatttgggtttgggggagtcagtctcagtcaggacacagcatggacatgagggtccccgctcagctcctggggctcctgctactctggcctccgagctgccagatgtgacatccagatgacccagtctccatcctccctgtctgcctctggtgggggtcagagtcaccatcacttgccggacaagtcacggtacgttaaaacctatttaaattggtatcagacaagaaacctggaaaacncccagacctcctgatctctggtcncatccactctgacgtaagtcggcctcccatcgagttcagtggcaggtgatcgtggacagtattcaatctacacactccacctactctacgactaaccgtaggaaggtatttggtacgtactaaacttccttaaccttacgtacgtaaccaacgtaagttaacgttaaccgtaccgttcccctcgtcctttacgtttcgggacccgtaacggggtaacctaaaggttcgaacgtaactaacgaaacggtaacgttacggtggacgtacgacctaccgtaacttcgttgttacc

SEQ ID NO: 206168 - DNA, 516 bp, Homo sapiens
  misc_feature: GYAE6OF01BYKT2.17.25.C03.1.454.CMB.1.raw
  modified_base (330)..(330): a, c, t, g, unknown or other
  misc_feature (330)..(330): n is a, c, g, or t
  modified_base (408)..(408): a, c, t, g, unknown or other
  misc_feature (408)..(408): n is a, c, g, or t
  modified_base (419)..(419): a, c, t, g, unknown or other
  misc_feature (419)..(419): n is a, c, g, or t
  modified_base (446)..(446): a, c, t, g, unknown or other
  misc_feature (446)..(446): n is a, c, g, or t
  modified_base (454)..(454): a, c, t, g, unknown or other
  misc_feature (454)..(454): n is a, c, g, or t
  modified_base (478)..(478): a, c, t, g, unknown or other
  misc_feature (478)..(478): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctanactggtgtcacagtgtcttcacccatcctccgggacagacttaccatgaccacgaactcctccataaacacagcctanatggattgagncctgacatctgacgacacgggtccgtntacttacngtgcgagcgtcccaggctccgggngacgcccgtaggccaggcggcctttgacttcgtcgggg

SEQ ID NO: 206169 - DNA, 629 bp, Homo sapiens
  misc_feature: GYAE6OF01AID3G.17.25.C03.1.454.CMB.1.raw
  modified_base (486)..(486): a, c, t, g, unknown or other
  misc_feature (486)..(486): n is a, c, g, or t
tcagcgtagactagcacgaccggtgctcgatttagtagtgtagatttgggtttggggtacgtcaacaaccacatctgtcctctagagaaaaccctagtgagcacagctcctcaccatggactggacctggaggatcctcttcttggtggcagcagctacaagtgcccactcccaggtgcagctggtgcagtcgtggggctggaggtgaaggaagccgtgggggcctcgagtgaaggtctccgtgcaaggcttctggattcacgtttacctctatacgtatcaacgtgggtgcgccaggcccgcgtggaacacgaccgttggacgtggatggggatcgggacgaaaccctacgactgggtgtacacgtagtcgtaccttcgacctacgtccgtaccggggacacgtaccttaccgagtcgaaccacgtacctaccttcaaactaactaccagtacctacgatagggtagttacgacggaatccgtanacgacgtcgtcgaaccgacgaccggtccgttacttacttacggtcgtgtaccggagtaccgtacccgacggtcgtccccgggagtacgtacccggtacggtcaaccgggtcccggaccgtttttcaccggttggtcccggggg

SEQ ID NO: 206170 - DNA, 548 bp, Homo sapiens
  misc_feature: GYAE6OF01AKOBS.17.25.C03.1.454.CMB.1.raw
  modified_base (272)..(272): a, c, t, g, unknown or other
  misc_feature (272)..(272): n is a, c, g, or t
  modified_base (295)..(295): a, c, t, g, unknown or other
  misc_feature (295)..(295): n is a, c, g, or t
  modified_base (384)..(384): a, c, t, g, unknown or other
  misc_feature (384)..(384): n is a, c, g, or t
  modified_base (544)..(544): a, c, t, g, unknown or other
  misc_feature (544)..(544): n is a, c, g, or t
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatccctccctgtctgcctctggtggggtcagagtcaccatcacttgccgacaagtcacggtacttaaaactattaaatgtatcagcaagaaacctggaaaacncccagacctctagatctctggtncactccactctgacgaagtcggcctccagtcgtaggtcagtgacaggtgatcgtggactagtattcaatcacacctataccactactcncgacctaactgagtattgacgactactacttactactagtaaccaagtacgtaacttaccgtaccgttcccctagacttaccgttcggaccgtagggaacctaaggtcgaagtactaacgaaacggtacgtcggtagcctacgactaacgtacttccgtntacc

SEQ ID NO: 206171 - DNA, 572 bp, Homo sapiens
  misc_feature: GYAE6OF01C3V19.17.25.C03.1.454.CMB.1.raw
  modified_base (331)..(331): a, c, t, g, unknown or other
  misc_feature (331)..(331): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgcaggccgctggacaacgacctgagtggatgggatggggacaaccctaanacgtggtcgtcatagtcgtcttcacccatcccgtccgggacacgtacttacatcgaaccacgtaacctcctaccaataaacacacgacctacagtggagttgaggacgcctagacagtcgtacgaacgaccgaccgggtcctacttacttaccgtgtcgacgtagaccgtcccgacgtacgtccggtagaccgcccgtacggccgtacggtccggtcctttaggccgttcggtaccggggg

SEQ ID NO: 206172 - DNA, 657 bp, Homo sapiens
  misc_feature: GYAE6OF01A48FK.17.25.C03.1.454.CMB.1.raw
  modified_base (279)..(279): a, c, t, g, unknown or other
  misc_feature (279)..(279): n is a, c, g, or t
  modified_base (346)..(346): a, c, t, g, unknown or other
  misc_feature (346)..(346): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctctatagtatcaactgggtncgccaggccgctggacaacgacctgagtggatgggatgggcaaccctaacacgtggtgtcactagtntcttcaccccacgtccggacgacacgttacctactacgaccaacaccgtaccctccctaactaaacaacccacgacctacctaagtaggtacggtaggtagggacgaccgtccgtaacacgtacgtcgtaacggaacccgaaccgggtacccggttaccgtttaacttaaccgtttggtacgtaccgggaacgtaacggtaccccgtacccggacggttacccgggtcggtacggtacccggacccggtacgaccgggtaccggttcccggtttaccgtttaccggttcccggttcgggggtaccccgggg

SEQ ID NO: 206173 - DNA, 960 bp, Homo sapiens
  misc_feature: GYAE6OF01DD4OX.17.25.C03.1.454.CMB.1.raw
tcagcgtagactagcacgaccggtgctcgatttagtagtgtagatttgggtttggggactcaacaaccacatctgtcctctagaacgaaaccctgtgagcacagctcctcaccatggacctggacctggaggactcctctttcgttggtggcagcagctacaagtcgcccactcccgaggtgcagctggtcgctagtcggtggggctaggaggtaagaagacgtcgggtcggtcctagtgtaggtacgtcctccgtgacgacgttcttcgagttacttccgttaccttaccctcttaagtacgttactaaccgtagggtcggtcgcccgacgccggtccgtacggtacgaaccgtaaccgtcggtaggtaggtaggacggggtagtacgggaccggtaaaaccccgtaaccgtaaaccgtcgggttcggtacgtaaccgtacggttcggtttaccgttaccctaacccccgtaaccctacccggttaacccccgggtaaccgggtaaactaacccgtttaacccgtaaacttaccgggaaccccctaaaccgggtaaacccttaaccccttacccgtaaaaccttaaacccaaaccgtaacggtaaccccttaaaccgtaacgttaaacgggtaacgggtttacgggtaacggggtaaccgtacccgtaacggtaacccgtaacgttaccgtaccgggaaaccggtaacccggtaaacccgggttaccccgggtttaaccgtttaaccgtttaaaccggttcgggttaccggtaccgggtaaaccgggtaaccgttaacccccggtaaacccgggttaacccggtaccccggggtttacggtaaccgggttcccccggttaaacccggggtacccggtaacccggggttcccgggtttacccccgggttttaaccgggttaacccgttttcccgggggtccggggggtaaacccccgggg

SEQ ID NO: 206174 - DNA, 727 bp, Homo sapiens
  misc_feature: GYAE6OF01BWN4J.17.25.C03.1.454.CMB.1.raw
  modified_base (284)..(284): a, c, t, g, unknown or other
  misc_feature (284)..(284): n is a, c, g, or t
  modified_base (335)..(335): a, c, t, g, unknown or other
  misc_feature (335)..(335): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagaagcctggggcctcgagtgaaggtctcctgcaaggcttcgtggattcgacgtttacctctatagtatcaacgtgggtncgccaggccgctggacaacgacctgagtggatgggatgggacaaccctaanacgtggtctcacgaggtcgtacttaccacccgattcccgtacccggggaacaacgtaaccttacccagttccggaaccaccgtaacctaccctaccaaactaaacacgaaccgtacctaacgagtacgggtaagttacggaacgggtacgtcccgtaggaactaacgtttccgtaacggaacccgaacccggtaacccgggtcccgtttaaccgttaacgtttaaccgttcgggttaccggaccggttaaacggacccggtttacccccgaaaccggggtaaccgtttaccccggggacggtaacccggtccccggttaaacccgggccggtaaaccggttccccgggtacccgttttttacgggacccgttttccggggtaacccgggggg

SEQ ID NO: 206175 - DNA, 534 bp, Homo sapiens
  misc_feature: GYAE6OF01DB9LI.17.25.C03.1.454.CMB.1.raw
  modified_base (280)..(280): a, c, t, g, unknown or other
  misc_feature (280)..(280): n is a, c, g, or t
  modified_base (430)..(430): a, c, t, g, unknown or other
  misc_feature (430)..(430): n is a, c, g, or t
  modified_base (441)..(441): a, c, t, g, unknown or other
  misc_feature (441)..(441): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacaacgacctgagtggatgggatgggacgaaccctaacactggtgtcacagtgtcttcacccatccctccgggcagacttaccatcgaccacgaacctcctaccaataaaccacacgcctaacatggagttgaggngcctgacatcngacgacacggtccgtctattacctgtcgcgagacgtcccagactccgggtgacgccctacggcacggtcggtcctttgcctttggtacggggg

SEQ ID NO: 206176 - DNA, 639 bp, Homo sapiens
  misc_feature: GYAE6OF01B7WP9.17.25.C03.1.454.CMB.1.raw
  modified_base (301)..(301): a, c, t, g, unknown or other
  misc_feature (301)..(301): n is a, c, g, or t
tcagcgtagactagcacgaccggtgctcgatttagtagtgtagatttgggtttgggagtcagtctcagtcaggacacagcatggacatgagggtccccgctcagctcctggggctcctgctactctggctacgagctgccagatgtgacatccagatgacccagtctccatcctccctgtctgcctctggtgggggtcagagtcaccatcacttgccggacaagtcacggtacttaaaactatttaaatgtatcagacaagaaacctaggaaaacgccccagacctcctgactctctggtncactccactctggacgaaggtcggccgtaccagtcggtaggttcgaaggtcgggacaagtggaagtcgtagggaactagtactttacgaatctaccaaccacttaccaaccctacttcctacgaccaaccgtaggaacggtagttgtacgtactaaacgttccttaactaacgtacgtaaccaaacgtacgtaacgtttaacctacccgtttacccctccgtactttaaccggtttacggacccggtaaggggtaaccctaaaaggttcgaaacgacttaaacgaaaccggttaacgtcgggtacgtaccgtcgaccgaactcgttaccgttgttacc

SEQ ID NO: 206177 - DNA, 773 bp, Homo sapiens
  misc_feature: GYAE6OF01DD27S.17.25.C03.1.454.CMB.1.raw
  modified_base (287)..(287): a, c, t, g, unknown or other
  misc_feature (287)..(287): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagccgtgggggcctcgagtgaaggtctcctgcgaaggcttctggattctacgtttacctcctatagtatcaactgggtncgccaggccgcgtggacaacgactgagtggagtgggatgggacgaaccctaacgacgtggtgtcactaggttcgtccttaccaacccctacttcccgtaccgggggactaacggtaaccctttaacccgattacggaacccgtaaccgtaacccttacccctaacccaaacttaaaaccaaccgggggaactaccctaacctaacgttagggtaaggtttacgggaacgggtacgacccgttacgtaacctacgttaccgtacggtaaccggaacccgtaacccggggtacccgttaccgttaacgttttaaccgttacggttacggtaccgggtaacggtaacccggttacccccgaaccggtaaaccggttccccggggttaacggtaacccgggtaccccggttaacccgggtacccggtaaccgggtacccgggtttacccggtttttacgggtacccggttttccggggtacccggggggg

SEQ ID NO: 206178 - DNA, 571 bp, Homo sapiens
  misc_feature: GYAE6OF01B95GS.17.25.C03.1.454.CMB.1.raw
  modified_base (276)..(276): a, c, t, g, unknown or other
  misc_feature (276)..(276): n is a, c, g, or t
  modified_base (301)..(301): a, c, t, g, unknown or other
  misc_feature (301)..(301): n is a, c, g, or t
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatcctccctgtctgcctctggtggggtcagagtcaccatcacttgccggacaagtcacggacgttaaaacctatttaaattggtatcagcaagaaacctggaaaacnccccaagacctcctgatctctggtncactccactctgacgaagtggccgtccatcgaggttcagtggcaggtggatcgtgggacagtatttcaatcctacaccatccaccactctgaccaacctgaggtattgtagactaatctaactactgtacaacagtaacgttaccaccgtttcccctcgtaccgttacgttttcgggacccgtaaggggtaaccctaaaggtttaggaacgtacttaaccgaaaacggtacgttggtacggaccttacgacctacctattctcggttacc

SEQ ID NO: 206179 - DNA, 572 bp, Homo sapiens
  misc_feature: GYAE6OF01D7ITG.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaaggcttctggattcacgtttacctcctatagtatcaactgggtgcgccaggccgcgtggacaacgcctgagtggatgggatgggacaaccctaacactggtgtcactagtgtcttcacccatccctccgggacagacttaccatcgaccacgaacctcctaccaataaacacacgacctaacatgggagttgaaggacgcctgacatctagaccgacgaccggtccttacttacttactggtacgcggagaccgtcccgaacgtacgtcccgggtagtacggacccgtacgggccgacggcccggttacccttttcggaccgtttcggtaccggggg

SEQ ID NO: 206180 - DNA, 572 bp, Homo sapiens
  misc_feature: GYAE6OF01AOSZU.17.25.C03.1.454.CMB.1.raw
  modified_base (291)..(291): a, c, t, g, unknown or other
  misc_feature (291)..(291): n is a, c, g, or t
  modified_base (327)..(327): a, c, t, g, unknown or other
  misc_feature (327)..(327): n is a, c, g, or t
  modified_base (430)..(430): a, c, t, g, unknown or other
  misc_feature (430)..(430): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgntggacacgcctgagtggatgggatgggacaacctanacgtggtgtcacagtcgtcttcacccatccgtccgggacagtaccttacatcgaccacgaactcctaccaataacacacgcctacatgggagttgacggtacnccgtgactatcgtaggaccgacgaccgggtccttacgttagttaccgtggtagaccggacgtaccgtacccgaacgtccgtccgggtacgacggacccgtacggaccgtacggccggtacctttggaccgttcggccggggg

SEQ ID NO: 206181 - DNA, 587 bp, Homo sapiens
  misc_feature: GYAE6OF01DTFX8.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagagccgtggggcctcagtgaggtctcctgcaaggcttctggattcacgtttacctctatagtatcaatgggtgcgccaggccgcgtggacaacgacctggagtgggatggggagtggggaccgaaacccgtaacaccgtgggtcgtcgacgagttcgtccttcacccactcccgtaccgggacacgtaccttaccatcgaacccacgtaacctcctaccaataaaccacacgacctacagtgggtagttggaaggtacgcctgactatcagaccgacgaccggtccgttacttacttactggtcgacgagtaccgtcccaacgtacgtccggtagacgtaccgtacggctacggtccggtcctttcggcttcgggtccgggg

SEQ ID NO: 206182 - DNA, 735 bp, Homo sapiens
  misc_feature: GYAE6OF01EG0NA.17.25.C03.1.454.CMB.1.raw
tcagcgtagactagcacgaccggtgctcgatttagtagtgtagatttgggtttggggactcaaacaaccacatctgtcctctagagaaaaccctgtgagcacagctcctcaccatggactggacctggaggatcctcttcttggtggcagcagctacaagtgcccactcccaggtgcagcgtggtgcagtcgtggggctggaggtgaaagaacggctttcgggggcctcgacgttagacggtctcccgtaggcctaacggtcgttacgtggtacgttttccaaccgtttttaaccccttccttacttaacgttacgtacgtacgtcgggtacgccggccgtacggtccgaccgtacggactacgaaccttaggccggtgggagtacgggacgtacgggtacgcccctaacggactcggtacgtacgtacgtacgttcgtaccttacgtaccctacgtacccgtaccgggtaacctaacgacgttacccaactacgtaaccctaccgtaacctaccctaacccaactaaaccaccaatcccgtactagtacggtacggtacgtcggacgtaccgtacgtaacgtaacgtacgtacggaaccgtaaccgaccggtaccgtacgttaacgttaccgttcggtacggtaccggtaacggtaccgtaccccggaacggtaccggtcccggtacggaccgtacccggtaccggaccgtacgggtccggttcccggttacgg

SEQ ID NO: 206183 - DNA, 528 bp, Homo sapiens
  misc_feature: GYAE6OF01A45SI.17.25.C03.1.454.CMB.1.raw
  modified_base (280)..(280): a, c, t, g, unknown or other
  misc_feature (280)..(280): n is a, c, g, or t
  modified_base (410)..(410): a, c, t, g, unknown or other
  misc_feature (410)..(410): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggcccgctggacaacgacctgagtggatgggatgggcgaaccctaacgacgtggtgtcacgagtgtcttcaccctatcccgtccgggacacgacttaccatcgaccacgaactccaccataaacncacgcctacatgagttgagacgcctgacatctgacgagtaccggccttctagttactgtacgcgagacgtcccagtctccggtgacgccctacggcagcggtcctttgcttcgcgggg

SEQ ID NO: 206184 - DNA, 821 bp, Homo sapiens
  misc_feature: GYAE6OF01D1KUZ.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctggtgcagtcgtggggctggaggtgaagagccgtggggcctcgagtgaaggtctcctgcgaaggtcttcgtggtacttctaacgtttacctctatagtatcaacgtgggtcgcgccgaggcccgcgtcggaaccaacgaccgtgaggtggagtgggatcgggacgaaaccctaagaccgtgggtcgtacgaacgtaggttcgttaccttacccgaaccccgttacgtccccggtaaccggggaactaacggtaacccttaaccgaagttaccggaaccctaaccggtaaaccccttcccctaaccctaaaacgttaaaaaccccgaaccgtaaccgggtacccttaaaccggtaacggtttaggggtaacggtttaacggggaaacgggtaacgtacccttaacgggaacctacgttaccgtaccgggaaacccgtaacccggtacccgggttacccgttactttaaacggtttaaccggtcggtacggaaccgggtaacggtaacccccggttccccgtaaacggggtccgttacccggggttacggaacccgggttaccccggtaaccgggacccgtaaccgggtcccccgggtttaccgttttacgggaaaccccgttttcgggggaaccccgggggg

SEQ ID NO: 206185 - DNA, 530 bp, Homo sapiens
  misc_feature: GYAE6OF01EW4MV.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctgggctgaggtgaagaagcctggggcctcagtgaaggtctcctgcaaggcttctggattcacgtttacctcctatagtatcaactgggtgcgccaggccgctggacaacgcctgagtggatgggatgggcaacctacactggtgtcacagtgtcttcacccactcctccgggacacgacttaccatcgacccacgaacctccctaccaataaacacacgacctacatggagttgaggacgcctgacatctgacgacacgccgtctattactgtgcgagtcgtaccccaggtactccggtgacgccctaggcgtacgcggtcctttggccttcggtacgggg

SEQ ID NO: 206186 - DNA, 547 bp, Homo sapiens
  misc_feature: GYAE6OF01BWLJU.17.25.C03.1.454.CMB.1.raw
  modified_base (288)..(288): a, c, t, g, unknown or other
  misc_feature (288)..(288): n is a, c, g, or t
  modified_base (305)..(305): a, c, t, g, unknown or other
  misc_feature (305)..(305): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctgggctgaggtgaagaagcctggggcctcagtgaaggtctcctgcaaggcttctggattcacgtttacctcctatagtatcaactggtgcgcaggccgntggacaacgacctgagnggatgggatgggacgaaccctaacactggtgtcacagtcgtcttccacccatccgtccgggacagtacttaaccatcgaaccacgaactcctaccaataaacacagcaacagtagagttgagagccgtagacactctacgaacgacgaccgggtccgttacgttattacctgtcgacgagacgtacccacgacgtccggtggcgccgtacgcgtagcggtacctttgacgttcggtacgggg

SEQ ID NO: 206187 - DNA, 522 bp, Homo sapiens
  misc_feature: GYAE6OF01DI62O.17.25.C03.1.454.CMB.1.raw
  modified_base (280)..(280): a, c, t, g, unknown or other
  misc_feature (280)..(280): n is a, c, g, or t
  modified_base (338)..(338): a, c, t, g, unknown or other
  misc_feature (338)..(338): n is a, c, g, or t
  modified_base (405)..(405): a, c, t, g, unknown or other
  misc_feature (405)..(405): n is a, c, g, or t
  modified_base (413)..(413): a, c, t, g, unknown or other
  misc_feature (413)..(413): n is a, c, g, or t
  modified_base (426)..(426): a, c, t, g, unknown or other
  misc_feature (426)..(426): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacaacgacctgagtggatgggatgggcgaaccctaacactggtntcacagtgtcttcacccatccctccggggacagaccttaccatcgaccacgaactcctcaataaacncagcctanatggattgaggancctgacatctgacgacacggcctctattactgtcgcgagacgtcccagcgtccggtgacgccctacggcaggccggtcctttggcttcgtcggggg

SEQ ID NO: 206188 - DNA, 521 bp, Homo sapiens
  misc_feature: GYAE6OF01CTI8D.17.25.C03.1.454.CMB.1.raw
  modified_base (328)..(328): a, c, t, g, unknown or other
  misc_feature (328)..(328): n is a, c, g, or t
  modified_base (411)..(411): a, c, t, g, unknown or other
  misc_feature (411)..(411): n is a, c, g, or t
  modified_base (422)..(422): a, c, t, g, unknown or other
  misc_feature (422)..(422): n is a, c, g, or t
  modified_base (457)..(457): a, c, t, g, unknown or other
  misc_feature (457)..(457): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaaggcttctggattcacgtttacctcctatagtatcaactgggtgcgccaggccgctggacaacgacctgagtggatgggatgggcaaccctanactggtgtcacagtgtcttcacccatccgtcgggacagaccttaccatcgaccacgaactcctacaataaacacagcctaacntggagttgagngcctgacatctagacgacacggtccgtctattacngtgcgagcgtcccagtactccggtgacgccgtacggctacgcggcctttgccgttgtacggggg

SEQ ID NO: 206189 - DNA, 564 bp, Homo sapiens
  misc_feature: GYAE6OF01CUKEA.17.25.C03.1.454.CMB.1.raw
  modified_base (279)..(279): a, c, t, g, unknown or other
  misc_feature (279)..(279): n is a, c, g, or t
  modified_base (328)..(328): a, c, t, g, unknown or other
  misc_feature (328)..(328): n is a, c, g, or t
  modified_base (335)..(335): a, c, t, g, unknown or other
  misc_feature (335)..(335): n is a, c, g, or t
  modified_base (512)..(512): a, c, t, g, unknown or other
  misc_feature (512)..(512): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctctatagtatcaactgggtncgccaggccgcgtggacaacgacctgagtggatgggatgggcaacctanactggtntcacagtgtcttcaccctatccgtccgggacacgacttaccatcgaccacgaactcctaccaataaaccacacgacctaacagtagggtagttggaggacgcctagacatctagaaccgacaccgggtcctacttattactggtcgcgtagaccgtcccgaacgtcgtacccgggtnacggtcccgtacggcgtacggtccggtacctttggccgttcggtaccggggg

SEQ ID NO: 206190 - DNA, 545 bp, Homo sapiens
  misc_feature: GYAE6OF01AVO7H.17.25.C03.1.454.CMB.1.raw
  modified_base (443)..(443): a, c, t, g, unknown or other
  misc_feature (443)..(443): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacacgtggtgtcactagtgtcttcaccccatcccgtaccggggacacgtaccttaccatcgacccacgaacctcctaccaataaaccacagccctagatgggagttggacgacncctgacatctgacgacacgggcctactatactgtcgcgagacgtcccgagtactcgaggtcgacgtaccctacgggccaggacccggtctttggacttcggg

SEQ ID NO: 206191 - DNA, 563 bp, Homo sapiens
  misc_feature: GYAE6OF01BJ1MR.17.25.C03.1.454.CMB.1.raw
  modified_base (513)..(513): a, c, t, g, unknown or other
  misc_feature (513)..(513): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggacaaccctaacacgtggtgtcacagtgtcttcacccatccctcgggacagacttaccatcgaccacgaacctcctaccaactaaacacagaccctacatcgggtagttgacggacgcctagacatcgtacgacgacgaccggtccgttactattacgtggtcgacgagtacgtaccccacggtacgttccggngacgccgtacgggctacgggccggtacctttggaccgtttcggaccgggg

SEQ ID NO: 206192 - DNA, 528 bp, Homo sapiens
  misc_feature: GYAE6OF01A1S79.17.25.C03.1.454.CMB.1.raw
  modified_base (358)..(358): a, c, t, g, unknown or other
  misc_feature (358)..(358): n is a, c, g, or t
  modified_base (409)..(409): a, c, t, g, unknown or other
  misc_feature (409)..(409): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggacgaaccctaacacgtggtgtcacagtgtcttcacccntccgtcgggacagactacatcgaccacgactccaccataaacacagcctanagtgagttgagagcctgacatctagacgacgaccggtccgtcttaacttactgtcgcgagacgtcccagtcgtccggagcgccgtacgcgtacggccggtaccttgccgttcggcgggg

SEQ ID NO: 206193 - DNA, 558 bp, Homo sapiens
  misc_feature: GYAE6OF01C1HFC.17.25.C03.1.454.CMB.1.raw
  modified_base (437)..(437): a, c, t, g, unknown or other
  misc_feature (437)..(437): n is a, c, g, or t
  modified_base (451)..(451): a, c, t, g, unknown or other
  misc_feature (451)..(451): n is a, c, g, or t
  modified_base (457)..(457): a, c, t, g, unknown or other
  misc_feature (457)..(457): n is a, c, g, or t
  modified_base (461)..(461): a, c, t, g, unknown or other
  misc_feature (461)..(461): n is a, c, g, or t
  modified_base (480)..(480): a, c, t, g, unknown or other
  misc_feature (480)..(480): n is a, c, g, or t
  modified_base (490)..(490): a, c, t, g, unknown or other
  misc_feature (490)..(490): n is a, c, g, or t
tcagcgtagactagcacgaccggtgctcgatttagtagtgtagatttgggtttggggacgtcaacaaccacatctgtcctctagagaaaaccctgtgacgcacagctcctcacccatggactggacctggaggatcctcttcttggtggcagcagctacaagtgcccactcccaggtgcagctggtgcagtcgtggggctgaggtgaagaagcctggggcctcagtgaaggtctcctgcaaggcttctggattcacgtttacctcctatagtatcaactgggtgcgccgaggccgctggacacgacctggacgtgggatgggagtgggaccgaaaccctaacgacgtggtgtcaacgaggtcgtcttcacccctagtcccgtaccgggacagacttaccatacgaccacgaactcccaccaataaacacagcctaangtggtagttgaggntccgtnactntcagaccgacacggccttntattacgtgngcgaagcgtacccagtacgtcggtagacgcccgtaggcacggtacggtcctttgccgttcggccgggg

SEQ ID NO: 206194 - DNA, 538 bp, Homo sapiens
  misc_feature: GYAE6OF01C24K7.17.25.C03.1.454.CMB.1.raw
  modified_base (433)..(433): a, c, t, g, unknown or other
  misc_feature (433)..(433): n is a, c, g, or t
  modified_base (443)..(443): a, c, t, g, unknown or other
  misc_feature (443)..(443): n is a, c, g, or t
  modified_base (457)..(457): a, c, t, g, unknown or other
  misc_feature (457)..(457): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacacgacctgagtggatgggatggggcgaaccctaacacgtggtgtcacagtgtcttcacccatcctccgggacagacttaccatcgaccacgtaacctcctaccaataaaccacacgcctaacatgggagttgaggancctgacatcngacgacacggcctntacttacgtgtgcagcgtcccacgtacgtccggtgacgacccgtacggcacggccggtcctttcgcgttcggtaccggggg

SEQ ID NO: 206195 - DNA, 550 bp, Homo sapiens
  misc_feature: GYAE6OF01EQ6IR.17.25.C03.1.454.CMB.1.raw
  modified_base (479)..(479): a, c, t, g, unknown or other
  misc_feature (479)..(479): n is a, c, g, or t
  modified_base (509)..(509): a, c, t, g, unknown or other
  misc_feature (509)..(509): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaaggcttctggattcacgtttacctcctatagtatcaactgggtgcgccaggcccgctgggaccaacggcctggagtggatggggatggggcaaaccctaacacgtggtgtcacgagtgttcttcaccctatccgtccggggacacggtaccttaccatcgaaccacgaacctccctaccaataaaccacaagccctaacatgggagttggaggagcctgacatctagacgacacgggtcccgtntacttctgtgcgagacgtcccagctccggngcgacctcggctacggcggtacctttcgcgttcggtcgggg

SEQ ID NO: 206196 - DNA, 524 bp, Homo sapiens
  misc_feature: GYAE6OF01E3CFG.17.25.C03.1.454.CMB.1.raw
  modified_base (276)..(276): a, c, t, g, unknown or other
  misc_feature (276)..(276): n is a, c, g, or t
  modified_base (299)..(299): a, c, t, g, unknown or other
  misc_feature (299)..(299): n is a, c, g, or t
  modified_base (404)..(404): a, c, t, g, unknown or other
  misc_feature (404)..(404): n is a, c, g, or t
  modified_base (437)..(437): a, c, t, g, unknown or other
  misc_feature (437)..(437): n is a, c, g, or t
  modified_base (514)..(514): a, c, t, g, unknown or other
  misc_feature (514)..(514): n is a, c, g, or t
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatcctccctgtctgcctctggtgggggtcagagtcaccatcacttgccggacaagtcacggacgttaaaacctatttaaatggtatcagcaagaaacctggaaaacncccagacctcctgatctctggtncatccactctgcgaagtcggcctccagtcgaggttcagtgcagtgatcgtggacagtatttacaattctcaccatccaccactctgacaaccgtgaggtattgtnactaatctactactgtacaactagtacgttacncgttcccctgtcttacgtttcggccgtagggtacctaaagtgaagtactacgaaacgtactgtacgctacgacaccnctcgtgttcc

SEQ ID NO: 206197 - DNA, 536 bp, Homo sapiens
  misc_feature: GYAE6OF01CCCN9.17.25.C03.1.454.CMB.1.raw
  modified_base (279)..(279): a, c, t, g, unknown or other
  misc_feature (279)..(279): n is a, c, g, or t
  modified_base (303)..(303): a, c, t, g, unknown or other
  misc_feature (303)..(303): n is a, c, g, or t
  modified_base (402)..(402): a, c, t, g, unknown or other
  misc_feature (402)..(402): n is a, c, g, or t
  modified_base (423)..(423): a, c, t, g, unknown or other
  misc_feature (423)..(423): n is a, c, g, or t
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctggtgggggtcagagtcaccatcacttgccggacaagtcacggacgttaaaacctatttaaattggtatcagcaagaaacctggaaaacnccccagacctcctgatctctggtncatccactctgcgaagtggctcccatcgaggttcagtggcagtggatcgtggacagtatttcaatctcacatcaccactctgactaactgagtattgtnactaatctactactgtacaanagtacgttactacgttccctcgtacttacgtttcggaccgtaggggaacctaaagtagagacgtaacaaacggtaacgtggtacggacgtcgacctaactacttctcgttacc

SEQ ID NO: 206198 - DNA, 621 bp, Homo sapiens
  misc_feature: GYAE6OF01C3MHH.17.25.C03.1.454.CMB.1.raw
tcagcgtagactagcacgaccggtgctcgatttagtagtgtagatttgggtttgggggagtcagtctcagtcaggacacagcatggacatgaggtcccgctcagctcctgggctcctgctactctggctccgagctgccagatgtgacatccagactgacccagtctccatcctccctgtctgcctcgtggtgggggtcagagtcaccatcacttgccggacaagtcacggacgttaaaactatttaaatggtatcagacaagaaacctaggaaaacgccccagaccctctgactctctggtcgcattccactctgcgaagtcggcctccagtcgaggttcaggtcggcaggtcgatcgtagggactaggtatttacaattcctaccaacctactacccaacctacctctacgacctaaccgtggtaggttattgtacgtactaactaccttaacttactagtaccaacgtagtaacgttacctaccgtttcccctacgtacctttaccgttttcgggacccggtaacgggtaacctaaaggtttagaacgttaactaacgtaaaacggtacgttacgggtaacggtccgttacgacctaacttacgttccgttgttaccc

SEQ ID NO: 206199 - DNA, 546 bp, Homo sapiens
  misc_feature: GYAE6OF01CM4F8.17.25.C03.1.454.CMB.1.raw
  modified_base (423)..(423): a, c, t, g, unknown or other
  misc_feature (423)..(423): n is a, c, g, or t
  modified_base (449)..(449): a, c, t, g, unknown or other
  misc_feature (449)..(449): n is a, c, g, or t
  modified_base (473)..(473): a, c, t, g, unknown or other
  misc_feature (473)..(473): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgcaggccgctggacacgacctgagtggatgggatcgggacgaaccctaacgacgtggtcgtcacgagtgtcttcaccctatcccgtccgggacagacttaccatcgaccacgaacctcctaccaataaaccacagccctaanatcggagttgaggacgcctgacatcngacgacacgggtcctctattacgngtcgacgagacgtcccaggctccggtggacgccgtacggctacggccggtccttttggaccgttcggtcgggg

SEQ ID NO: 206200 - DNA, 549 bp, Homo sapiens
  misc_feature: GYAE6OF01AY004.17.25.C03.1.454.CMB.1.raw
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatcctccctgtctgcctctgtggggtcagagtcaccatcacttgccggacaagtcacggcgttaaaacctatttaaattggtatcagcaagaaacctggaaaacgccccagacctcctgactctctggtgcatccactctgcgaagtggcgtcccatcgaggttcagtggcaggtgatcgtgggacagtatttcaatcctcaccactcaccactcctgacctaaccgtgtaggtattgtgtactaactacggtacttactacgtacaacgagtaacgttactacgttcccctcgtctacgtttcggaccgtacgggtaccgtaaagtagtagtactacaaacgtaacgtacgtggtacgtcgacacctactcgttgttcc

SEQ ID NO: 206201 - DNA, 563 bp, Homo sapiens
  misc_feature: GYAE6OF01E2N0E.17.25.C03.1.454.CMB.1.raw
  modified_base (555)..(555): a, c, t, g, unknown or other
  misc_feature (555)..(555): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacccgagtggatgggatgggaccgaaccctaacacgtggtgtcacagtgtcttccacccagtcccgtccgggacacgtaccttaccatcgacccacgaacctcctaccaataaacacagaccctacagtaggagttgaggacgcctagactatcctaggaccgaacgaccggtccgttactacttacgtggtacgcgagtacgtcccagtacgtccggtgacgtccgtacggcacgtccggtccttagcttcggngggtaccg

SEQ ID NO: 206202 - DNA, 518 bp, Homo sapiens
  misc_feature: GYAE6OF01BHXJ2.17.25.C03.1.454.CMB.1.raw
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggacgttaaaacctatttaaattggtatcagcagaaacctggaaaagcccaagacctcctgatctctggtgcatccactctgcgaagtgctccatcgagttcagtggcagtgatcgtgggacagtatttcaatcacaccatccaccactctacgccaaacctgaaggtattggtgactaatactactactcgtacaacgtagtaacgttaccacgtttccctcgcttacgtttcgacgtacgggacctaaagttgagtatacaaggactgagctgacactatcgtgtac

SEQ ID NO: 206203 - DNA, 771 bp, Homo sapiens
  misc_feature: GYAE6OF01CRBOU.17.25.C03.1.454.CMB.1.raw
  modified_base (248)..(248): a, c, t, g, unknown or other
  misc_feature (248)..(248): n is a, c, g, or t
  modified_base (288)..(288): a, c, t, g, unknown or other
  misc_feature (288)..(288): n is a, c, g, or t
  modified_base (299)..(299): a, c, t, g, unknown or other
  misc_feature (299)..(299): n is a, c, g, or t
  modified_base (323)..(323): a, c, t, g, unknown or other
  misc_feature (323)..(323): n is a, c, g, or t
  modified_base (346)..(346): a, c, t, g, unknown or other
  misc_feature (346)..(346): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctggtgcagtcgtggggctggaggtgaagagccgtggggcctgagtgaggtctccgtgcaaggcttcgnggattcctacgtttaccacttatagtatcaacgtgggtcnccgcaggcccngtcggacaacggcctggaggtggngtgggatcgggaccaaaccgtancgtggtcactacgaggtcttcctaccaacccgtcgtacccgtcggggaaactacgtaaccctttaaccgacgttaacggaccctaaaccggtaacccttaccctaaccctaaaattaaaacccgaaccctaacggtacccttaaaccggaggttacgggttaacggttacggaacggggaccttaccggtacgaaccgtacgttcgtaaccggtaaccggacccggtaacccggggtcctttaaacgtttacgttaaccgtttcggggtaacggacccggtaacgggtacccggtttaacccccgacgggttaaaccccggttccggggacgtaacccggggtaccccggttaaaccgggctaacccggggggttcccgttacccggttttaacgtacccggggttttcgggaaccccggggggg

SEQ ID NO: 206204 - DNA, 541 bp, Homo sapiens
  misc_feature: GYAE6OF01DFPOE.17.25.C03.1.454.CMB.1.raw
  modified_base (301)..(301): a, c, t, g, unknown or other
  misc_feature (301)..(301): n is a, c, g, or t
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatcctccctgtctgcctctggtgggggtcagagtcaccatcacttgccggacaagtcacggcgttaaaaacctatttaaattggtatcagcaagaaacctggaaaacgccccagacctcctgatctctggtncatccactctgcgaagtggctccatcgagttcagtggcagtggatcgtggacagtatttcaatctcaccatcaccactctgacaacctgaggtattgtgcaatctactactgtacaacagtaacgttactacgttcccctcgtctacgttttcggaccgtaagggggaaccctaaaaggttagaagtaacttaacgaaaaccggtaaactggtggtacgtcgaccaacctattctgttcc

SEQ ID NO: 206205 - DNA, 606 bp, Homo sapiens
  misc_feature: GYAE6OF01AQ2SG.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccgaggccgcgtggacaacgcctggagtggatgggagtcgggacgaaccctaacgacgtggtcgtccgacgtaggtcgtccttaccaccccgtatccccgtaccggggtacacgtaccttaccgagtcgaaccctacgtaacctccctaccaataaaccactacgtacctaactagtggaagttcggaggacgcctgacagtcgtagaaccgacgaccggtcctactattacgtggtcgcgagtacgtacccgagtacgttccggacggcgacccgtacggacacggtcccgggttacctttcggtaccgttcgggtaccgggg

SEQ ID NO: 206206 - DNA, 700 bp, Homo sapiens
  misc_feature: GYAE6OF01CYOAN.17.25.C03.1.454.CMB.1.raw
tcagcgtagactagcacgaccggtgctcgatttagtagtgtagatttgggtttggggacctcaacaaccacatctgtcctctagaacgaaaaccctgtgagcacagctccctccaccagtggactcggacctgggaggactccttcttcgttgggtggcagcagctacaagtcgcccacctcccgaggtgcagcgtgggtgctagtcggtggggctggaggtaggaagaacgccggtcggggcctcgaggtaggaacggtcctccgtgacgacggtcttcgtggtacttccttaccgtttacctcctaagttaagttactacgtaacgtgggtcgccgccgacggcccgcgtcggaaccaaccgtaccgtggaggtggaggtgggagtcgggaccgaaacccctaacgacgtggtcgtacacgtagttcgtccttaccaccctacgtcccgtaccgggactacgtaccttaccactccgaacccgaaccgtaacctccctaaccaaactaaaccacacgaccctaatagtgggtagttggacggacgtctacgactacgtcgtacggaccgaaccgtccggtccgttacttacttacgtgacgcggtacgcccgtacccgacggtccgtccgggagaccgtacccggacggccgtacggtcccggttaccgtttacggcccgtttaccggggtccggggg

SEQ ID NO: 206207 - DNA, 548 bp, Homo sapiens
  misc_feature: GYAE6OF01BO0SG.17.25.C03.1.454.CMB.1.raw
  modified_base (395)..(395): a, c, t, g, unknown or other
  misc_feature (395)..(395): n is a, c, g, or t
  modified_base (447)..(447): a, c, t, g, unknown or other
  misc_feature (447)..(447): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctacactggtgtcacagtcgtcttcacccatcctccgggacacgtacttaccatcgaccacgacctccnccaataaacacacgcctacatggagttgaggagccctgacatctcgacgacncgggtcctctattactgtcgcgagacgtcccacggtactcccgggtgcggccctacgggcctacgggcccggttaccgtttacggctttcgggtccggggg

SEQ ID NO: 206208 - DNA, 529 bp, Homo sapiens
  misc_feature: GYAE6OF01ETY6A.17.25.C03.1.454.CMB.1.raw
  modified_base (280)..(280): a, c, t, g, unknown or other
  misc_feature (280)..(280): n is a, c, g, or t
  modified_base (337)..(337): a, c, t, g, unknown or other
  misc_feature (337)..(337): n is a, c, g, or t
  modified_base (417)..(417): a, c, t, g, unknown or other
  misc_feature (417)..(417): n is a, c, g, or t
  modified_base (431)..(431): a, c, t, g, unknown or other
  misc_feature (431)..(431): n is a, c, g, or t
  modified_base (438)..(438): a, c, t, g, unknown or other
  misc_feature (438)..(438): n is a, c, g, or t
  modified_base (441)..(441): a, c, t, g, unknown or other
  misc_feature (441)..(441): n is a, c, g, or t
  modified_base (489)..(489): a, c, t, g, unknown or other
  misc_feature (489)..(489): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacaacgcctgagtggatgggatgggcaaccctaacgacgtggngtcacagtgtcttcacccatcccgtccgggacagtacttaccatcgaccacgaacctccctacaataaacacacgcctanatggagttgaggcncctgacntcngacgacgacggccgtctattctgtgcgagtacgtcccagtcgtccggngacgccgtacggcacggcggtacctttggccttggcgggg

SEQ ID NO: 206209 - DNA, 682 bp, Homo sapiens
  misc_feature: GYAE6OF01DJKV1.17.25.C03.1.454.CMB.1.raw
  modified_base (502)..(502): a, c, t, g, unknown or other
  misc_feature (502)..(502): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagagccgtggggcctcagtgaaggtctcctgcaaggcttctggtattctacgtttacctctatagtatcaacgtgggtgcgccgaggcccgcgtcgggaaccaaccggacctggaggtagggtagtaggggatcggggacctaaaccctaacgacgtgggtactacaacgtggttcgtccttaccaacccgtgttcccgtacgggaacacgtaaccttacagtacaacctaccgaacctccctaccaaataaaccacaacgtaccctaagtagttcgggtaagttagaacgggtacncccgttaagactacgtacgtcgaaccgacgaccgggtccgttacttaagttaccgtggtacgaaccggtacgtacccggtaccccgtaaggtaccggttacccgggaggacccgacccggttaacccgggctaccggggaccccgtttgttttaccggcccgtttacgggacccgggggg

SEQ ID NO: 206210 - DNA, 575 bp, Homo sapiens
  misc_feature: GYAE6OF01A3TCY.17.25.C03.1.454.CMB.1.raw
  modified_base (276)..(276): a, c, t, g, unknown or other
  misc_feature (276)..(276): n is a, c, g, or t
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggtacgttaaaacctatttaaattggtatcagcagaaacctggaaaacnccccagaccctcctgactctctggtgcatccactctgcgaagtcggcgtcccatcgaggttcagtcggacagtggatcgtagggacagtatttcaatctacaccataccacctactctgaccaaccgtgacgtagttgtgtactaatctactactgtaccaacgtagtaacgttacaccgttacccctcgtccttaacgtttcgggaccgtaacggggtaaccctaaaggttacgaacgtaactaaccgaaacggtaacttggtaggaccttacgcctaaacctcttccgttgttcccg

SEQ ID NO: 206211 - DNA, 553 bp, Homo sapiens
  misc_feature: GYAE6OF01DIAJP.17.25.C03.1.454.CMB.1.raw
  modified_base (304)..(304): a, c, t, g, unknown or other
  misc_feature (304)..(304): n is a, c, g, or t
  modified_base (356)..(356): a, c, t, g, unknown or other
  misc_feature (356)..(356): n is a, c, g, or t
  modified_base (388)..(388): a, c, t, g, unknown or other
  misc_feature (388)..(388): n is a, c, g, or t
  modified_base (398)..(398): a, c, t, g, unknown or other
  misc_feature (398)..(398): n is a, c, g, or t
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctggtgggggtcagagtcaccatcacttgccgacaagtcacggtacgttaaaacctatttaaattggtatcagcaagaaacctaggaaaacgccccagacctcctgatctctggtncatccactctgcgaagtcggcctccagtcggtagttcagtggcagtgatcgnggacagtacttcatcacactatccacactctnctactgagtntgtgactatctactactactacaactagtacgttactaccgttccctcgtaccttacgtttcggaccgtacgggtaaccgtaaaggttagaacgtaacgtaacgaaacgtacgttacggtcggtacgtacgacctaccgtacttcgttcgttacc

SEQ ID NO: 206212 - DNA, 827 bp, Homo sapiens
  misc_feature: GYAE6OF01D2BJ0.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagagcctggggcctcagtgaagtctcctgcaaggcttctggattcacgtttacctctatagtatcaacgtgggtgcgccaggccgcgtggaaccaaccgtacctggagtggagtggggatcggggaccgaaaccccgttaacgacgtgggtcgttacgacgtaggttcgttacccttccgaacccctacgttaccccgtcccggggaaactacggtaaccctttaaccgacgttacggaaccccgtaacccggtaaacccttccccgttaacccctaaacttaaaaacccgaacccgtaaaccgtaaccccgttaaacgaaaccggtttaggggttaaacggtttacgggaaagggtaacccgtaccccgtaggaaccctaacgttccgtaacgggaacccggaacccgacccggggtcccgtttaacttaacgtttaacccgtggttaccggaccggtaaacggtacccggttaccccgaaaccgggttaccggttaccccggggttacggaacccgggttaccccggttaaaccccggggtaccgtaaaccggggttccccgggtttaaccccttttttaacggggtaaccccggttttcccggggtaaccccgggggggg

SEQ ID NO: 206213 - DNA, 541 bp, Homo sapiens
  misc_feature: GYAE6OF01B4HVI.17.25.C03.1.454.CMB.1.raw
  modified_base (273)..(273): a, c, t, g, unknown or other
  misc_feature (273)..(273): n is a, c, g, or t
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggacgttaaaactatttaaattggtatcagcagaaacctggaaaanccccagacctcctgatctctggtgcatccactctgcgaagtggcgtccatcgaggttcagtgcagtggatctgggacagatttcaatctcaccatcaccactctgcaactagagattgtgctaatctactactgtaccaatacgtaagttactacgttcccctcgtactacgttttcggaccgtaacgggtaaccgaaaggttaggacgtaacttacaaaaccggtaacgtacgtaggcctacggaccaacctaactcttcggttacc

SEQ ID NO: 206214 - DNA, 537 bp, Homo sapiens
  misc_feature: GYAE6OF01CEHBC.17.25.C03.1.454.CMB.1.raw
  modified_base (417)..(417): a, c, t, g, unknown or other
  misc_feature (417)..(417): n is a, c, g, or t
  modified_base (463)..(463): a, c, t, g, unknown or other
  misc_feature (463)..(463): n is a, c, g, or t
  modified_base (490)..(490): a, c, t, g, unknown or other
  misc_feature (490)..(490): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacacgtggtgtcacagtgtcttcaccctatcctccgggacacgacttaccatcgaccacgaactccctaccaataaaccacagcctanatggagttggagagcctgacatctgacgacacggtcctctattacngtcgcgagacgtcccacgactcccggngacgcccgtacggctaggccggtcctttacggaccttcggtcggggg

SEQ ID NO: 206215 - DNA, 740 bp, Homo sapiens
  misc_feature: GYAE6OF01CYW8K.17.25.C03.1.454.CMB.1.raw
tcagcgtagactagcacgaccggtgctcgatttagtagtgtagatttgggtttggggtacgtcaaacaaccacatctgtcctctagagaaaaccctgtgacgcacagctcctcaccatggactggacctggaggactcctcttcttggtggcagcagctacaagtgcccactcccaggtgcagctggtgtcaggtctggggctgacggtgaagaagccgtggggcctcagtgaaggtctccgtgcaaggcttcgtggattctacgtttacctcctatagtatcaactggtacgcgccaggccgtcgtggaccaaccgtacctggacgtggatgggatcgggacctaaccctaacacgtggtgtcgacgagttgtccttcgaccctagtcccgtaccgggactacgtaaccttaacccagtacgacccaacgtaacctcccgtaccctaactaaaccacctaacgtacctaacgagttcgggaagtttacggaaggtacgtaccgttacggaacctagttcccgttaaggaacccggtaacccggtaacccgggtacccggttaccgttaaacgtttaaaccgtcgggttaaccggacccggtaaacggaccggttacccccgaacggttaaccggtaccccgggttaacggtaaccggtacccccggttaaccgggaccgtaaccgggtaccccgggtttcccgttttaccggtaacccgttttcgggtacccggggggg

SEQ ID NO: 206216 - DNA, 580 bp, Homo sapiens
  misc_feature: GYAE6OF01DAIZM.17.25.C03.1.454.CMB.1.raw
  modified_base (340)..(340): a, c, t, g, unknown or other
  misc_feature (340)..(340): n is a, c, g, or t
  modified_base (416)..(416): a, c, t, g, unknown or other
  misc_feature (416)..(416): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaaggcttctggattcacgtttacctcctatagtatcaactgggtgcgccaggccgctggacaacgacctgagtggagtgggatgggacgaaccctaacacgtggtntcacagtcgtcttccaccctatcccgtccgggacacgtaccttaccatcgaccacgaacctccctaccaataaacncagacctacagtcggagttggaggacgtcctagacctatcgtaggaccgaccgaccgggtccgttacttaattaccgtggtcgccggaagtaccgtcccgacggtacgtccgggtgacgcccgtaggccacgggtccggtcctttggccgtttcggaccggggg

SEQ ID NO: 206217 - DNA, 518 bp, Homo sapiens
  misc_feature: GYAE6OF01DPSI9.17.25.C03.1.454.CMB.1.raw
  modified_base (338)..(338): a, c, t, g, unknown or other
  misc_feature (338)..(338): n is a, c, g, or t
  modified_base (402)..(402): a, c, t, g, unknown or other
  misc_feature (402)..(402): n is a, c, g, or t
  modified_base (410)..(410): a, c, t, g, unknown or other
  misc_feature (410)..(410): n is a, c, g, or t
  modified_base (422)..(422): a, c, t, g, unknown or other
  misc_feature (422)..(422): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgactgagtggatgggatgggacgaaccctaacactggtntcacagtgtcttcacccatcctccgggacagacttaccatcgaccacgaactcctacataaacncagcctantggattgaggancctgacatctgacgacgacggtcgtactattactgtgcgagacgtcccagcgtccggtgacgcctacggctaggccggtctttgcgttcgcggggg

SEQ ID NO: 206218 - DNA, 614 bp, Homo sapiens
  misc_feature: GYAE6OF01ESV4N.17.25.C03.1.454.CMB.1.raw
  modified_base (280)..(280): a, c, t, g, unknown or other
  misc_feature (280)..(280): n is a, c, g, or t
  modified_base (304)..(304): a, c, t, g, unknown or other
  misc_feature (304)..(304): n is a, c, g, or t
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatccctccctgtctgcctctggtggggtcagagtcaccatcacttgccggacaagtcacggtacgttaaaacctatttaaagttggtatcagcaagaaacctaggaaaacncccagacctctgactctcgtggtncatccactctgacgagtcgcctccagtcgagttcagtgcagtgatcgaggacagtatttcaattctacacctatccaccactcacgtaccaacgtggaggtacttgtactactaacttaccttactacttacgtaacaacgtaacgttaacgttaaccgtacccgtttaccccgtcgtaccttacggttttaccgggaaccggtaacggggtaaaccgtaaaggttacggaacgtaacgttaaccgaaaaccgggtacgttacgggtacggaccgttacgaccctaaccttacttccgttcgtttacccg

SEQ ID NO: 206219 - DNA, 528 bp, Homo sapiens
  misc_feature: GYAE6OF01AL52H.17.25.C03.1.454.CMB.1.raw
  modified_base (280)..(280): a, c, t, g, unknown or other
  misc_feature (280)..(280): n is a, c, g, or t
  modified_base (412)..(412): a, c, t, g, unknown or other
  misc_feature (412)..(412): n is a, c, g, or t
  modified_base (465)..(465): a, c, t, g, unknown or other
  misc_feature (465)..(465): n is a, c, g, or t
  modified_base (496)..(496): a, c, t, g, unknown or other
  misc_feature (496)..(496): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacaacgacctgagtggatgggatgggacgaaccctaacacgtggtgtcacagtcgtcttccacccatccgtccgggacacgtacttaccatcgaccacgaactccaccaataacacancctacagtggagttagaggacgcctagacctatcgagacgacacgggtccgtnttacttactgcgcgagcgtccagtcgtcggngcgccgtagcgagcgctttcgcgttcggcggg

SEQ ID NO: 206220 - DNA, 766 bp, Homo sapiens
  misc_feature: GYAE6OF01C0XCF.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcgttggtggcagcagctacaagtcgcccactcccaggtgcagctggtgcagtcgtggggctggaggtgaagagccgtggggcctcgagtgaacggtctccgtgacgaaggtcttcgtggtattccgtaccgtttacctcctatagtactacaacgtgggtcgccgccgacggcccgtcgtacggaaccgaaccgtaccgtaggaggtcggtagtgggaagtcgggaaccaaaccctaacgtacgtggtacgtacaacgtaggttcgttccttaccaacccgtacgtcccggtacccgggactacggtaaccctttaaccacgtaccgacccgtaaaccgtaaccgttcccctaacctaaactaaacccaccgtaaccgtaccctaaacgtaggttacgggtacggttacggaacggtacgtcccgtacgaacctacgttaccgtaacggaacccgaaccgtacccggggtccttaccgttaacgtttaccgtcggtacggaccggtaacggtacccgtaccccgtaacggtacccggttaccgggtacgtacccggtacccggtaaccgggaccgtaccgggtccccggttacgttttaccgggacccgtttccggggtacccggggg

SEQ ID NO: 206221 - DNA, 524 bp, Homo sapiens
  misc_feature: GYAE6OF01D0659.17.25.C03.1.454.CMB.1.raw
  modified_base (280)..(280): a, c, t, g, unknown or other
  misc_feature (280)..(280): n is a, c, g, or t
  modified_base (330)..(330): a, c, t, g, unknown or other
  misc_feature (330)..(330): n is a, c, g, or t
  modified_base (337)..(337): a, c, t, g, unknown or other
  misc_feature (337)..(337): n is a, c, g, or t
  modified_base (406)..(406): a, c, t, g, unknown or other
  misc_feature (406)..(406): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacaacgcctgagtggatgggatgggcgaaccctaanactggtntcacagtgtcttcacccatcctcgggacagacttacatgaccacgaactcctccataaacacagcctanatggagttgagagcctgactatctacgacgacacgggccgttactattactgtgcgagcgtcccacggactccggtgacgcccgtaggccaggccgtcctttcgactttcggcggggg

SEQ ID NO: 206222 - DNA, 543 bp, Homo sapiens
  misc_feature: GYAE6OF01EXBWI.17.25.C03.1.454.CMB.1.raw
  modified_base (330)..(330): a, c, t, g, unknown or other
  misc_feature (330)..(330): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggaccaacgacctgagtggatgggatgggcaacctaanactggtgtcacagtgtcttcacccatccgtcgggacagacttacatcgaaccacgaacctcctaccaataaaccacacgacctacatgggagttgaggacgcctagacatctagacgacaccggtccgtctattactgtgcgagacgtcccaggactcccgggtgacgcccgtacggcctaggccggtacctttcggaccgttcgtacggggg

SEQ ID NO: 206223 - DNA, 577 bp, Homo sapiens
  misc_feature: GYAE6OF01CX8DO.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagccgtggggcctcagtgaaggtctcctgcaggcttctggattcacgtttacctcctatagtatcaactgggtgcgccaggccgctcggacaacgacctgaggtggatggggatggggaccgaaccctaacgcgtggtgtcacgtagtgtccttccaccctatccgtccgggactagaccttaccatacgaccacgaacctcctaccaataaaccacacgaccctaacagtgggagttggaaggacgcctagacctattcgtacgaaccgaccgaccgggtccttacttaatttacgtgtagcgagaccgtcccaacggtcgttccggagacgcctaacggctacggcgtacctttcgcgttcggacgggg

SEQ ID NO: 206224 - DNA, 586 bp, Homo sapiens
  misc_feature: GYAE6OF01D9HTY.17.25.C03.1.454.CMB.1.raw
  modified_base (103)..(103): a, c, t, g, unknown or other
  misc_feature (103)..(103): n is a, c, g, or t
  modified_base (337)..(337): a, c, t, g, unknown or other
  misc_feature (337)..(337): n is a, c, g, or t
  modified_base (432)..(432): a, c, t, g, unknown or other
  misc_feature (432)..(432): n is a, c, g, or t
  modified_base (466)..(466): a, c, t, g, unknown or other
  misc_feature (466)..(466): n is a, c, g, or t
tcagcgtagactagcacgaccggtgctcgatttagtagtgtagatttgggtttgggggagtcagtctcagtccaggacacagcatggacatgagggtccccgntcagctcctggggctcctgctactctggcctcgagctgcagatgtgacatccagatcgacccagtcctccactccctccctgtctcgccttcgtgggtgggggtcagacgtccaccatcacttcgccggaacaagtccacggtaacgtttaaaacctattttaaagttggtatacagacaacgtaaaaccgtaggaaaaccgccccaagaccctcctagacttctcgtgggtcnccactccactcgtgacgtaagtcggcctccagtcgagttcaggtggactaggtgactcggtggacagtattacaatctacacactccacctatcncgacacgtgaggtattgcactaactctactactntacaacgtagtacttacaccgttccctacgtcttacgttcggaccgtaaggggtaacctaaaggttgaacgtactaacgaaacgtacgtgtcgactacgacctaactacttcgtgttacc

SEQ ID NO: 206225 - DNA, 724 bp, Homo sapiens
  misc_feature: GYAE6OF01DBYAK.17.25.C03.1.454.CMB.1.raw
  modified_base (289)..(289): a, c, t, g, unknown or other
  misc_feature (289)..(289): n is a, c, g, or t
tcagcgtagactagcacgaccggtgctcgatttagtagtgtagatttgggtttggggactcaacaaccacatctgtcctctagagaaaaccctgtgagcacagctccctcaccatggactggacctggaggatcctcttcttggtggcagcagctacaagtgcccactcccaggtgcagctggtgcagtcgtggggctgaggtgaagaagccgtggggcctcgagtgaaggtctccgtgacaaggcttcgtggacttcacgtttacctcctatagtatacacgtgggtncgccaggcccgctcggacaaccgcctggagtgagtgggagtcgggacctaacccgtaacgacgtggtcgtaccaacgtacggtcgtaccgttccaaccccgtacgttcccgtacggggacctaacggtaaccctttaccgaacgttaccgaaccctaaccgtaaccctccctaaccctaaactaaaccacctaaccgacctaacgtagtacgggtaaggttcggaacggtacgtccctaaggacctagttaccgttacgaaaccggtacccgtaccgggtaccccgttattaaaccgttttacgtacggtcggtaccggtacggtaacccgttaccccgaacgggtaaccgttcccgggtaaggacccggtaccccggtacgggaccgaccgggttccggttacccgtttacggtcccgttcgggtacccggggg

SEQ ID NO: 206226 - DNA, 559 bp, Homo sapiens
  misc_feature: GYAE6OF01EQU3P.17.25.C03.1.454.CMB.1.raw
  modified_base (418)..(418): a, c, t, g, unknown or other
  misc_feature (418)..(418): n is a, c, g, or t
  modified_base (426)..(426): a, c, t, g, unknown or other
  misc_feature (426)..(426): n is a, c, g, or t
  modified_base (446)..(446): a, c, t, g, unknown or other
  misc_feature (446)..(446): n is a, c, g, or t
  modified_base (450)..(450): a, c, t, g, unknown or other
  misc_feature (450)..(450): n is a, c, g, or t
  modified_base (479)..(479): a, c, t, g, unknown or other
  misc_feature (479)..(479): n is a, c, g, or t
  modified_base (511)..(511): a, c, t, g, unknown or other
  misc_feature (511)..(511): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggacgaaccctaacgacgtggtgtcacgtagtcgtcttccaccctatccgtaccgggacacgtaccttaccatcgacccacgaacctccctacataaacncagcctanataggattgagacgctgacntcgngaccgacgaccggtccttactacttacgngtcgacgacgacgtcccaggtactccgggtancggcccgtacggactacggcggttcctttggaccgttggtaccggggg

SEQ ID NO: 206227 - DNA, 515 bp, Homo sapiens
  misc_feature: GYAE6OF01B0HMP.17.25.C03.1.454.CMB.1.raw
  modified_base (420)..(420): a, c, t, g, unknown or other
  misc_feature (420)..(420): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcaacctaacactggtgtcacagtgtcttcacccatcctcgggacagacttaccatgaccacgaactcctaccataaacacagcctacatggagttgaggngcctgacatctgacgacacggcctatattactgtgcgagacgtcccaggctcccggtgacgcctacggcacgcggtctttggacttcgtcggggg

SEQ ID NO: 206228 - DNA, 571 bp, Homo sapiens
  misc_feature: GYAE6OF01DKYH8.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggacgaaccctaacactggtgtcacagtgtcttcaccctatcctccgggacagacttaccatcgaccacgaacctcctaccaataaaccacacgacctaacagtagggagttaggacggacgccttagacctatcgtacgaaccgaccgaccgggtcccgttacttattacgtggtgaccgagacgtccccaggacgttccgggtagacgcccgtacggcaggtccggtcctttcggaccttcggtacggggg

SEQ ID NO: 206229 - DNA, 570 bp, Homo sapiens
  misc_feature: GYAE6OF01CGGL9.17.25.C03.1.454.CMB.1.raw
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggacgttaaaactattaaattggtatcagcaagaaacctggaaaacgcccagacctcctgatctctggtcgcactccactctgcgaagtcggctccagtcgaggttcaggtggcaggtggatcgtggacagtattcaatctacaccactcacctactctgactaaccgtgaaggtattgtgactaatcttaactactagtacctaaacgacgtaacgttacctaccgttccccgtacgtcttacgttttcggacccggtaaggggtaacctaaaggttagaacgtaataccgaaaacggtacgttacggtaggacttacggacctaccacttcgtgttacc

SEQ ID NO: 206230 - DNA, 645 bp, Homo sapiens
  misc_feature: GYAE6OF01BQMCM.17.25.C03.1.454.CMB.1.raw
  modified_base (243)..(243): a, c, t, g, unknown or other
  misc_feature (243)..(243): n is a, c, g, or t
  modified_base (278)..(278): a, c, t, g, unknown or other
  misc_feature (278)..(278): n is a, c, g, or t
  modified_base (288)..(288): a, c, t, g, unknown or other
  misc_feature (288)..(288): n is a, c, g, or t
  modified_base (441)..(441): a, c, t, g, unknown or other
  misc_feature (441)..(441): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaaggcttcnggattcacgtttacctctatagtatcaactgggtncgcaggccgntggacaacgcctggagtggatggggatcggggaccgtaaaccctaagacgtgggtactacacgagtcgtaccttaccacccgtactcccgtaccggggacaacggtaccttacccattcgaacccacgtaacctcctacaactaaaccacacncctaacagtgagttgaggacgctaggacagtcgtagaccgtacgaccggtacccgtacttaagttaacgtgttaggccggtaacgaccgttaccccggaacgtacggttaccccgggtaggtaacccggacccgttaacccgggacccgtaaccggcccggggttacccttttaccgggtaacgtttcccgggtaaccgggggg

SEQ ID NO: 206231 - DNA, 640 bp, Homo sapiens
  misc_feature: GYAE6OF01BM6R7.17.25.C03.1.454.CMB.1.raw
tcagcgtagactagcacgaccggtgctcgatttagtagtgtagatttgggtttggggactcaacaaccacatctgtcctctagagaaaaccctgtgagcacagctccccaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactggggtgcgccaggccgctggacaacgacctgagtggagtgggatgggacaaaccctaacacgtggtgtcacagtcgtcttcacccatccgtccgggacacgtaccttacatacgaccaacgacctcctaccaataaaccacagacctaacagtggagttggaacggtacgcctaggaacctataccgtagaaccgtacgacccgggtaccttacttaacttacttggtacgaccgggtaacgtaccgttacccccgaaaggtaccgttcccggggtagaaccggtccccgttaaccgggccgtaaccgggtccccgggttacccttttagggaacccgtttttccgggccgggggggaaccccgg

SEQ ID NO: 206232 - DNA, 588 bp, Homo sapiens
  misc_feature: GYAE6OF01B94CZ.17.25.C03.1.454.CMB.1.raw
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatccctccctgtctgcctcgtggtgggggtcagagtcaccatcacttgccggacaagtcacggtacgttaaaacctatttaaattggtatcagcaagaaacctaggaaaacgccccaagaccctcctgactctcgtggtcgcatcccactctcgacgaagtcggcgtcccagtcggaggttcagtgcagtggactgtagggacagtactttcaatctacaccatccaccactctcgactaaccgtgacgtattgtagactaattctaactactgtaacaacgtagtaacgttacctaccgtttcccctacgtacttaacgtttcgggaccgtaacggggtaacctaaaggttcgaaacgtaactaacgaaaacgtacgttggtacggtcttaccggactaaccgtcttccgttgttacc

SEQ ID NO: 206233 - DNA, 494 bp, Homo sapiens
  misc_feature: GYAE6OF01DAOKD.17.25.C03.1.454.CMB.1.raw
  modified_base (387)..(387): a, c, t, g, unknown or other
  misc_feature (387)..(387): n is a, c, g, or t
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatcctccctgtctgcctctggtgggggtcagagtcaccatcacttgccggacaagtcacggacgttaaaacctattaaattggtatcagcagaaacctaggaaaagccccagacctcctgatctctggtgcatccactctgcgaagtggcgtccatcgagttcagtgcagtgatcgtggacagtatttcaatctcacatcaccactctgcaactgagnttgtgacaatctactactgtacaacagtagttacacgttcccctcactactttcggcgacgggtaacaagttgagactacgaaacgactgtgctgacacatctgtac

SEQ ID NO: 206234 - DNA, 546 bp, Homo sapiens
  misc_feature: GYAE6OF01B6N65.17.25.C03.1.454.CMB.1.raw
  modified_base (504)..(504): a, c, t, g, unknown or other
  misc_feature (504)..(504): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggaccaaccctaacacgtggtcgtcacagtgtcttcacccatcccgtccgggacagacttaccatcgacccacgaacctccctaccaataaaccacagcctacagtggagttgaggacgcctgactactctgaccgacgacggtccgttacttacttacgtgtcgcgagacgtcccagctccgggngacgccgtacggctacggccggtcctttgccgttcggcgggg

SEQ ID NO: 206235 - DNA, 691 bp, Homo sapiens
  misc_feature: GYAE6OF01CQ95K.17.25.C03.1.454.CMB.1.raw
  modified_base (295)..(295): a, c, t, g, unknown or other
  misc_feature (295)..(295): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctggtgcagtcgtggggctggaggtgaaagaagccgtggggcctcgagtgaaggtctcctgacgaaggtcttcgtggtattctaccgtttacctcctatagtatacaacgtgggtnccgccgacggccgcgtacggaaccaaccgtaccgtggaggtggagtgggagtcgggaccgtaaacccgtaacgacgttggtcgtacaacgtagtcgttccttaccaccctactcccgtacccgggactacgtaaccttaccagtacgaacccaacgtaacctccctaccaaataaaccactacgacctaacagttagggagttcggaaggacgtacctacgaactactcgtacgaaccgaaccgacccggtccgttaccttattaaccgtggtacgacgtaacgggtacctaccccgaacgtccggttacccgggtaggacccggttacccgttaaccgggcccgtagggtaccccggttccggttttacgtacccggtttccgggtaccgggggg

SEQ ID NO: 206236 - DNA, 523 bp, Homo sapiens
  misc_feature: GYAE6OF01EO1TZ.17.25.C03.1.454.CMB.1.raw
  modified_base (280)..(280): a, c, t, g, unknown or other
  misc_feature (280)..(280): n is a, c, g, or t
  modified_base (328)..(328): a, c, t, g, unknown or other
  misc_feature (328)..(328): n is a, c, g, or t
  modified_base (404)..(404): a, c, t, g, unknown or other
  misc_feature (404)..(404): n is a, c, g, or t
  modified_base (418)..(418): a, c, t, g, unknown or other
  misc_feature (418)..(418): n is a, c, g, or t
  modified_base (451)..(451): a, c, t, g, unknown or other
  misc_feature (451)..(451): n is a, c, g, or t
  modified_base (481)..(481): a, c, t, g, unknown or other
  misc_feature (481)..(481): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacaacgcctgagtggatgggatgggcaaccctanactggtgtcacagtgtcttcacccatccctcgggacagactaccatcgaccacgactcctcaataacacagcctanatggagttgaggancctgacatctagacgacacggcctatattacgngtcgcgagtacgtcccacgtactccgggtnacgccctacggcacggccggacctttggacttcggacggggg

SEQ ID NO: 206237 - DNA, 569 bp, Homo sapiens
  misc_feature: GYAE6OF01CF380.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagaagccgtggggcctcagtgaaggtctcctgcaaggcttctggattcacgtttacctcctatagtatcaactgggtgcgccaggccgctggacaacgacctgagtggagtgggatgggaccgaaccctaacgacgtggtgtcacgagtcgtccttaccaccctactcccgtccgggactacgtaccttaccatacgaccacgtaacctccctaccaataaaccacacgacctaacagtaggagttggacggacgcctgactatctagaccgacgaccggtcctactattcgtgtcgcgagaccgtcccacgtcgtccggagcgcccgtaggcgtacggccggtctttcgccgttcggtacgggg

SEQ ID NO: 206238 - DNA, 564 bp, Homo sapiens
  misc_feature: GYAE6OF01BJSO4.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgttttacctcctatagtatcaactgggtgcgccaggccgctggacaacgacctggagtggagtgggatgggaccgaaccctaacacgtggtgtcacagtgtcttcacccatccgtccgggacagacttaccatgaccacgaactcctaccaataaacacacgcctacagtggagttgagagcctgacatctagaccgacgaccggtccgtacttacttactgtggccgtagtaccgtaccccgacggtacttcccgggtagacgaccccgtacggcctacggccggtccctttgacccgttcggtacggggg

SEQ ID NO: 206239 - DNA, 606 bp, Homo sapiens
  misc_feature: GYAE6OF01EBO52.17.25.C03.1.454.CMB.1.raw
  modified_base (439)..(439): a, c, t, g, unknown or other
  misc_feature (439)..(439): n is a, c, g, or t
  modified_base (447)..(447): a, c, t, g, unknown or other
  misc_feature (447)..(447): n is a, c, g, or t
  modified_base (544)..(544): a, c, t, g, unknown or other
  misc_feature (544)..(544): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctgaggtgaagaagctggggcctcagtgaaggtctccgtgcaaggtcttcgtggtattctacgtttacctccgtatagtatcaacgtgggtgcgccgaggccgcgtggaaccaacgaccgtggacgtggagtgggatcgggaccaaaccctaacgacgtggtcgtacgaacgtagtcgtacttccgaccctactcccgtacgggacacgtacttaccatcgaccacgtacctcctacaataaacncacgctanagtggagttgagacgcctagactatcgtagaccgacgtcgtccgttacttacgttacgtgtcgacggtaagtaccgtacccacggtcggttaccggnggaaccgtcccgtacggaccgtacggtcccgttaccggtttcgaccgttccgggtaccgggg

SEQ ID NO: 206240 - DNA, 540 bp, Homo sapiens
  misc_feature: GYAE6OF01AKFZO.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatcgaccacgaacctcctaccaataaacacagcctacatggagttgagagcctgacatctgacgacgacggtccgtactattactgtgcgagtacgtcccacgtacgtcccgggtagacgcccgtacggcacggtccggtccttttgaccgtttcggtcggggg

SEQ ID NO: 206241 - DNA, 558 bp, Homo sapiens
  misc_feature: GYAE6OF01CLYXZ.17.25.C03.1.454.CMB.1.raw
  modified_base (321)..(321): a, c, t, g, unknown or other
  misc_feature (321)..(321): n is a, c, g, or t
  modified_base (329)..(329): a, c, t, g, unknown or other
  misc_feature (329)..(329): n is a, c, g, or t
  modified_base (472)..(472): a, c, t, g, unknown or other
  misc_feature (472)..(472): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaggtctctgcaggcttctggattcacgtttacctctatagtatcaactgggtgccgcaggccgctggacacgactgagtgatgggatgggcaacctaanacgtggtntcactagtcgtccttcaccctagtccgtacgggacctagaccttacatcgaccaacgaactcccactaactaaacacacgtcctaacagtaggagttggagacgtcctgactactcgtagacgacgaccggctactattacgngtcgcaacgtcgtaccccaacggtcgtaccggacgacgccgtaacgggctaacggccggtaccctttgtaccgttcggtacggggg

SEQ ID NO: 206242 - DNA, 634 bp, Homo sapiens
  misc_feature: GYAE6OF01DTHYR.17.25.C03.1.454.CMB.1.raw
  modified_base (573)..(573): a, c, t, g, unknown or other
  misc_feature (573)..(573): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctggtgcagtcgtggggctggaggtgaagagccgtggggcctgagtaggaacggtctccgtgcgtaaggtctttcgtaggtacttccgtaaccgttttacctccttaattacggttactacctaacgtggggtcgccggccgagggcccgcgtaggaacctaacgccgtaggagtacgggagtagggagtacgggaccgaaaccctaacgacgtggtacgacacgtacgtcgttcctaccacccgtacgttcccggacggtactaacgtacttaccattccgaactaccgactaccctacaaactaacacgacgtacacgtagtcggtagttagacgcgtcagactactcgtacgaacgccgtacggtaccgtattacgtacgtgacgcgtacncgtacccgacgtacgtcggtcgcgccgtagcgacgtccgttactcggtacttcgggacggg

SEQ ID NO: 206243 - DNA, 768 bp, Homo sapiens
  misc_feature: GYAE6OF01B041B.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagccgtggggcctcagtgaaggtctcctgcaaggcttctggtattcacgtttacctcctatagtatcaacgtggggtgcgccgaggccgctggacaacgcctggagtggagtgggagtcggggaccgaaaccctaacacgtgggtcgtccaacgtaggttcgttaccttccaacccctacgtccccgtacccggggaacaacggtaaccctttaacccgaagttaccggaaaccccgtaaccggtaaaccctttcccccgttaacccaaacgttaaaaacccacccgtaacccggtacccttaacgaacggttacggggtaacggtttacggggaaacggggtactcccggttaggaaccctagttaccgtacggaacccgacccgtaccggggttccccgttactttaacgtttaccgttcgggtacggacccggtaacggtacccggtacccccgtaacgggtaccgttaccccgggggtagaaccgaccgtaacggttacccggggactaccgggtcccgggtttccccgttttaggggtaccccgtttacgggggg

SEQ ID NO: 206244 - DNA, 803 bp, Homo sapiens
  misc_feature: GYAE6OF01CZBQ3.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagccgtggggcctcagtgaaggtctccgtgcaaggcttcgtggattccacgttttacctcttatagtatcaacgtgggtgcgccgaggccgcgtggaacaacgacctggaggtggagtggggaattcggggaccgtaaaccccgtaacgacgttgggtacgttaccgaaccgtaaggttcggttcccttttaccgaaaccccccgtagttcccccggttacccgggggaacctaaacggttaaccccttttaaacccgaaacgttccgggaaaccccctaaaccgggtaaaccccttcccccttaacccgaaaacgttaaaaacccaccccgtaaacggtacccccttaaacgtaacgtttacggggtaacggttttacgggaaacggggtaaccgtccccgtttaaggaacccttaagttcccgtaacgggtaaccggaacccgtaccggggtccccgttacttaaacgtttaccgtggtacgaccggtaacgaccgtaccccgaacggtacgttacccgggtagaccggtaccccgttaacgggccgtaacgggtcccggttaccttttacggccgtttcggtacccgggggg

SEQ ID NO: 206245 - DNA, 549 bp, Homo sapiens
  misc_feature: GYAE6OF01DFIKF.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggacgaaccctaacactggtgtcacagtgtcttcacccatccgtccgggacagacttaccatcgacccacgaactccctaccaataaaccacacgacctaacagttggagttgaggagcctgacatctgacgacgacggccgtactattactgtgacgagacgtcccacgacgtccggttgacgtcccgtacgggcctacggccggtcctttcggccgttcggtccggggg

SEQ ID NO: 206246 - DNA, 596 bp, Homo sapiens
  misc_feature: GYAE6OF01DG140.17.25.C03.1.454.CMB.1.raw
  modified_base (277)..(277): a, c, t, g, unknown or other
  misc_feature (277)..(277): n is a, c, g, or t
  modified_base (304)..(304): a, c, t, g, unknown or other
  misc_feature (304)..(304): n is a, c, g, or t
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatcctccctgtctgcctctggtggggtcagagtcaccatcacttgccggacaagtcacggacgttaaaacctatttaaattggtatcagcaagaaacctaggaaaacnccccagaccctctagactctcgtggtnctatccactctgacgaagtggcctccagtcgaggttcaggtcggcaggtggatcgtagggacagtactttacgaattcctacaacctactacccaacctaccttcgtcgtaccctaaccgtgaaggtattagtacgactaacgtacctaacttactacgtacaacgtagtacttaccgtaccgttccccgtcgtacttacgtttacggaccggtaacgggtaacctaaaggttacgaacgtaactaaccgaaacggtacgtggtacgacgtcgaccactcttcgtcgttacc

SEQ ID NO: 206247 - DNA, 605 bp, Homo sapiens
  misc_feature: GYAE6OF01CRRMY.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagagcctggggcctcgagtgaaggtctcctgcaaggcttctggattctacgtttacctccgtatagtattcaacgtgggtcgccgccgggccgtcgtggacaacgcctaggagtggagtgggagtcgggccgaaaccctacacgtggtgtacacgtagtgtcttcaccctatcccgtaccgggactacgtacttaccgattcgaaccacgaacctcctaccaataaacacacgcctaacacgtggacttggaaggacgtccctagactactcgtcgaaccgacaccgggtcctacttaattcgtgtcggacgaacgtaccgtacccacgacgttcccgggagaccgtcccgtaaacgggctacgggcccgttctttaggacccttccgggtgggtacccgg

SEQ ID NO: 206248 - DNA, 576 bp, Homo sapiens
  misc_feature: GYAE6OF01DC0ON.17.25.C03.1.454.CMB.1.raw
  modified_base (280)..(280): a, c, t, g, unknown or other
  misc_feature (280)..(280): n is a, c, g, or t
  modified_base (329)..(329): a, c, t, g, unknown or other
  misc_feature (329)..(329): n is a, c, g, or t
  modified_base (337)..(337): a, c, t, g, unknown or other
  misc_feature (337)..(337): n is a, c, g, or t
  modified_base (418)..(418): a, c, t, g, unknown or other
  misc_feature (418)..(418): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgcaggccgctggacaacgacctgagtggatgggatgggcaaccctaanacgtggtntcacagtgtcttcaccctatcccgtccgggacagaccttacatcgaccacgaacctcctaccaataaacacacgcctaacntaggagttggacggagcctagactatcgagaaccgaccgaccgggtccgtacttactttactgtcggaccgagacgtaccccaacggtacgtcccgggtagaccgtacccgtacggacacggtccgggtacccttttcggaccgttcggtaccggggg

SEQ ID NO: 206249 - DNA, 535 bp, Homo sapiens
  misc_feature: GYAE6OF01A2XTT.17.25.C03.1.454.CMB.1.raw
  modified_base (330)..(330): a, c, t, g, unknown or other
  misc_feature (330)..(330): n is a, c, g, or t
  modified_base (416)..(416): a, c, t, g, unknown or other
  misc_feature (416)..(416): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgcctgagtggatgggatgggcgaaccctaanacgtggtgtcacagtgtcttcacccatcctccgggacacgacttaccatcgaccacgaactcctaccaataaaccacagccctaanatggagttgaggagcctgacatctgaccgacaccgggccttactattactgtcgcgagtacgtcccgagtactccggtgagcccgtacggctaggcggtcctttgaccgttgtccgggg

SEQ ID NO: 206250 - DNA, 517 bp, Homo sapiens
  misc_feature: GYAE6OF01A1N8G.17.25.C03.1.454.CMB.1.raw
  modified_base (468)..(468): a, c, t, g, unknown or other
  misc_feature (468)..(468): n is a, c, g, or t
  modified_base (486)..(486): a, c, t, g, unknown or other
  misc_feature (486)..(486): n is a, c, g, or t
tcagcgtagactagcacgaccggtgctcgatttagtagtgtagatttgggtttggggacgtcaacaaccacgatctgtcctctagagaaaaccctgtgagcacacgctcctcaccatcggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatggggcgaaccctaacactggtgtcacagtgtcttcacccatcctccgggacagacttaccatcgaccacgaactcctccataaacacagcctacatggagttgaggagcctgacatctgacgacacgggcctctattactgtgcganacgtcccacgactccggngcgcctacggcagcgtctttgcttgtcgggg

SEQ ID NO: 206251 - DNA, 537 bp, Homo sapiens
  misc_feature: GYAE6OF01A2CJZ.17.25.C03.1.454.CMB.1.raw
  modified_base (280)..(280): a, c, t, g, unknown or other
  misc_feature (280)..(280): n is a, c, g, or t
  modified_base (412)..(412): a, c, t, g, unknown or other
  misc_feature (412)..(412): n is a, c, g, or t
  modified_base (465)..(465): a, c, t, g, unknown or other
  misc_feature (465)..(465): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacaacgacctgagtggatgggatgggaccgaaccctaacactggtgtcacagtgtcttcacccatccgtcgggacacgacttacatcgaccacgaactcctacataaacacagcctanatggagttgaggacgcctagacatctagaccgacgacggccttactacttacngtcgcgagacgtcccacgtcgtccggtagacgccgtacggcgtacggccggtcctttgaccgttcgcggggg

SEQ ID NO: 206252 - DNA, 518 bp, Homo sapiens
  misc_feature: GYAE6OF01AMAJR.17.25.C03.1.454.CMB.1.raw
  modified_base (281)..(281): a, c, t, g, unknown or other
  misc_feature (281)..(281): n is a, c, g, or t
  modified_base (457)..(457): a, c, t, g, unknown or other
  misc_feature (457)..(457): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctgggggcctcagtgaaggtctcctgcaaggcttctggattcacgtttacctcctatagtatcaactgggtncgccaggccgctggacaacgacctgagtggatgggatgggcgaaccctaacactggtgtcacagtgtcttcacccatcctccgggacagacttaccatcgaccacgaactcctccataaacacagcctacatggagttgaggagcctgacatctgacgacacggccgtctattacngtgcgagagtcccacgatcccggtagagccctacggcagcggacctttcgcttcgtcgggg

SEQ ID NO: 206253 - DNA, 653 bp, Homo sapiens
  misc_feature: GYAE6OF01DRN30.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagccgtggggcctgagtgaaggtctcctgcaggcttcgtggattcacgtttacctcctatagtatcaacgtgggtgcgccaggccgctggacaacgacctgagtggagtgggagtgggaccgaaacccgtaacaccgttgggtacgtaccgaacgaaggttcgtacctttaccgaacccctacgttccccggtacccggggaacacgtaacctttacccgattacgaaccctacgtaacctaccctaccaactaaacctacaacgacctacagtacgggagttggaaggacgtaccgtgaactactcgtagaaccgtacgaaccgggtccttacgttacttacgtgtacgcgaggaccgtacccgacgtcgtcccgggttagaccggcccgtaacgggccgtacgggtcccggtccgttttacggtaccgttcggtacccggggg

SEQ ID NO: 206254 - DNA, 775 bp, Homo sapiens
  misc_feature: GYAE6OF01DVMNH.17.25.C03.1.454.CMB.1.raw
  modified_base (221)..(221): a, c, t, g, unknown or other
  misc_feature (221)..(221): n is a, c, g, or t
  modified_base (265)..(265): a, c, t, g, unknown or other
  misc_feature (265)..(265): n is a, c, g, or t
  modified_base (285)..(285): a, c, t, g, unknown or other
  misc_feature (285)..(285): n is a, c, g, or t
  modified_base (295)..(295): a, c, t, g, unknown or other
  misc_feature (295)..(295): n is a, c, g, or t
  modified_base (337)..(337): a, c, t, g, unknown or other
  misc_feature (337)..(337): n is a, c, g, or t
tcagcgtagactagcacgaccggtgctcgatttagtagtgtagatttgggtttggggactcaacaaccacatctgtcctctagagaaaaccctgtgagcacagctccctcaccatggactggacctggaggatcctcttcttggtggcagcagctacaagtgcccactcccaggtgcagctggtgcagtctggggctgaggtgaagaagccgtggggcctnagtgaaggtctcctgcaaggtcttcgtggattctacgtttaccncctatagtatcaactgggtncgccaggccngtggacaacgcctgagtggatgggagtgggaccaaccctaanacgtggtcgtcacgtagtcgtcttccaccctacgtcccgtacccggggactaacggtaacctttacccaagttaccgaaccctaaccggtaacccttacctaccctaaagttaaaaccccaaccctaacggacccttaacgaagttacggggtaaggtttacgggaacggtacggtacccgttacgaacctaacgttccggttaagaacccggtaacccggtaacccggggtaccccgtttaaccgtttaacgtttaaccgttaggtaccggtaccggtaacgggttaaacccggttacccccgtaaacgggtaacccggttacccggggttacgggtaacccggtaccccggtaaaccggggaccggtaaacgggttcccccgggttacccgtttttaccgggtaaacccggtttttccggggtaaccccggggggg

SEQ ID NO: 206255 - DNA, 557 bp, Homo sapiens
  misc_feature: GYAE6OF01CWHFH.17.25.C03.1.454.CMB.1.raw
  modified_base (330)..(330): a, c, t, g, unknown or other
  misc_feature (330)..(330): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgcctgagtggatgggatgggcgaaccctaanacgtggtgtcacagtgtcttcacccatcctccgggacagacttaccatcgaccacgaacctcctaccaataaaccacacgccctacatggagttgaggagcctgacatctagaccgacgaccgggccgttactattacgtgtcgccggagaccgtcccacggtacgtcccgggtagacggcccgtacggccgacggccggtccttttcggaccgttcggtacggggg

SEQ ID NO: 206256 - DNA, 735 bp, Homo sapiens
  misc_feature: GYAE6OF01DDWA3.17.25.C03.1.454.CMB.1.raw
  modified_base (294)..(294): a, c, t, g, unknown or other
  misc_feature (294)..(294): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagccgtggggcctcagtgaaggtctcctgcaaggcttctggattcacgtttacctcctatagtatcaacgtgggtgcgccagggcccncgtggaccaacgacctggagtggatgggatggggaccaaccctaacgcgtaggtgtccacgtagttcgtccgtttccaacccctagtcccgttacccgggggaacctacggtaacctttacccgaagttaccgaaccccgtaaccggaaacccttcccgtacccctaaataaaacccaaccgaacgtaccccttaacgaagttacgggaagtttacgggaacgggtaacgtcccgttaggaactacttaccgtacggaaccgaacccgtaaccggggtacccgttaccttaacgtttaacccgtgggtaccggtaccggaacgggtaacccggtacccctaacgggaacgtttccccggggttaggaacccgtccccggtaaccgggccgtaacgggtcccgggttacccttttacggtaccgtttcgggtacccgggggg

SEQ ID NO: 206257 - DNA, 535 bp, Homo sapiens
  misc_feature: GYAE6OF01ET4QJ.17.25.C03.1.454.CMB.1.raw
  modified_base (332)..(332): a, c, t, g, unknown or other
  misc_feature (332)..(332): n is a, c, g, or t
  modified_base (412)..(412): a, c, t, g, unknown or other
  misc_feature (412)..(412): n is a, c, g, or t
  modified_base (427)..(427): a, c, t, g, unknown or other
  misc_feature (427)..(427): n is a, c, g, or t
  modified_base (434)..(434): a, c, t, g, unknown or other
  misc_feature (434)..(434): n is a, c, g, or t
  modified_base (437)..(437): a, c, t, g, unknown or other
  misc_feature (437)..(437): n is a, c, g, or t
  modified_base (460)..(460): a, c, t, g, unknown or other
  misc_feature (460)..(460): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaaggcttctggattcacgtttacctcctatagtatcaactgggtgcgccaggccgctggacaacgacctgagtggatgggatggggacgaaccctaanacgtggtgtcacagtgtctcacccatccctcgggacagtacttacatcgaccacgaacctcctacataaacacagcctanatggagttgaggacncctgacntcngacgacacggcctatactactgngacgagccgtcccacggtacgtccgggagcgcccgtacggcacggtccggtccgtttgaccgttggtaccggggg

SEQ ID NO: 206258 - DNA, 565 bp, Homo sapiens
  misc_feature: GYAE6OF01CXRW8.17.25.C03.1.454.CMB.1.raw
  modified_base (280)..(280): a, c, t, g, unknown or other
  misc_feature (280)..(280): n is a, c, g, or t
  modified_base (485)..(485): a, c, t, g, unknown or other
  misc_feature (485)..(485): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacacgacctgagtggatgggatgggacgaaccctaacacgtggtgtcacagttgtcttcaccctatcccgtccgggacagtaccttacatcgaccacgacctcctacaataaacacacgcctaacagtgggattcggaggtagtcctgactactctagaaccgaccgaccgggtccgttactaactttacnggtcgacgtagaccgtccccagtacgtcccgggtgacgtcccgtacggctacggcgttcctttcggcttcggtacggggg

SEQ ID NO: 206259 - DNA, 531 bp, Homo sapiens
  misc_feature: GYAE6OF01EQTM0.17.25.C03.1.454.CMB.1.raw
  modified_base (280)..(280): a, c, t, g, unknown or other
  misc_feature (280)..(280): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacaacgacctgagtggatgggatgggcaaccctaacactggtgtcacagtgtcttcacccatccgtccgggacagacttaccatcgaccacgaactcctccaataaaccacagcctaacatggagttgaggacgcctagacatctgacgacacggtccttctattactgtgcgagacgtcccagacttccgggagcgcccgtacggcctaggccggtcctttgcgttcggtacgggg

SEQ ID NO: 206260 - DNA, 910 bp, Homo sapiens
  misc_feature: GYAE6OF01B3ZG0.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtagaagagccgtggggcctcgagtgaaggtcctccgtgacgaggtcttcgtggtacttcgtaccgttttaccctaccgttaagttacgttaactaccgtaaacggttggggtacgaccggacccgaacggggtccccgtacgttacgggaaaccctaaacccggtacccgtgggaacggttagggaaggttcgggggaagttacgggggaacccgtaaaaccccgtaacgtaccggttgggttacgtaccgaacgtagttcgttacccttaccgaacccctacgtcccccggtaccggggaactaacggtaacctttacccagttaccgaaccctaaccgtaaccttaccccgtacctaaacgtaaaaccaccgtaaccgtacccttaacgacggttagggtaacgtttacgggaacggtaccgtacccgttaaggaacctaacgttaccgtaaccgggaacccggtaaccccggtacccggggttaccccgttaacgttttaaccgttaaccgggttaccggttacgggtaacccgggtaaacggtacccggtttaaccccccggaacgggttacccggtttacccgggggtacggtaaacccgggtacccccggttaaaccggggacccgttaacccgggggttccccggtttacccggtttttaaccgggtaacccgggttttcccgggggtaaccccggggggg

SEQ ID NO: 206261 - DNA, 538 bp, Homo sapiens
  misc_feature: GYAE6OF01EB28M.17.25.C03.1.454.CMB.1.raw
  modified_base (280)..(280): a, c, t, g, unknown or other
  misc_feature (280)..(280): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacaacgacctgagtggatgggatgggcaaccctaacactggtgtcacgagtgtcttcacccatccctccgggacagacttaccatcgaccacgaactccacataaacacagcctacatggagttgaggacgcctgacatcgtaggaccgacgacgggtccgtacttattacgtgtgcgaagacgtcccagtacgtccgggtgacgccgtacggcgagcccggtctttggaccttcggtacgggg

SEQ ID NO: 206262 - DNA, 531 bp, Homo sapiens
  misc_feature: GYAE6OF01BLD8A.17.25.C03.1.454.CMB.1.raw
  modified_base (280)..(280): a, c, t, g, unknown or other
  misc_feature (280)..(280): n is a, c, g, or t
  modified_base (331)..(331): a, c, t, g, unknown or other
  misc_feature (331)..(331): n is a, c, g, or t
  modified_base (486)..(486): a, c, t, g, unknown or other
  misc_feature (486)..(486): n is a, c, g, or t
tcagcgtagactagcacgaccggtgctcgatttagtagtgtagattttggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacaacgacctggagtggatgggatgggcaaccctaanactggtgtcacagtgtcttcacccatcctcggggacagacttaccgatcgaccacgaactcctccataaacacagcctacatggattgaggagcctgacatctgacgacacgggccttctacttactgtgcgagcgtcccacggtactcccgggngcgccctacgggcacggccggtcctttggacctttcgtccggggg

SEQ ID NO: 206263 - DNA, 550 bp, Homo sapiens
  misc_feature: GYAE6OF01BCLMT.17.25.C03.1.454.CMB.1.raw
  modified_base (411)..(411): a, c, t, g, unknown or other
  misc_feature (411)..(411): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaggcttctggattcacgtttacctcctatagtatcaactgggtgcgccaggccgctggacaacgacctgagtggatggggatggggaccgaaccctaacacgtggtgtcacagtgtcttcacccatccgtccgggacagtacttaccatacgaccacgaacctcctaccaataaacncacgcctaacagtggtagttgagacgcctgactatcgtagacgacgacggccgttctacgttctgtcgcgacgacgtacccgagacgttccggagacgcctacgggctacggccgtacctttgccgttggtaccggggg

SEQ ID NO: 206264 - DNA, 569 bp, Homo sapiens
  misc_feature: GYAE6OF01BFB6A.17.25.C03.1.454.CMB.1.raw
  modified_base (538)..(538): a, c, t, g, unknown or other
  misc_feature (538)..(538): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaacgtgggtgcgccaggcccgcgtggaccaacgacctggaggtggagtggggatcggggaccgaaaccctaacgacgtggtgtacacgagttgtaccttccaccccactcccgtaccggggacacgtaaccttaccatacgacccacgaacctccctaccaactaaaccacacgacctaacagtaggtagttggaggacgcctgacatcgagacgacagtcggaccgttactattacgtggtgcgagacgtcccgacgtacgtcggngacgcgtacggcacggccggtcttgcgtcgg

SEQ ID NO: 206265 - DNA, 547 bp, Homo sapiens
  misc_feature: GYAE6OF01AQ4FH.17.25.C03.1.454.CMB.1.raw
  modified_base (337)..(337): a, c, t, g, unknown or other
  misc_feature (337)..(337): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagaagccgtggggcctcagtgaaggtctcctgcaaggcttctggattcacgtttacctcctatagtatcaactgggtgcgccaggcccgctggacaacgacctggagtggatgggatgggacgaaaccctaanacgtggtgtcacagtgtcttcacccatccgtccgggacagacttaccatcgaccacgaacctcctaccaataacacagcctacagtggagttgaggacgccgtagacatctcgacgaccgcggtccgttactattacgtgtacgcgagacgtcccaacgtcgtccggtagacgccgtacggctacgccggtacctttgcttcggtcgggg

SEQ ID NO: 206266 - DNA, 534 bp, Homo sapiens
  misc_feature: GYAE6OF01APZH6.17.25.C03.1.454.CMB.1.raw
  modified_base (331)..(331): a, c, t, g, unknown or other
  misc_feature (331)..(331): n is a, c, g, or t
  modified_base (415)..(415): a, c, t, g, unknown or other
  misc_feature (415)..(415): n is a, c, g, or t
  modified_base (455)..(455): a, c, t, g, unknown or other
  misc_feature (455)..(455): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcaaaccctaanactggtgtcacagtgtcttcacccatccgtccgggacacgacttaccatgaccaccgaactcctccaataaaccacacgcctanactggagttgagacgcctgacatctgacgacacggccgtntacttactgtcgcgtagacgtcccacgacgtccggtgcgccgtacgcgacgccggtacctttgaccgttcggtacgggg

SEQ ID NO: 206267 - DNA, 540 bp, Homo sapiens
  misc_feature: GYAE6OF01DJTZM.17.25.C03.1.454.CMB.1.raw
  modified_base (244)..(244): a, c, t, g, unknown or other
  misc_feature (244)..(244): n is a, c, g, or t
  modified_base (280)..(280): a, c, t, g, unknown or other
  misc_feature (280)..(280): n is a, c, g, or t
  modified_base (341)..(341): a, c, t, g, unknown or other
  misc_feature (341)..(341): n is a, c, g, or t
  modified_base (428)..(428): a, c, t, g, unknown or other
  misc_feature (428)..(428): n is a, c, g, or t
  modified_base (459)..(459): a, c, t, g, unknown or other
  misc_feature (459)..(459): n is a, c, g, or t
  modified_base (469)..(469): a, c, t, g, unknown or other
  misc_feature (469)..(469): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttcnggattcacgtttacctcctatagtatcaactgggtncgccaggccgctggacaacgacctgagtggatgggatgggcgaaccctacactggtgtcanagtgtctcacccatccctcgggacagaccttaccatcgacccacgaactccctaccaataaaccacagcctacatggagttgagganccctgaccatctgacgaccacgggtcccttntacttactgngcggagacgtcccaggactccgggtgaacgcccgtacggcacggccggtacctttggccttcggtacgggg

SEQ ID NO: 206268 - DNA, 613 bp, Homo sapiens
  misc_feature: GYAE6OF01A0CDY.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaacgtgggtgcgccgaggccgctggacacgacctgagtggagtgggagtcgggaccgaaccctaacgacgttggtcgtacacgtagttcgttccttccacccctacgtcccgtccgggacacgtacttaccatcgaaccacgtaacctccctacaactaaaccacgtacgacccttaagagttagggtacgttaggagtacgtccctagacctacgtcgtacggaacccgaccgtaccggtaccttacttacgtacgtggtacgacgtacggaccgtcccgaggtcgtccggagccgtcccgaggtccgacggtccgttagttcgtccgttcgggaccgggg

SEQ ID NO: 206269 - DNA, 725 bp, Homo sapiens
  misc_feature: GYAE6OF01D4WVN.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagccgtggggcctcgagtgaaggtctccgtgcaaggtcttcgtggattcacgtttacctcctatagtatcaacgtgggtcgcgccgaggccgcgtggaacaacgacctgagtggagtgggatcgggaccaaacccgtaacgacgtggtacgtaccaacgtagttcgtccttccaaccccgtagtcccgtaccggggaactacggtaacctttaccacgttacgaaccctaaccgtaaacccttcccgtacctaaacgttaaaaccacgtaaccgtacccttaacgaacgttaggggtaacgtttacgggaaacgggtaccgtacccgtaggaaccctagttaccgtacggaacccgaccgtaaccggggtcccttacgttaacgttaccgtggtacggtacggaacggtacccgttaccccgaaggtaccgttacccggggtagacccggtacccgtaaccgggccgtaacgggtccccggttaccgttttcggacccgtttcggggtacccggggg

SEQ ID NO: 206270 - DNA, 585 bp, Homo sapiens
  misc_feature: GYAE6OF01D6GCW.17.25.C03.1.454.CMB.1.raw
  modified_base (425)..(425): a, c, t, g, unknown or other
  misc_feature (425)..(425): n is a, c, g, or t
  modified_base (450)..(450): a, c, t, g, unknown or other
  misc_feature (450)..(450): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaagtctcctgcaaggcttctggattcacgtttacctcctatagtatcaactgggtgcgccaggccgctcggacaacgacctgagtggatgggagtgggcgaaccctaacacgtggtcgtcacagtgtcttcaccctactcccgtccgggacacgtacttaccatacgaccacgaactcctaccaataaaccacagccctaanagtggagttgaggacgtccgtgacntctagacgacgaccgggtccgtacttacgttactggtcgacgtagtaccgtccccaacggtacgtcccgggtagccggtacccgtacgggaccgaggtcccgggtaccttttcggaccgttcggtacccgggggg

SEQ ID NO: 206271 - DNA, 661 bp, Homo sapiens
  misc_feature: GYAE6OF01B6J25.17.25.C03.1.454.CMB.1.raw
  modified_base (247)..(247): a, c, t, g, unknown or other
  misc_feature (247)..(247): n is a, c, g, or t
  modified_base (448)..(448): a, c, t, g, unknown or other
  misc_feature (448)..(448): n is a, c, g, or t
tcagcgtagactagcacgaccggtgctcgatttagtagtgtagatttggggtttggggacggtcaacaaccacatctgtcctctagagaaaaccctgtgagcacagctcctcaccatggactggacctggaggatccctcttcttggtggcagcagctacaagtgcccactcccaggtgcagctggtgcagtctggggctggaggtgaagaagcctggggcctcagtgaaggtctcctgcaggcttnggattcacgtttacctcctatagtatacaagttgggtcgcgccaggccgcgtggaccaacgtccgtggaggtggatggggatgggaccgaacctaagacgtggtctacacgtgtcgtcttacacccattccgtaccgggacacgtaccttaccagtacgacccacgtaacctcctaccaataaacccacgtacgccctaanagttgggtaagttcggaagggacgtcccgtagaacctacgttcgtaacgtaaccggacctaccgggtaccctactaaacgtttccgtgggtacgtacggtaacggtaccgttaccccgtaagggtaccgttccggggtaacgtacccggcccgttaacgggccgtaacgggtccccgttaccgttttcggacccgtttcggggacccgggggg

SEQ ID NO: 206272 - DNA, 555 bp, Homo sapiens
  misc_feature: GYAE6OF01BN5AD.17.25.C03.1.454.CMB.1.raw
  modified_base (333)..(333): a, c, t, g, unknown or other
  misc_feature (333)..(333): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggacgaaccctaacncgtggtgtcacaggtctcttcaccctatcccgtccgggacagtacttaccatcgaccacgaactcctaccaataaacacacgcctacagtggagttgaggtacgcctgacagtctgaacgaccgacggtccgttctacttacgtgtacgcgtagacgtcccgagtcgtcccggtggacgcccgtacgcgtacggccggtacctttcgacgtttcggtggggg

SEQ ID NO: 206273 - DNA, 523 bp, Homo sapiens
  misc_feature: GYAE6OF01D7MCY.17.25.C03.1.454.CMB.1.raw
  modified_base (280)..(280): a, c, t, g, unknown or other
  misc_feature (280)..(280): n is a, c, g, or t
  modified_base (330)..(330): a, c, t, g, unknown or other
  misc_feature (330)..(330): n is a, c, g, or t
  modified_base (429)..(429): a, c, t, g, unknown or other
  misc_feature (429)..(429): n is a, c, g, or t
  modified_base (464)..(464): a, c, t, g, unknown or other
  misc_feature (464)..(464): n is a, c, g, or t
  modified_base (490)..(490): a, c, t, g, unknown or other
  misc_feature (490)..(490): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacaacgacctgagtggatgggatgggacaaccctanactggtgtcacagtgtcttcacccatcctcgggacagtaccttaccatcgaccacgaacctcctaccaataaaccacacgacctacatggagttgaggnccgtgacatctagacgacacggccgtactattacngtagcgagcgtcccacgctccgggtncgcctacggcaggccgtctttcgcttgacgggg

SEQ ID NO: 206274 - DNA, 638 bp, Homo sapiens
  misc_feature: GYAE6OF01BTMX7.17.25.C03.1.454.CMB.1.raw
  modified_base (329)..(329): a, c, t, g, unknown or other
  misc_feature (329)..(329): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaaggcttctggattcacgtttacctcctatagtatcaactggtgcgccaggccgctggacaacgacctgagtggatgggatgggacaaccctaanacgtggtgtcacagtcgtcttcacccatcctccgggacagacttaccatcgaccacgaacctcctacaactaaacacagtcctaacagtcggtagttggaacggacgtcctaggaacctattcgtaggaaccggtagttaacccggggtacccgttacgtttaacgtttacgtggttacggaccggtaacggtaccggttacccccgaacgggtacgttcccggggtacgaccgggtaccccggttaaccgggccgtaacggggtcccgggttacccttttcgggtacccgtttccgggtaccgggggg

SEQ ID NO: 206275 - DNA, 615 bp, Homo sapiens
  misc_feature: GYAE6OF01DATCU.17.25.C03.1.454.CMB.1.raw
  modified_base (330)..(330): a, c, t, g, unknown or other
  misc_feature (330)..(330): n is a, c, g, or t
  modified_base (435)..(435): a, c, t, g, unknown or other
  misc_feature (435)..(435): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcaaccctaanactggtgtcacagtgtcttcacccatcctccgggacacgacttaccatcgaccacgaactcctaccaataaacacagcctaacatagggtagttggaacgggacnccgtagactacttcgtaggaaccgaccgaccgggtcccgttacttaactttaccgtggtcggacgtaacggtaccgtaccccgaacggtacgttacccgggtagaccggtaccccgttacgggaccgtacgggtcccgggttacccttttacgggtacccgtttccgggtacccgggggg

SEQ ID NO: 206276 - DNA, 525 bp, Homo sapiens
  misc_feature: GYAE6OF01A7B7Z.17.25.C03.1.454.CMB.1.raw
  modified_base (280)..(280): a, c, t, g, unknown or other
  misc_feature (280)..(280): n is a, c, g, or t
  modified_base (432)..(432): a, c, t, g, unknown or other
  misc_feature (432)..(432): n is a, c, g, or t
  modified_base (456)..(456): a, c, t, g, unknown or other
  misc_feature (456)..(456): n is a, c, g, or t
  modified_base (487)..(487): a, c, t, g, unknown or other
  misc_feature (487)..(487): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacaacgacctgagtggatgggatgggcgaaccctaacactggtgtcacagtgtcttcaccccatccctccgggacagacttaccatcgaccacgaacctcctaccaataaaccacacgcctaacatggagttgaggancctgacatctgacgacacggcctntattactgtgcgagtcgtcccagctccgggngacgcctacggcacggcggtcctttgccgttggcgggg

SEQ ID NO: 206277 - DNA, 755 bp, Homo sapiens
  misc_feature: GYAE6OF01D7X1S.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcaccgtttacctcctatagtatcaactgggtgcgccaggccgctggacaacgacctggagtggagtgggatggggaccgaaaccctaacgacgtgggtcgtccaacgtaggttcgtcctttaccaacccctacgttccccgtccgggggaaccacggtaaccctttaacccaagtcgaacccgtaaccgtaaacccttcccctaccaaacttaaaacccaaccgaacgtacccttaacaacgttacggggtaaggtttacgggaacggggtacgtcccgttaacggaacctacgtttaccgtacggaacccggtaacccggtaacccggggttacccgtttaacctttaacgtttaccgttgggtacggaccggtaaacggtacccggttacccccgaaacgggttaccgttacccggggttaggaccgggtaccccgtaaccggggaccgtaacgggtcccgggttacccgtttttcggtaacccgtttcggggtacccgggggg

SEQ ID NO: 206278 - DNA, 540 bp, Homo sapiens
  misc_feature: GYAE6OF01BZQY8.17.25.C03.1.454.CMB.1.raw
  modified_base (288)..(288): a, c, t, g, unknown or other
  misc_feature (288)..(288): n is a, c, g, or t
  modified_base (328)..(328): a, c, t, g, unknown or other
  misc_feature (328)..(328): n is a, c, g, or t
  modified_base (427)..(427): a, c, t, g, unknown or other
  misc_feature (427)..(427): n is a, c, g, or t
  modified_base (460)..(460): a, c, t, g, unknown or other
  misc_feature (460)..(460): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgagtgaagagcctggggcctcagtgaaggtctcctgcaaggcttctggattcacgtttacctcctatagtatcaactgggtgcgccaggccnctggacaacgcctgagtggatgggatgggcgaaccctaanactggtgtcacagtgtcttcacccatccgtcgggacagtacttacatcgaccacgaactcctacaataaacacacgcctaacatcggagttgacggacncctgacatcagacgacacggcctactatactgngcgacgcgtcccaggactccgggtagcggacccgtaccggacgacggtccggtaccttttcggaccgttggtaccggggg

SEQ ID NO: 206279 - DNA, 579 bp, Homo sapiens
  misc_feature: GYAE6OF01DME1F.17.25.C03.1.454.CMB.1.raw
  modified_base (450)..(450): a, c, t, g, unknown or other
  misc_feature (450)..(450): n is a, c, g, or t
  modified_base (459)..(459): a, c, t, g, unknown or other
  misc_feature (459)..(459): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctggtgcagtcgtggggctggaggtgaagaagcctggggcctcagtgaaggtctcctgcaggcttcgtggattcacgtttacctcctatagtatcaactgggtgcgccaggccgcgtggacaacgacctgagtggagtgggatgggacgaacctaacacgtggtgtcacgtagtcgtacttcaccctatcccgtccgggacacgacttaccatacgaaccacgaacctcctaccaataaaccacacgacctaacagtaggagttgaggtanccgtgaacntcgtaggaccgacgaccggtccgtacttacttacgtgtgacgtacgacgtacccgacgtacgttccgggagtacgccgttacgcgtacgtccggtacctttcgtccgttcgtaccggggg

SEQ ID NO: 206280 - DNA, 621 bp, Homo sapiens
  misc_feature: GYAE6OF01DMQAP.17.25.C03.1.454.CMB.1.raw
  modified_base (284)..(284): a, c, t, g, unknown or other
  misc_feature (284)..(284): n is a, c, g, or t
  modified_base (295)..(295): a, c, t, g, unknown or other
  misc_feature (295)..(295): n is a, c, g, or t
  modified_base (354)..(354): a, c, t, g, unknown or other
  misc_feature (354)..(354): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagaagccgtggggcctcgagtgaaggtctcctgcaaggcttctggattcacgtttacctcctatagtatcaacgtgggtncgccaggccgngtacggacaacgacctggagtggagtgggagtcgggacgaaaccctaacgacgtgggtntcacgtagtcgttccttcaaccctctcccgtaccggggacacggtaccttaaccatcgaaccacgaacctccctacaactaaacacacgcctacgagtaggagttaggaggacgcctagactagtcgacgacgaccgaccggtcccgttacttacttacgtcggtgacggaacggtaccgtacccgacggtaccgttaccgggtacggtaccgaccgtaccgggacgtacggtcccgggtaccttttggacccgttggtaccggggg

SEQ ID NO: 206281 - DNA, 764 bp, Homo sapiens
  misc_feature: GYAE6OF01B3VM6.17.25.C03.1.454.CMB.1.raw
  modified_base (487)..(487): a, c, t, g, unknown or other
  misc_feature (487)..(487): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatccttcttcgttggtggcagcagctacaagtcgcccactcccaggtgcagcgtggtgcagtcgtggggctggaggtagaagacggccgtggggcctcgaggtgaacggtcctccgtggacgaaggtcctttcgtaggactttccgtaccgttttacctcttaatagtatcgaacgtggggtcgccggaccgaggcccgacgtcggaaccaaccgtacctggagtggagtgggacgtcgggaccgtaaaccgtaacgacgttggtcgtacaacgtagtcgtaccttacaccccgtactcccggtaccgggacacgtaaccttacgagtaccgaaccaaccgtacctaccaacctaanaaacctaacacgtacctaacgagtacgacgtcgtaggacgcgtccgtagacctagtccgaacggaccgtaaccgtaccggtaccgtttacgttaacgttacgacggttacgaaccgggtaaaccgtacccgggttaacccccgtaaccgggttaaccggttccccgggttaaacgggaaccccgggtttaacccccggtaccggggacccgggttacccggggtaaccccgggtttttaccccggtttaaccgggttaacccgggtttcccgggggg

SEQ ID NO: 206282 - DNA, 783 bp, Homo sapiens
  misc_feature: GYAE6OF01EC57Y.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctggtgcagtcgtggggctggaggtgaagagccgtggggcctcagtgaaggtctcctgcgaaggcttcgtggtactttcgtaaccgttttacctccttaatagtactcgaacgtggggtcgccgtccgacgggccgtcgtacggaaccaacggtacctggtacggtggaggtgggagtcggggaaccgtaaaccctaagacgttgggtcgtacacgtagtcgttccttacgacccctacgttcccgtaccgggaactacgtaaccttaaccgagtacgaaccccaaccggtaacccttccccgtaaccctaaacttaaaacccgacccgtaaaccgtaaccccgttaaacgtaacggtttacggggtaacgtttacgggaaacgggaccgttccgtaacggtaaccgtacttaccggtacggaacccgtaaccggacccggggttacccttacgttaaacgtttaccggtcggtacggaccggtaacggtacccgttaccccgaacggttaaccggttccggggtacgaaccggtccccggtacgggaccgtaaccgggtcccggttaccttttacgggtaccgtttcccggggtaaccggggg

SEQ ID NO: 206283 - DNA, 559 bp, Homo sapiens
  misc_feature: GYAE6OF01B0HI7.17.25.C03.1.454.CMB.1.raw
  modified_base (419)..(419): a, c, t, g, unknown or other
  misc_feature (419)..(419): n is a, c, g, or t
  modified_base (427)..(427): a, c, t, g, unknown or other
  misc_feature (427)..(427): n is a, c, g, or t
  modified_base (439)..(439): a, c, t, g, unknown or other
  misc_feature (439)..(439): n is a, c, g, or t
  modified_base (451)..(451): a, c, t, g, unknown or other
  misc_feature (451)..(451): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagccgtggggcctcagtgaaggtctcctgcaaggcttctggattcacgtttacctcctatagtatcaactgggtgcgccaggccgctggaccaacgacctgagtggagtgggagtgggaccgaaccctaacacgtggtgtcactagtgtccttcaccctatcccgtccggacacgtaccttaccatcgaccacgtaacctcctacaataaacncagcctanatggattgagcncctgactatcgngacgacacgggtccctatacttacgtgtcgcgagccgtaccgagcgttccgggtagaccgtccgtaacggctacgggccgttactttcggaccgttcggtaccggggg

SEQ ID NO: 206284 - DNA, 635 bp, Homo sapiens
  misc_feature: GYAE6OF01DDHKZ.17.25.C03.1.454.CMB.1.raw
  modified_base (333)..(333): a, c, t, g, unknown or other
  misc_feature (333)..(333): n is a, c, g, or t
  modified_base (339)..(339): a, c, t, g, unknown or other
  misc_feature (339)..(339): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtcgcgccaggccgcgtggacaacgactgagtggatgggatgggacaaccctaacncgtggngtcacagtgtccttcaccctatcccgtaccgggacagaccttaccatcgaccaacgtaacctccctaccaactaaacacacgaccctaacagttgggagttacggaaggacgtacctacggaacctattccgtaggaaccgtaaccgaacccgggtcccgttacttaacgtttaccgtggttcggaccgagtaccgttaccccgaacggtacgtacccggggttagaccggtacccgtacgggccgtacgggtacccggttccgttttacggacccgttttcgggtacccgggggg

SEQ ID NO: 206285 - DNA, 519 bp, Homo sapiens
  misc_feature: GYAE6OF01BQU85.17.25.C03.1.454.CMB.1.raw
  modified_base (331)..(331): a, c, t, g, unknown or other
  misc_feature (331)..(331): n is a, c, g, or t
  modified_base (410)..(410): a, c, t, g, unknown or other
  misc_feature (410)..(410): n is a, c, g, or t
  modified_base (434)..(434): a, c, t, g, unknown or other
  misc_feature (434)..(434): n is a, c, g, or t
  modified_base (457)..(457): a, c, t, g, unknown or other
  misc_feature (457)..(457): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgcctgagtggatgggatgggcgaaccctaacncgtggtgtcacagtgtcttcacccatccctccgggacagacttaccatcgaccacgaactcctcataaacacagcctanatggagttgagagcctagacatcngacgacaccggcctctattacgngtgcgagcgtcccagacgtccggtgacgcctacggcaggccgtcctttgacgttcgtcgggg

SEQ ID NO: 206286 - DNA, 566 bp, Homo sapiens
  misc_feature: GYAE6OF01CFNF0.17.25.C03.1.454.CMB.1.raw
  modified_base (419)..(419): a, c, t, g, unknown or other
  misc_feature (419)..(419): n is a, c, g, or t
  modified_base (432)..(432): a, c, t, g, unknown or other
  misc_feature (432)..(432): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaggtctcctgcaggctctggattcacgtttacctcctatagtatcaacgtgggtgcgccaggccgcgtggacaacgacctgagtggatgggatcgggacaaccctaacacgtggtgtcacgagtgtcttaccaccctactcccgtcgggacagacttaccatcgacaacgaactcctaccaataaccacacgcctanagtgagtgaggancctagacatctagaccgacacgggtcctctaacttctggtcgacgtagaccgttcccacggtacgtcccgggtagccggaccccttaagggccacgggttcccgtccgtttacggaccgttcggtaccgggggg

SEQ ID NO: 206287 - DNA, 581 bp, Homo sapiens
  misc_feature: GYAE6OF01CIU0N.17.25.C03.1.454.CMB.1.raw
  modified_base (445)..(445): a, c, t, g, unknown or other
  misc_feature (445)..(445): n is a, c, g, or t
  modified_base (482)..(482): a, c, t, g, unknown or other
  misc_feature (482)..(482): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagccgtggggcctcagtgaaggtctcctgcaaggcttcgtggattctacgtttacctcctatagtatcaactgggtgcgccaggccgcgtcggacaacgacctggagtggagtgggagtcggggaccgaacccctaacgaccgtgggtcgtcaacgtaggttcgtccgttccaccctactcccgtaccgggacacgtaccttaccatcgaccaccgaacctccctaccaataaaccncacgcctaagagtggagttgacggacgcctgacatcngaaccgacgacgtcgtctattctgcgcgagcgtcccagtcgtccggtggacgtcccgtagggcccaggtcccggtactttcggccgttcgggtacgggg

SEQ ID NO: 206288 - DNA, 549 bp, Homo sapiens
  misc_feature: GYAE6OF01CP8DM.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggacgaaccctaacacgtggtgtcacagtcgtcttcaccctatccgtccgggactacgacttaccatcgaccacgaactcctaccaataaacacacgacctacatggagttagacggagcctagactatcgtacgaacgacgaccggtccgtactacttactgtgcgagacgtcccaacggtctccggtgcgccgtacggcgacggcggtcctttcgcgttcggtacgggg

SEQ ID NO: 206289 - DNA, 574 bp, Homo sapiens
  misc_feature: GYAE6OF01BY24F.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctgggctgaggtgaagaagcctggggcctcagtgaaggtctcctgcaaggcttctggattcacgtttacctcctatagtatcaactgggtgcgccaggccgctggacaacgacctgagtggatgggatgggacgaaccctaacacgtggtgtcacgagtcgtcttcacccatcccgtcgggacagacttaccatcgaccacgactccctacaataaacacacgacctacatggagttgaaggacgcctgacatctagaccgacgacggtccttacttattacgtgtcgacgagaccgtaccccgaggtacgtaccgggtgaaccgtcccgtaccgggaccgtacgggcccggttacccttttaggacccgtttcgggtaccggggg

SEQ ID NO: 206290 - DNA, 626 bp, Homo sapiens
  misc_feature: GYAE6OF01BJRSO.17.25.C03.1.454.CMB.1.raw
  modified_base (243)..(243): a, c, t, g, unknown or other
  misc_feature (243)..(243): n is a, c, g, or t
tcagcgtagactagcacgaccggtgctcgatttagtagtgtagatttgggtttggggactcaacaaccacatctgtcctctagagaaaaccccgtgagcacagctcctcaccatggactggacctggaggatcctcttcttggtggcagcagctacaagtgcccactcccaggtgcagctggtgcagtcgtgggctgaggtgaagaagcctggggcctcagtgaaggtctccgtgcaggcttntggattcacgtttacctcctatagtatcaacgtgggtgcgccgaggccgcgtggaccaacgacctgacgtggagtgggagtcgggaccgaaacccctaacgacgttggtcgtccaacgaggttcgtccttaccgaccctacgtcccgtccgggacacgtaccttacatcgaccacgaacctcctaccaataaccacacgacctaacataggacgttaggagacgtcctagactagtcctacggaaccgaccgacccggtcccgttacttacttacgtgtacgcgtaaggcctaccccgaacggtaccgtccgggtagaccggcccgttacgggccaacgggtcccgttccgttacgccgtttcccgggtcggggtaccccggg

SEQ ID NO: 206291 - DNA, 647 bp, Homo sapiens
  misc_feature: GYAE6OF01CL2A9.17.25.C03.1.454.CMB.1.raw
  modified_base (278)..(278): a, c, t, g, unknown or other
  misc_feature (278)..(278): n is a, c, g, or t
  modified_base (297)..(297): a, c, t, g, unknown or other
  misc_feature (297)..(297): n is a, c, g, or t
  modified_base (303)..(303): a, c, t, g, unknown or other
  misc_feature (303)..(303): n is a, c, g, or t
  modified_base (617)..(617): a, c, t, g, unknown or other
  misc_feature (617)..(617): n is a, c, g, or t
tcagcgtagactagcacgaccggtgctcgatttagtagtgtagatttgggtttgggggagtcagtctcagtcaggacacagcatggacatgagggtccccgctcagctcctgggctcctgctactctggctccgagctgccagatgtgacatccagatgacccagtcctccatccctcctgtctgcctctggtggggtcagagtcaccatcacttgccggacaagtcacggtacgttaaaactatttaaatggtatcagcaagaaacctaggaaaacncccagacctcctgatcctntggtcnctactccctacttcgtggacgtaaggtcggccgtaccctaagtcggtaggtttcaggttggccgtaaggttggaagttcgtagggacctagtactttcaatcctaccactatcccactactctcgaccctaacgtaggtaagtgttcgtagaacctaagttccttaacctacgtcgtaacctaaacgtagtaacgtttaccgtaccgtttcccccgtcgtactttaccgtttacgggacccggtaaacgggaaccttaaagggttgaaacggtactaacccggaaaacgttaccgttagggtcgtaccggttanacccgtaacctacgtttcctggtttacccc

SEQ ID NO: 206292 - DNA, 535 bp, Homo sapiens
  misc_feature: GYAE6OF01D27IQ.17.25.C03.1.454.CMB.1.raw
  modified_base (291)..(291): a, c, t, g, unknown or other
  misc_feature (291)..(291): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgntggacaacgacctgagtggatgggatgggacgaaccctaacactggtcgtcactagtgtcttcaccctatcctccgggacagacttaccatcgaccacgaacctcctaccactaaacacagcctacatggagttgagacgcctgacatctgacgacgacgggtcctacttattactgtgcgagacgtcccacgtcgtccggtgacgccgtacggcgacgccggtctttcggcgttcggtcgggg

SEQ ID NO: 206293 - DNA, 590 bp, Homo sapiens
  misc_feature: GYAE6OF01DCQ6Z.17.25.C03.1.454.CMB.1.raw
  modified_base (241)..(241): a, c, t, g, unknown or other
  misc_feature (241)..(241): n is a, c, g, or t
  modified_base (334)..(334): a, c, t, g, unknown or other
  misc_feature (334)..(334): n is a, c, g, or t
  modified_base (342)..(342): a, c, t, g, unknown or other
  misc_feature (342)..(342): n is a, c, g, or t
  modified_base (350)..(350): a, c, t, g, unknown or other
  misc_feature (350)..(350): n is a, c, g, or t
  modified_base (426)..(426): a, c, t, g, unknown or other
  misc_feature (426)..(426): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctctgcaggcttntggattcacgtttacctctatagtatcaacgtgggtgcgccaggcccgctggaccaacgacctggagtggagtgggatgggaccaaaccctanacgtggtntcacagtntccttcaccctatcccgtcgggacagtaccttaccatcgaccacgaacctcctaccactaaacacacgtacctaanagttgggattaggaggactccgtacgtacacgttcacggaacccgacgacccgggtccgtacttattacgtggtcgaccgagtacccgtcccgacggtactccgggtacgacggtacccgtacgggcgacggtccggttcctttacgacgtttcggaccggggg

SEQ ID NO: 206294 - DNA, 574 bp, Homo sapiens
  misc_feature: GYAE6OF01C4GL6.17.25.C03.1.454.CMB.1.raw
  modified_base (334)..(334): a, c, t, g, unknown or other
  misc_feature (334)..(334): n is a, c, g, or t
  modified_base (411)..(411): a, c, t, g, unknown or other
  misc_feature (411)..(411): n is a, c, g, or t
  modified_base (416)..(416): a, c, t, g, unknown or other
  misc_feature (416)..(416): n is a, c, g, or t
  modified_base (425)..(425): a, c, t, g, unknown or other
  misc_feature (425)..(425): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattctacgtttacctcctatagtatcaactgggtgcgccaggccgctcggacaacgacctgagtggatgggatgggacaacccctaanacgtggtctcacgtagtgtccttacacccctatcccgtaccgggcacgtaccttaccatcgaccacgactcctacanaaacncagcctaanagtgagtgagcgcctgacatcgtgaaccgacgaccggtccttactacgttactggtacgcgtagaccgtacccacggtacgtccgggtaggaccgtacccggtacggcctacgggtccggttccgttttacgccgttcgggtaccgggg

SEQ ID NO: 206295 - DNA, 555 bp, Homo sapiens
  misc_feature: GYAE6OF01BHY09.17.25.C03.1.454.CMB.1.raw
  modified_base (274)..(274): a, c, t, g, unknown or other
  misc_feature (274)..(274): n is a, c, g, or t
tcagcgtagactagcacgaccggtgctcgatttagtagtgtagatttgggtttgggagtcagtctcagtcaggacacagcatggacatgagggtccccgctcagctcctgggactcctgctactctggctccgagctgccagatgtgacatccagatgacccagtctccatcctccctgtctgcctctgtggggtcagagtcaccatcacttgccggacaagtcacggacgttaaaacctatttaattggtatcagcaagaaacctggaaaacnccccagacctcctgatctctggtgcatccactctgcgaagtcggcctcccagtcgaggttcagtggcaggtggatcgtgggacagtatttcaattctacaccatccaccactctcgacctaacctgaaggtattgtgactaattcctactactgtaccaacgtagtaacgttaccaccgtttcccctgtaccttacgtttcggaccgtaagggtaacctaaaggttgaagtactaacgaaacgtacgtaggtacggtctacgccaacctacttcgtgttcc

SEQ ID NO: 206296 - DNA, 588 bp, Homo sapiens
  misc_feature: GYAE6OF01B8TID.17.25.C03.1.454.CMB.1.raw
  modified_base (328)..(328): a, c, t, g, unknown or other
  misc_feature (328)..(328): n is a, c, g, or t
  modified_base (530)..(530): a, c, t, g, unknown or other
  misc_feature (530)..(530): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaaggcttctggattcacgtttacctcctatagtatcaactgggtgcgccaggccgctggacaacgcctgagtggatgggatggggcaaccctanactggtgtcacgagtgtccttcacccctatcccgtaccggggacacgtaccttaccgatcgacctaccgaacctcctaccaactaaacacacgacctaacagtggagtttggaggacgccctagacagtctacgacgaaccgacgggtccgtacttacgtttactggtacgccgacgtacgtaccccgacgacgttcccggngtaacggccctacgggacctaggtcccggtaccctttggaccgtttccggtacggggg

SEQ ID NO: 206297 - DNA, 511 bp, Homo sapiens
  misc_feature: GYAE6OF01EUOGY.17.25.C03.1.454.CMB.1.raw
  modified_base (279)..(279): a, c, t, g, unknown or other
  misc_feature (279)..(279): n is a, c, g, or t
  modified_base (410)..(410): a, c, t, g, unknown or other
  misc_feature (410)..(410): n is a, c, g, or t
  modified_base (479)..(479): a, c, t, g, unknown or other
  misc_feature (479)..(479): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaaggcttctggattcacgtttacctcctatagtatcaactgggtncgccaggccgctggacaacgacctgagtggatgggatgggcgaaccctaacactggtgtcacagtgtcttcacccatcctcgggacagacttaccatcgaccacgaacctcctccaataaacacagcctanatggattgaggagcctgacatctgacgacacggcctctattactgtgcgagacgtcccagactccgggnacgcctaggcagcggcctttgcttcgtcgggg

SEQ ID NO: 206298 - DNA, 567 bp, Homo sapiens
  misc_feature: GYAE6OF01DWCGM.17.25.C03.1.454.CMB.1.raw
  modified_base (280)..(280): a, c, t, g, unknown or other
  misc_feature (280)..(280): n is a, c, g, or t
  modified_base (290)..(290): a, c, t, g, unknown or other
  misc_feature (290)..(290): n is a, c, g, or t
  modified_base (332)..(332): a, c, t, g, unknown or other
  misc_feature (332)..(332): n is a, c, g, or t
  modified_base (362)..(362): a, c, t, g, unknown or other
  misc_feature (362)..(362): n is a, c, g, or t
  modified_base (476)..(476): a, c, t, g, unknown or other
  misc_feature (476)..(476): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccnctggacaacgacctgagtggatgggatgggacgaaccctaanactggtgtacacgagtcgtcttcaaccctntcccgtcggggacagacttaccatcgaccacgtactcctacaataaaccacacgacctaacatgggtattcggagacgcctgacatctagacgacgacgtccgtactattacgngtacgcgagtacgtacccacggacttacccgggagacgacccgttacggcgtaacggccggtaccttttcggaccgtttcggtaccggggg

SEQ ID NO: 206299 - DNA, 736 bp, Homo sapiens
  misc_feature: GYAE6OF01CQHN5.17.25.C03.1.454.CMB.1.raw
  modified_base (267)..(267): a, c, t, g, unknown or other
  misc_feature (267)..(267): n is a, c, g, or t
  modified_base (303)..(303): a, c, t, g, unknown or other
  misc_feature (303)..(303): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagaagccgtggggcctcgagtgaaggtctccgtgcaaggtcttctggattccgtacgtttacncctatagtactacaacgtggtcgcgccgacggccgngtacggacaacgaccgtggacgtggacgtggggacgttcggggaccgtaaaccccgtaacgaacggtggtcgtaccaacgtagttcggttccttaccaccccgtacgtacccgtacccgggactaacggtaaccttaaccgataccggaaccctaaccgtaaaccctcccttaacccaactaaaaaccaccgaaccgtaccctaaacgacgttagggtaagttaggaacggtacggtcctaacggaactacgtacgttcggaaccgtaccgaacccgggttccggttaacctttaacgtttaaccgtcggtagtccggtaacgtaacccgggtaccaacggtaacccggttcccgggaaggtaaccggacccgttacgggacccgtaagggtccccggttacgttttaccggaccgttcgggtacccgggggg

SEQ ID NO: 206300 - DNA, 731 bp, Homo sapiens
  misc_feature: GYAE6OF01DLSYE.17.25.C03.1.454.CMB.1.raw
  modified_base (232)..(232): a, c, t, g, unknown or other
  misc_feature (232)..(232): n is a, c, g, or t
  modified_base (706)..(706): a, c, t, g, unknown or other
  misc_feature (706)..(706): n is a, c, g, or t
tcagcgtagactagcacgaccggtgctcgatttagtagtgtagatttggggtttggggtaggtcagtctcagtcaggacacagcatggacatgagggtccccgctcagctccgtgggctcctgctactctggctccgacgctcgccagatgtgacatccagtactcgacccagtctccatccctcctgtctcgcctcgtggtggggtcagacgtccaacatcactgaccganacgtcacggtacttaaactattaatgtatgagactaagtaaacgtaggaaaacctcccaacgtacctcctagtactccgtcgtaggtaccactactcctaactcgtacggacgtaagtcggtacccgtacctaggtacggttacggtacgtaggtacggtacgtaggttgtacgttacggtacgggaacttaggttaactttacaaacttcccaacctaacctaacttacccaacctaccgtactaccgaaccctacgtaacggtaagtacgttacgtacgtaaccgtaaacttaccttaacgttaccgtaacgttaaccgaaacgttaacgttaacgttaaccccgttccgtttaccccgacgttaacgtttacgttaccgggaacggtaaaccgggtaagtaaagggttacaaacggggtaaacgtaaacccgaaacggttacgtacggggtactaaccgttccgtaaaccnccttaacgttcgtaccggtttaccc

SEQ ID NO: 206301 - DNA, 717 bp, Homo sapiens
  misc_feature: GYAE6OF01EG07H.17.25.C03.1.454.CMB.1.raw
  modified_base (282)..(282): a, c, t, g, unknown or other
  misc_feature (282)..(282): n is a, c, g, or t
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatccctccctgtctgcctcgtggtgggggtcagagtcaccatcacttgccggacaagtcacggtacgttaaaacctatttaaattggtatcagcaagaaaccgtaggaaaacnccccaagtaccctcctgatcgtcgtggtcgctactcccacttcgtaggacggtaaaggtcgggtcccgttacccgtaagtccgggtaacgggtttaccgaagggttcggggaccctagggttacgggaacgttccgggtaggggaacctaagggttacttttaacaaacgtttcctacctaacctaacttacccaaccctaaccgttacctacggtaccctaaaccgttgggtaacggttacgtttggtacgtaactaacttaccttaacttacgtacgtacaaacgtaacgttaacgttaacctccgttaccccgttacgtaccgttacggtttaccggaccggtaacggggtaacctaaagttacgaacgtaactaaacgaaaccggtaacgtcggtacggacgtacgacctaaccgtcttccgtgttacccg

SEQ ID NO: 206302 - DNA, 617 bp, Homo sapiens
  misc_feature: GYAE6OF01CV7ZI.17.25.C03.1.454.CMB.1.raw
  modified_base (279)..(279): a, c, t, g, unknown or other
  misc_feature (279)..(279): n is a, c, g, or t
  modified_base (305)..(305): a, c, t, g, unknown or other
  misc_feature (305)..(305): n is a, c, g, or t
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatcctccctgtctgcctcgtggtgggggtcagagtcaccatcacttgccggacaagtcacggacgttaaaacctatttaaattggtatcagcaagaaacctaggaaaacnccccagacctcctgatctcgtggtcncatccactcgtgacgaagtcggaccgtcccagtcggaggttcaggtcgcaggtgatcgtgggactagtactttacaattcctacacctactaccaccctaccttctacgaccctaaaccgtggtaaggtactttgtacgtacctaacgttaccttaacgttacttagtaccaaacgtaacgtacgttaccgtacccgtttcccgtccgtacctttacggtttcgggaacccgtacggggtaacctaaaggttcgaacgtactaacgtaaacgtacgtcggtggtacctagacccaccgtattccgtgttacc

SEQ ID NO: 206303 - DNA, 665 bp, Homo sapiens
  misc_feature: GYAE6OF01B0V5T.17.25.C03.1.454.CMB.1.raw
  modified_base (607)..(607): a, c, t, g, unknown or other
  misc_feature (607)..(607): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagaagccgtggggcctcagtgaaggtctccgtgcaaggcttcgtggattctacgtttacctctatagtatcaatgggtgcgccaggccgctggacacgcctgagtggatgggatgggaccgtaaaccctaagacgttggtcgtcaacgtaggttcgtccttccgacccctacgtcccgtacccgggacaacggtacctttaccagttcgaaccctacgaacctcctaccaataaaccacacgtaccctaacgagtcgggaagtttcggaagggtaaccgtcccttaggaactacgttaccgacgaacccggaaccgtacccggggtacccgttacttaacgtttacggtgtacggaccggtaagtaccggttaccaaccggtaacggtactccccgggggtanaaccggtccccgttaacgggcgacgggtcccggttcctttgggaccttttcccggggg

SEQ ID NO: 206304 - DNA, 575 bp, Homo sapiens
  misc_feature: GYAE6OF01DRPG9.17.25.C03.1.454.CMB.1.raw
  modified_base (400)..(400): a, c, t, g, unknown or other
  misc_feature (400)..(400): n is a, c, g, or t
  modified_base (404)..(404): a, c, t, g, unknown or other
  misc_feature (404)..(404): n is a, c, g, or t
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctggtgggggtcagagtcaccatcacttgccggacaagtcacggacgttaaaacctatttaaattggtatcagcaagaaacctggaaaacgccccagacctcctgatctctggtcgcatccactctgcgaagtcggcgtccatcgagttcagtgcagtggatcgtgggacagtatttcaatctacaccatccaccactctgacaactgagtnttgngcaatctactactgtacaacagtacgttacaacgtttcccctcgtacttacggttttcggaccgtaaaggggtaaccctaaaaggtttcgaacggtaaacttaaccgaaaaaccggtaacttcgggtacggtaccttacggaccctaaccctaacttccgttcgtttaccc

SEQ ID NO: 206305 - DNA, 674 bp, Homo sapiens
  misc_feature: GYAE6OF01A9U9K.17.25.C03.1.454.CMB.1.raw
  modified_base (455)..(455): a, c, t, g, unknown or other
  misc_feature (455)..(455): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaacgtgggtgcgccaggccgcgtggacaacgacctggacgtggactgggatggggacgaaacccgtaacgacgttggtcgtacaacgtagttcgtcctttccacccctagtcccgtaccggggacacggtaaccttaacccgattcgaaccctacgtaaccttccctaccgaaattaaaacccncaacgtacccttaacgaagttcgggtaagtttcggaaggtacgcccgttaggaacctagttccgtaggaacccgtaaccgacccgggtccttacgttaatttaccgtggtacgaccggtaagtaccgtaccccgaaggtaccgttcccgggtagaccgcccgttaaccgggctaccgggtccggttacccttttaggacccgtttcgggtacccggggg

SEQ ID NO: 206306 - DNA, 523 bp, Homo sapiens
  misc_feature: GYAE6OF01ES0BP.17.25.C03.1.454.CMB.1.raw
  modified_base (331)..(331): a, c, t, g, unknown or other
  misc_feature (331)..(331): n is a, c, g, or t
  modified_base (424)..(424): a, c, t, g, unknown or other
  misc_feature (424)..(424): n is a, c, g, or t
  modified_base (485)..(485): a, c, t, g, unknown or other
  misc_feature (485)..(485): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagaagcctggggcctcagtgaaggtctcctgcaaggcttctggattcacgtttacctcctatagtatcaactgggtgcgccaggccgctggacaacgacctgagtggatgggatgggcaaccctaanactggtgtcacagtgtcttcacccatcctcgggacagactaccatgaccacgaactccctacataaaccacagacctacatggagttgagacnccgtgactatctgacgacacggccgtactattactgtcgcgagacgtcccacgctaccggngacgccacgggcagccggtcctttgacttcgtacgggg

SEQ ID NO: 206307 - DNA, 537 bp, Homo sapiens
  misc_feature: GYAE6OF01EMXQG.17.25.C03.1.454.CMB.1.raw
  modified_base (396)..(396): a, c, t, g, unknown or other
  misc_feature (396)..(396): n is a, c, g, or t
  modified_base (406)..(406): a, c, t, g, unknown or other
  misc_feature (406)..(406): n is a, c, g, or t
  modified_base (414)..(414): a, c, t, g, unknown or other
  misc_feature (414)..(414): n is a, c, g, or t
  modified_base (427)..(427): a, c, t, g, unknown or other
  misc_feature (427)..(427): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacggacctgagtggatgggatgggcgaaccctaacacgtggtgtcacgagtgtcttcacccatcccgtcgggacagaccttacatcgaccacgactccncaactaaacncagcctanatggagttgaggngccgtgacatctgacgacacgggtcctatacttactggtagcgagtcgtccccaggactccgggtgacggcccgtaggcacgcggtaccttttgccgttcggtaccgggg

SEQ ID NO: 206308 - DNA, 535 bp, Homo sapiens
  misc_feature: GYAE6OF01AZAUS.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatcgacccacgaacctcctccaataaaccacagcctaacatggagttgaggacgcctgacatctgaccgacacggcctctattactgtgcgagacgtcccacgtcgtccgggtgcgcccgtacgggctacggccggtcctttggaccttcggtcggggg

SEQ ID NO: 206309 - DNA, 605 bp, Homo sapiens
  misc_feature: GYAE6OF01D6FGB.17.25.C03.1.454.CMB.1.raw
  modified_base (278)..(278): a, c, t, g, unknown or other
  misc_feature (278)..(278): n is a, c, g, or t
  modified_base (413)..(413): a, c, t, g, unknown or other
  misc_feature (413)..(413): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagctggggcctcagtgaaggtctcctgcaaggcttctggattcacgtttacctcctatagtatcaactgggtncgcaggccgctggacaacgcctggagtggagtgggatcggggaccaaccctaacgacgtggtcgtcacgaggttgtccttcaccccatcccgtcgggacagtacttaccatcgaccacgactcctaccataaacncagacctacagtaggagttaggagtacgcctaggaactgtactcggaaccgaccgacgggtcccttacttaacgttactggttcggacggtaacgtacccgtacccaacggtacgtacccgggtaggaccgcccggttacggccgtaacggtcccgggttaccttttcggaccgtttccgggtaccgggggg

SEQ ID NO: 206310 - DNA, 729 bp, Homo sapiens
  misc_feature: GYAE6OF01CQCR3.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagagccgtggggcctcagtgaaggtctcctgcaggcttcgtggattcacgtttacctctatagtatcaacgtgggtcgcgccaggcccgcgtaggaccaacgacctggaacggtggagtggggatcggggaccgaaacccgtaacgacgtggtcgtacacgtacgttcgtccttaccaccccgtagttcccgtaccggggaactacggtaaccttaccgagtaccgaacccgtaaccgtaaccttaccctaaccgtaaacttaaacccgaaccgtaacggtacccttaaacgaacgttacgggtaacggtttacgggaacggtaacgtccgtacggaaccgtacgttccggtaacgaaccggtacccgtaaccgggtcccgttacttaacgtttaccgtaggtacggacggtaaccgtaccgtaccccgaacgtaccggttacccgggaggtacccggtacccgttaaccgggcgtacgggtacccggttaccgttttacggacccgtttcgggtacccggggg

SEQ ID NO: 206311 - DNA, 738 bp, Homo sapiens
  misc_feature: GYAE6OF01EPVDO.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaggcttctggattcacgtttacctcctatagtatcaactgggtgcgccaggccgctggacaacgacctggagtggagtgggatggggaccgaaaccctaacgacgtgggtgtccaacgtagtgttccttccaacccctacgttccccgtacccgggggaaccacggtaacctttaacccagttacggaacccctaaccggaaccctttccccgtacccaacttaaaaacccaacccgaaccggaccccttaaaccgtaagttaggggttaaacggtttacgggaacggggtaaccgcccgttaacggaacctaagtccgtaacgggaacccggaacccgaccggggtaccccgttacctttaacgtttaaccgttcggtacggtaccggaacggtaccggtaccccgaaccggtaacggttcccggggtaggacccggtacccgtaccgggccgtacgggtacccggttcccgttttacggtccgtttccgggtaccgggggg

SEQ ID NO: 206312 - DNA, 842 bp, Homo sapiens
  misc_feature: GYAE6OF01A72QR.17.25.C03.1.454.CMB.1.raw
tcagcgtagactagcacgaccggtgctcgatttagtagtgtagatttgggtttgggagtcagtcctcgacgtccaggacacagacatggaacatgagggtcccgtctcctagctccgtggggctcctcgcctactctgggcctccggacgcgtgccagatgtgacgatcccgacgagtcgacccgagtacctccctacgtcccgtcccctgtccctcgcccttcgtggtgggggtcagtacgttcgaccgactccacttcgaccggtactaacgtccacgggtacgttaaaaccgtatttaaacgtcggtaactcccgaagggtacggtaaggaaaaccgttagggaaaacgtccccgaagacccttcctagtactcgtcggtaggtcacctaacctccctaaccctcctaggaccggtaaaggttcggaccgttaccccgaagtccggtaaggtttaccaggtcggacaaggtcggtaactaaccgtgggtaccctacgtatttaccgaacttccgtacctaccctacgtcccgaacccgtaccttcgtaccggaccctaacccggttcgggtaacggttaactttcggtacggtaccgtaaacgttaccgtaacgttaacgttacggtacccgtaaacggtacgggtttaacggtttaacccgtaccggtttacccccggtacgggtacccgttaaccgggttttacccgggacccggtaaccgggggtaaccccttaaacgggttccggtaacggtaccgtaacccgtaaacccggtaccggtacgggtcccggtaccgttaccgggtacccctaacccgtcgttcccgtccgttcccg

SEQ ID NO: 206313 - DNA, 780 bp, Homo sapiens
  misc_feature: GYAE6OF01B9LSF.17.25.C03.1.454.CMB.1.raw
  modified_base (284)..(284): a, c, t, g, unknown or other
  misc_feature (284)..(284): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagccgtggggcctcgagtgaaggtctcctgcaaggcttctggattcacgtttacctctatagtatcaacgtgggtnccgccaggccgcgtcggacaaccgccgtgaggtggagtgggagtcgggaccgaaccctaacgacgtggtcgtcacgtagtcgtcttaccaccctacgtcccgtccggggaactaacgtaaccttaccgagtaccgaaccctaaccgtaacccttaccctaaccctaaactaaaacccaacgaaccggtaacccttaaaccgaacggttacggggtaacggtttacgggaaacgggtaccgtacccgttaggaaccctaagttcccgtaacggaacccggtaacccggtacccggggtaccccgttaaccgtttaacgtttaaccggttacgggtacggtaaccgggtaacggtacccggttacccccgaaacgggttacccggttaccccggggtacggtaacccggtaccccggttaaccggggaccgtaaccggggttacccgggttaccccgtttttacgggtaaccccgttttccggggtaaccccgggggg

SEQ ID NO: 206314 - DNA, 684 bp, Homo sapiens
  misc_feature: GYAE6OF01CTIAG.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagaagccgtggggcctcgagtgaaggtctcctgcaaggcttctggattcacgtttacctcctatagtatcaacgtgggtgcgccaggccgctggacacgcctgagtggatgggatcgggaccaaccgtaacacgtgggtcgtacaacgagttgtccttacaacccctacgttaccgtacccgggacacgtaacctttacccagttaccgaaccctaacggtaacctccctaaccgtaaactaaaccaccaacgtacctaaccgaattacgggtaggtttacggaacgggtacgtacctaggaactacgtactacggaaccggaacccgtaacccgggtccttacgttaacgttacgtacgtacggaccggtaacgtaccggttaccccgaacggtaccgtacccggggtggtaccggtacccgttaacgggccgtacggtacccggttccgtttcggtacccgttcgggtacccgggggg

SEQ ID NO: 206315 - DNA, 586 bp, Homo sapiens
  misc_feature: GYAE6OF01B71BH.17.25.C03.1.454.CMB.1.raw
tcagcgtagactagcacgaccggtgctcgatttagtagtgtagatttgggtttgggggagtcagtctcagtcaggacacagcatggacatgagggtccccgctcagctcctgggctcctgctactctggctccgagctgccagatgtgacatccagatgacccagtctccatcctccctgtctgcctctgtggggtcagagtcaccatcacttgccggacaagtcacggacgttaaaacctatttaaattggtatcagcaagaaaacctggaaaacgccccaagacctcctgatctctggtgcatccactctgcgaagtggcgtcccatcgaggttcagtggcaggtggatcgtgggacagtatttcaatctacaccatccaccactctgacaacctgagtattgtgacaatctactactcgtacaactagtaacgttactaccgtttcccctcgtaccgttacgttttacgggacccgtaacggggaaccttaaaaggttacggaacgtaacgttaacgaaaaaccggtaacgttagggtacggaccgttacgaccctaaccctacgttccgttacggtttaccc

SEQ ID NO: 206316 - DNA, 539 bp, Homo sapiens
  misc_feature: GYAE6OF01E58F6.17.25.C03.1.454.CMB.1.raw
  modified_base (425)..(425): a, c, t, g, unknown or other
  misc_feature (425)..(425): n is a, c, g, or t
  modified_base (440)..(440): a, c, t, g, unknown or other
  misc_feature (440)..(440): n is a, c, g, or t
  modified_base (474)..(474): a, c, t, g, unknown or other
  misc_feature (474)..(474): n is a, c, g, or t
  modified_base (500)..(500): a, c, t, g, unknown or other
  misc_feature (500)..(500): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaaggcttctggattcacgtttacctcctatagtatcaactgggtgcgccaggccgctggacaacgacctgagtggatggggatcgggccgaaacccctaacgacgtgggtcgtcacagtcgtcttccaccccatcccgtccgggacagacttacatcgaccacgacctcctaccaataaacacacgcctanatggagttgacggancctgactatctgaacgacacgggccttctattcngtgcgagacgtcccgagactccgggngcgccgtacggcacggccgtcctttggacttcggcgggg

SEQ ID NO: 206317 - DNA, 541 bp, Homo sapiens
  misc_feature: GYAE6OF01AOK6Y.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatggggacaaccctaacgacgtggtgtcacgagtgtcttcacccatccctcgggacagacttaccatcgaccacgaactcctaccataaacacacgcctacagtggagttgaggagcctgacatcgtgacgacacggtcctctacttactgtgcgagacgtcccgacgtacgtccgggtgaccgcccgtacggcacggccggtccttttggccgtttcggtcgggg

SEQ ID NO: 206318 - DNA, 579 bp, Homo sapiens
  misc_feature: GYAE6OF01CJKSG.17.25.C03.1.454.CMB.1.raw
  modified_base (280)..(280): a, c, t, g, unknown or other
  misc_feature (280)..(280): n is a, c, g, or t
  modified_base (439)..(439): a, c, t, g, unknown or other
  misc_feature (439)..(439): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagaagcctggggcctcagtgaaggtctcctgcaaggcttctggattcacgtttacctctatagtatcaactgggtncgcaggccgctggacacgacctgagtggatgggatcggggacgaaccctaacacgtggtgtcgacagtgtcttccaccactccgtaccgggacacgtaccttaccatcgaccacgaactcctaccaactaaacacacgcctacagtggagttgaggacnccgtagactatcgtggaaccgtaccgaccgggtccgttacttaatttacgtgtacggcgacgtacgtccccgacgtcgtccgggtgacggtcccgtacggccgacggtcccggtactttacggccgtttcggtccggggg

SEQ ID NO: 206319 - DNA, 674 bp, Homo sapiens
  misc_feature: GYAE6OF01DS167.17.25.C03.1.454.CMB.1.raw
  modified_base (330)..(330): a, c, t, g, unknown or other
  misc_feature (330)..(330): n is a, c, g, or t
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatcgacccagtctccactcctccctgtctcgcctcgtggtggggtcagatcaccatcacttgccggaacagtcgacggtacttaaaacttatttaaagttgtatcagacaagaaacctaggaaaaccgccctaagaccctctagacttcctgtggtcactactcccgtattccgnggacgtaacggtcggcccgtaccaagtccggtaggttccgaggtcggcaaggtggacttcggacgggtaactaggtactttacaacttccctacaacctacttaccaaccctacgttccacgtacctaaacgtgtaacggtagttcgacgtaactaacttacctacgttaaccttacgtacctaaacgtacgttaacgttacccgtaccgtttaccccgtacgtaccttacggtttaccggaccggtaaacgggtaacgtaaacggttaggaacgtaacgttaaaccgaaaccggtacgtacggtacgtaccgtacgacctaccgtacttcgttcgtttaaccc

SEQ ID NO: 206320 - DNA, 652 bp, Homo sapiens
  misc_feature: GYAE6OF01DOQQ8.17.25.C03.1.454.CMB.1.raw
  modified_base (281)..(281): a, c, t, g, unknown or other
  misc_feature (281)..(281): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaacgtgggtncgccaggccgctggacaacgacctggagtggatgggatgggacaaccctaacacgtggtgtcacgtagtcgttccttcaaccctatcccgtaccggggactacgaacctttaccatacgaacccacgtaacctccctaccaataaaaccacacgaccctaacagtagggagttggaacgggacgccctagacctattccgtaggaccgaaccgaccgggtcccgttacgttaactttaccgtggtcgaccggtaaggtaccgttacccccgaacggtaccgttacccggggtacggaaccggaccccgtaacgggacccgtaacgggtcccgggttacccgttttacggcccgtttcgggtacccgggggg

SEQ ID NO: 206321 - DNA, 558 bp, Homo sapiens
  misc_feature: GYAE6OF01CJ7ZZ.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagacgccgtgggtcctcggtgagggtctcctgcaaggcttcgtggaggctaccttcagcgactatagtttcaagttggtgcgacggcctcgtggacaaggccttgagtggagtgggagatcgtcctagtcgtgacacaccaaactacgcacagaacgttccgaggcagactcaccataaccgcgaacaaataacgaacaacaagttaatactaggaagcgtagaaacagcctagtacatactagaggaacgacgggtcttacctattctgtgacgaagagttaatactaataactactgtactttaccttttacctacccttccgttcgtacttcggtacggtccagttacccgg

SEQ ID NO: 206322 - DNA, 551 bp, Homo sapiens
  misc_feature: GYAE6OF01DHU19.17.25.C03.1.454.CMB.1.raw
  modified_base (497)..(497): a, c, t, g, unknown or other
  misc_feature (497)..(497): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaggtctcctgcaggcttctggattcacgtttacctcctatagtatcaactgggtgcgccaggccgctggacaacgcctgagtggatgggatgggcgaaccctaacactggtgtcacgagtgtccttccaccactccgtccgggacagaccttaccatcgaccacgaacctcctaccaataaacacagacctaacatggagttgaggacgccgtgacatcgtgacgacaccggtcctactattactgtcgacgagacgtcccaacgtcgtccggnggaccgcccgtacgggcctacggccggttacctttcggtccgttcggtccgggg

SEQ ID NO: 206323 - DNA, 823 bp, Homo sapiens
  misc_feature: GYAE6OF01CDI4I.17.25.C03.1.454.CMB.1.raw
  modified_base (281)..(281): a, c, t, g, unknown or other
  misc_feature (281)..(281): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagccgtggggctcgagtgaaggtctcctgcaaggcttctggattcacgttttacctctatagtatcaactgggtncgccaggccgctggacaacgcctgagtggatggggatcgggaccgaaacccgtaacgaccgttgggtcgtacaacgtaaggttcggttaccctttccaacccctacgttcccccgtacccggggggtaaacctaacggtaaacccttttaaccccaagttaccgggaacccctaaaccgggaaaccctttaccccgtaacccctaaacgtaaaaaacccaacccctaacggtacccccttaaacctaagttacgggggaaaacggtttttacggaaacggggtaaccgtaccccgttaagggtaacctaacgttacccgttaaggaaaccccgggttaaccgaaaccccgggggtccccgtttaaccttaaccgtttttaaccggtacgggttacggacccggtaaagggtaacccgttaccccccgaaacgggtaaccgtttccccggggtacggtaaacccggtccccgtaaccgggtaccgaccgggtacccgggttacccgtttttcccgaacccggtttccgggttacccggggggg

SEQ ID NO: 206324 - DNA, 551 bp, Homo sapiens
  misc_feature: GYAE6OF01BY8ME.17.25.C03.1.454.CMB.1.raw
  modified_base (410)..(410): a, c, t, g, unknown or other
  misc_feature (410)..(410): n is a, c, g, or t
  modified_base (421)..(421): a, c, t, g, unknown or other
  misc_feature (421)..(421): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcaaccctaacacgtggtgtcacgagtgtcttcacccatcctacgggacagtacttaccatcgaccacgaactcctacaataacacagcanatgagtgagancctgacatctcgaacgacgacggtccgttacttaacttacgtgtcgacggaagtcgtaccccgaagtacgtccgggtagacggcccgtacggcgacggccggtaccttttcggaccgtttcggtacgggg

SEQ ID NO: 206325 - DNA, 541 bp, Homo sapiens
  misc_feature: GYAE6OF01AJNUF.17.25.C03.1.454.CMB.1.raw
  modified_base (492)..(492): a, c, t, g, unknown or other
  misc_feature (492)..(492): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtacccactcccaggtgcagctggtgcagtctggggctgaggtgaagaagcctggggcctcagtgaaggtctcctgcaaggcttctggattcacgtttaccctcctatagtatcaactggggtgcgccaggccgctggacaacgacctgagtggatgggatgggcgaaccctaacactggtgtcacagtgtcttcacccatcccgtcgggacacgacttaccatcgaccacgaacctcctaccataaacacagcctacatggagttgaggacgcctgacatctgaccgacaccggtcctactacttactgtcgcgagcgtcccagacgtccggngacgtcccgacggcacggtccggtcctttaggaccttcggcggggaccg

SEQ ID NO: 206326 - DNA, 556 bp, Homo sapiens
  misc_feature: GYAE6OF01DMS4Q.17.25.C03.1.454.CMB.1.raw
  modified_base (292)..(292): a, c, t, g, unknown or other
  misc_feature (292)..(292): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaacgtgggtgcgccaggccgntggaacacgacctgagtggatgggatgggaccaaccctaacgactggtgtcacagtgtcttcacccatcccgtccgggacagaccttacatacgaccacgaacctcctaccataaacacacgacctaacagtggagttcgaggcgcctgaccatcgtagaccgacgacggtccgttactattactgtacgcgacgtacgtccccgaggacgtccgggtagacggcccgtacggcgtacggcgtcctttgacgttcggtacgggg

SEQ ID NO: 206327 - DNA, 594 bp, Homo sapiens
  misc_feature: GYAE6OF01DE85I.17.25.C03.1.454.CMB.1.raw
  modified_base (249)..(249): a, c, t, g, unknown or other
  misc_feature (249)..(249): n is a, c, g, or t
  modified_base (283)..(283): a, c, t, g, unknown or other
  misc_feature (283)..(283): n is a, c, g, or t
  modified_base (487)..(487): a, c, t, g, unknown or other
  misc_feature (487)..(487): n is a, c, g, or t
  modified_base (514)..(514): a, c, t, g, unknown or other
  misc_feature (514)..(514): n is a, c, g, or t
  modified_base (546)..(546): a, c, t, g, unknown or other
  misc_feature (546)..(546): n is a, c, g, or t
tcagcgtagactagcacgaccggtgctcgatttagtagtgtagatttgggtttggggacgtcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagccgtggggcctcgagtgaaggtctctgcaggctctggnttcacgtttacctcctatagtatcaacgtgggtnccgccgaggccgcgtacggaacaacgtacctggagtggagtgggagtcggggaccgaaacccctaaacgacgtggtacgtacaacgtaggttctcctttaccacccctacgtcccgtaccggggactaacggtaccttaacactacgacccaacgtaacctccctaacaataaaccacacgactacagtcggtagttggaagcnctagacagtctacgacgacgcggtctntacttctgtgcgagccgtccgagtacgtcggngaacgccgtacggactcggaccgttcctttacggcgtttcggacgggg

SEQ ID NO: 206328 - DNA, 592 bp, Homo sapiens
  misc_feature: GYAE6OF01DIIV6.17.25.C03.1.454.CMB.1.raw
  modified_base (220)..(220): a, c, t, g, unknown or other
  misc_feature (220)..(220): n is a, c, g, or t
  modified_base (284)..(284): a, c, t, g, unknown or other
  misc_feature (284)..(284): n is a, c, g, or t
  modified_base (294)..(294): a, c, t, g, unknown or other
  misc_feature (294)..(294): n is a, c, g, or t
  modified_base (463)..(463): a, c, t, g, unknown or other
  misc_feature (463)..(463): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagaagcctggggcctnagtgaaggtctcctgcaaggcttcgtggattcacgttttacctcctaatagtatcaactgggtncgccaggccntgacaacgacctgagtggatggggatcggggcgtaaaccctaacgactcgggtgtacacaggttgtccttacacccatcccgttccggggaactacggaactttaccagtcggaacctaacgaacctccaccaataaaccacacgacctatagtggacgttggaggacncctagaactatcgtagaaccgaacgaccgggtcccgttactaactttcgacgtggaccggagtacgtacccaaggtacgttccggagacgccgtacggcgacggtcgtcttcgacgttcggtaccgggg

SEQ ID NO: 206329 - DNA, 714 bp, Homo sapiens
  misc_feature: GYAE6OF01AEINQ.17.25.C03.1.454.CMB.1.raw
  modified_base (286)..(286): a, c, t, g, unknown or other
  misc_feature (286)..(286): n is a, c, g, or t
tcagcgtagactagcacgaccggtgctcgatttagtagtgtagatttgggtttggggtacgtcaacaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagaagcctggggcctcagtgaaggtctcctgcaaggcttcgtggattcgacgtttacctcctatagtatcgaactgggtncgcaggccgctggacacgacctggagtggatgggatggggaccaaccctaacgacgtggtgtccacgtagtgtccgttaccaccccgtagttcccgtacccgggggaactaaccggtaacctttacccgaaacgttccggaaccctacccggtaaaccttccccttaaccaaacgttaaaacccaccgtacgaccccttaacgaacgttggggtaaacgtttcgggaaacgggtacgtacccgtacggaactacttaccggtgaacccggacccgtaacccggggtcccgttaacgttactttaaccggtgtacccggagtagacccgtaccgtaaccgtaggttccccgggttagaccggtccccggttaaacgggcctaccggggttaccggtcccttttcgggaaccgtttcgggaaccgggggg

SEQ ID NO: 206330 - DNA, 579 bp, Homo sapiens
  misc_feature: GYAE6OF01CHSSZ.17.25.C03.1.454.CMB.1.raw
  modified_base (276)..(276): a, c, t, g, unknown or other
  misc_feature (276)..(276): n is a, c, g, or t
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggcgttaaaacctatttaaattggtatcagcaagaaacctggaaaancccagacctctgatctctggtgcatccactctgcgaagtggcgtccatcgagttcagtggcagtggatcgtgggacagtatttcaaatctacaccatacaccactctcgacaacctgaaggtactttgtacgactaattcttaacttactacgttaccaaactagtaacgtttaccacgtttcccccttgtacccttacgttttcgggaccgtaacggggtaaccaaaagggtttgaacgtactaacgaaaacggtaaccgttggtacggccttacggacctaaccacttccgttcggttacc

SEQ ID NO: 206331 - DNA, 550 bp, Homo sapiens
  misc_feature: GYAE6OF01BLPME.17.25.C03.1.454.CMB.1.raw
  modified_base (280)..(280): a, c, t, g, unknown or other
  misc_feature (280)..(280): n is a, c, g, or t
  modified_base (423)..(423): a, c, t, g, unknown or other
  misc_feature (423)..(423): n is a, c, g, or t
  modified_base (436)..(436): a, c, t, g, unknown or other
  misc_feature (436)..(436): n is a, c, g, or t
  modified_base (444)..(444): a, c, t, g, unknown or other
  misc_feature (444)..(444): n is a, c, g, or t
  modified_base (473)..(473): a, c, t, g, unknown or other
  misc_feature (473)..(473): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcgagtgaaggtctcctgcaaggcttctggattcacgtttacctctatagtatcaactgggtncgccaggccgctggacaacgcctgagtggatgggatgggacgaaccctaacacgtggtgtcagagtgtcttcaccctatcccgtccgggacacgtacttaccatcgacccaacgtaacctcctaccaataaacacacgcctanatgggatgaggancctgactntcgtacgacgacacgggtcctctattacngtgcgagcgtacccaggtctccgggtgaccgccgtacggacgtacggtccggtacctttcgccgttcggtacggggg

SEQ ID NO: 206332 - DNA, 561 bp, Homo sapiens
  misc_feature: GYAE6OF01BZWI3.17.25.C03.1.454.CMB.1.raw
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggacgttaaaacctatttaaattggtatcagcagaaacctggaaaagccccagacctcctgatctctggtgcatccactctgcgaagtggctcccatcgaggttcaggtggcagtggatcgtgggacagtatttcaattcctcaccatcaccactctgcaactgagtattgtgcaatctactactgtacaacagtacgttactacgttcccctcgtcctacgttttcgggacccgtaacggggtaacctaaaggttacggaagtaacttaaccaaaaccggtaaccgttacgggttcggacttacggacctaaccctacttccgttgtttaccc

SEQ ID NO: 206333 - DNA, 536 bp, Homo sapiens
  misc_feature: GYAE6OF01CAPD0.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacgactggtgtcacagtgtcttcacccatccctccgggacagacttaccatcgaccacgaacctcctaccaataaacacagcctacatggagttgaggagcctagacatctgacgacacggtcctctattactgtcgcgagacgtcccacggctccgggtgcgcccgtaggccgacggccggtctttcggacctttcggtccggggg

SEQ ID NO: 206334 - DNA, 526 bp, Homo sapiens
  misc_feature: GYAE6OF01BKYVV.17.25.C03.1.454.CMB.1.raw
  modified_base (281)..(281): a, c, t, g, unknown or other
  misc_feature (281)..(281): n is a, c, g, or t
  modified_base (334)..(334): a, c, t, g, unknown or other
  misc_feature (334)..(334): n is a, c, g, or t
  modified_base (403)..(403): a, c, t, g, unknown or other
  misc_feature (403)..(403): n is a, c, g, or t
  modified_base (411)..(411): a, c, t, g, unknown or other
  misc_feature (411)..(411): n is a, c, g, or t
  modified_base (424)..(424): a, c, t, g, unknown or other
  misc_feature (424)..(424): n is a, c, g, or t
  modified_base (448)..(448): a, c, t, g, unknown or other
  misc_feature (448)..(448): n is a, c, g, or t
  modified_base (461)..(461): a, c, t, g, unknown or other
  misc_feature (461)..(461): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctccgtatagtatcaactgggtncgccaggccgctggacaacggacctgagtggatgggatgggacgaaccctaanactggtgtcacagtgtcttcacccatcctcgggacagacttaccatgaccacgaactcctccataaacncagcctanatggagttgagancctgacatctgacgacacggcctntatactgtgcganacgtcccacgctccgggtgacgcccgtacggcacgtccggtacctttcggcctttggtccggggg

SEQ ID NO: 206335 - DNA, 606 bp, Homo sapiens
  misc_feature: GYAE6OF01ANOSI.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctccgtgcaaggcttctggacttcacgtttacctcctatagtatcaactgggtgcgccgaggccgctggacaacggacctggagtggatggggatggggaccaacccctaacacgtggtgtcacgagttcgtccttaccaccccatcccgtccggggacacgtacttaccatacgaccacgaacctcctaccaactaaaccacacgcctaacatagggtagttagacggacgcctagacagtcgtgaaccgacgacgggtccgttactacttactggtagagacgtaccgtaccccgaggtacgtcccgggtagaccggtcccgtaacgggccgtacgggaccggttacccgttttacggaccgtttcgggtcggggg

SEQ ID NO: 206336 - DNA, 647 bp, Homo sapiens
  misc_feature: GYAE6OF01BNML9.17.25.C03.1.454.CMB.1.raw
  modified_base (224)..(224): a, c, t, g, unknown or other
  misc_feature (224)..(224): n is a, c, g, or t
  modified_base (281)..(281): a, c, t, g, unknown or other
  misc_feature (281)..(281): n is a, c, g, or t
  modified_base (304)..(304): a, c, t, g, unknown or other
  misc_feature (304)..(304): n is a, c, g, or t
tcagcgtagactagcacgaccggtgctcgatttagtagtgtagatttgggtttgggagtcagtctcagtcaggacacagcatggacatgagggtccccgctcagctccgtggggctcctgctactctggctccgagctgccagatgtgacatccagatcgacccagtcctccatcctccctgtctgcctcgtggtggggtcagagtcaccatcacttgaccganaagtcacggtacgttaaaactatttaaatggtatcagacaagaaacctaggaaaacncccagacctctagatctctggtnaccactaccactcgtcgacgaagtcggcctaccagtcggtaggttcaggtgcagtgatcgtggactagtatttacaatctacacataccactactctacgactaaccgtggtacggtattgtacgactaaacgttccttaaccgtacttacgtaactaaacgtaacgttaacgtttaaccgtaacccgtttcccccgtacgtaccgtttaacccggtttacgggaacccggaacggggtaaacccttaaaaggttacgaaacgtaacgtaaaccgaaacggttaacgttcgggaacggttccgtacggaacccttaaccgacgtttacccgttgtttaacccg

SEQ ID NO: 206337 - DNA, 622 bp, Homo sapiens
  misc_feature: GYAE6OF01EKZKH.17.25.C03.1.454.CMB.1.raw
  modified_base (224)..(224): a, c, t, g, unknown or other
  misc_feature (224)..(224): n is a, c, g, or t
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctcgcctcgtggtgggggtcagagtcaccatcacttgccganagtcacggtacgttaaaacctatttaaattggtatcagcaagaaactaggaaacgccccagacctcctagatctcgtggtcgcactccactcgtagacgaaggtcggaccgtcccagtcggtaggttcaggtcggacaggtggatcgtagggacagtatttacaatctacacctataccaccactcgtacgacctaaccgtgtaaggtatttggtacgtactaacttccttaacttacttacgtaccaacgtacgtaacgtttacctaccgtttcccctacgtaccttacgtttacgggaccggtaacggggtaacctaaaggttcgaacgtaacgtaacgaaaacgtacgttacggtacggtaccgttacgacctaacctacttccgttcgttaccc

SEQ ID NO: 206338 - DNA, 623 bp, Homo sapiens
  misc_feature: GYAE6OF01AKUJ8.17.25.C03.1.454.CMB.1.raw
  modified_base (433)..(433): a, c, t, g, unknown or other
  misc_feature (433)..(433): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaaggtcttcgtggtattctacgtttacctcctatagtatcaactgggtgcgccaggccgctggacaacgacctgagtggagtgggatgggaccgaaccctaacacgtggtcgtacacgtagtgtccttcaccctatcccgtaccgggacagtaccttaccatcgacccacgtacctcctacaataaacacacgtcctanagtagggtattgaacgacgtccctaggaaccagtcgtacgaaccggaccgaccgggtcccgttacttacttacgtgtacgaccggtagtaccgtaccccgtaggtaccgtacccgggtacgaccggtccccgtacgggccgtaacgggcccggttacccgtttacggtaccgttcggggtaacccggggg

SEQ ID NO: 206339 - DNA, 698 bp, Homo sapiens
  misc_feature: GYAE6OF01DT6GO.17.25.C03.1.454.CMB.1.raw
  modified_base (280)..(280): a, c, t, g, unknown or other
  misc_feature (280)..(280): n is a, c, g, or t
  modified_base (335)..(335): a, c, t, g, unknown or other
  misc_feature (335)..(335): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacaacgacctgagtggagtgggatgggaccgaaccctaacncgtggtcgtcacagtcgtcttcaccctatcccgtaccggggacacggtacctttaacccagttaccgaacccgaacgtaaccctccctaaccctaactaaaaccaccaacgtaccctaacgtagtacgggtaagtttacggacgggacgtcccgttagaacctacgttcgtacggaaccgaaccgaccgggtcccgttacttactttaacgtcggtacgtaccggacggtaccggttacccccaacgggtaccgttaccccggggttaggaaccggtaccccggtttaaacccgggccggtaaccgggtacccgggttccccgtttttacgggacccgtttttcccggggtaacccggggggg

SEQ ID NO: 206340 - DNA, 688 bp, Homo sapiens
  misc_feature: GYAE6OF01C0XRA.17.25.C03.1.454.CMB.1.raw
  modified_base (279)..(279): a, c, t, g, unknown or other
  misc_feature (279)..(279): n is a, c, g, or t
  modified_base (320)..(320): a, c, t, g, unknown or other
  misc_feature (320)..(320): n is a, c, g, or t
tcagcgtagactagcacgaccggtgctcgatttagtagtgtagatttgggtttgggagtcagtctcagtcaggacacagcatggacatgagggtccccgctcagctcctggggctcctgctaatctggctccgagctgccagatgtgacatccagatgacccagtctccatcctccctgtctgcctcgtggtggggtcagagtcaccatcacttgccggacaagtcacggacgttaaaacctatttaaattggtatcagcaagaaacctaggaaaaccncccagtacctcctgacttctcgtggtcgctactccactcgngacgaaggtcggcctacccagtccggtaggtttcaggtggcaggtggacttcggtagggaactagttatttaccaaattcctacacctactaccaccctaacttcctacgaccctaaccgtggtaagtacgtttagtacgtaacctaaacttaccgtaacctttacgtacgttaaccgtaaacgtaacgttaaccgtttaaccgtacccgtttccccgttacgttacccgtttaccggttttaccgggaaccggtaaacggggtaaacctaaagggttcggaaacgtaaaccgtaaccgtaaaacggtaaccggttacgggttaccggacgttacgaaccgtaccttaacgttccgttcgtttacccg

SEQ ID NO: 206341 - DNA, 546 bp, Homo sapiens
  misc_feature: GYAE6OF01EDEMB.17.25.C03.1.454.CMB.1.raw
  modified_base (280)..(280): a, c, t, g, unknown or other
  misc_feature (280)..(280): n is a, c, g, or t
  modified_base (329)..(329): a, c, t, g, unknown or other
  misc_feature (329)..(329): n is a, c, g, or t
  modified_base (336)..(336): a, c, t, g, unknown or other
  misc_feature (336)..(336): n is a, c, g, or t
  modified_base (358)..(358): a, c, t, g, unknown or other
  misc_feature (358)..(358): n is a, c, g, or t
  modified_base (405)..(405): a, c, t, g, unknown or other
  misc_feature (405)..(405): n is a, c, g, or t
  modified_base (458)..(458): a, c, t, g, unknown or other
  misc_feature (458)..(458): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacaacgcctgagtggatgggatgggcaaccctaanacgtggntcacagtgtcttcacccatccnccggggacagacttaccatcgaccacgaacctcctccaataaaccanacgcctaacatggagttgaggagccctgacatctgacgaccgacggtcccttnttaacttactggtgacgagacgtcccgacgtacgtaccgggtgacgcccgtacggcacggccggtcctttggaccgttggtacggggg

SEQ ID NO: 206342 - DNA, 556 bp, Homo sapiens
  misc_feature: GYAE6OF01B28RR.17.25.C03.1.454.CMB.1.raw
  modified_base (408)..(408): a, c, t, g, unknown or other
  misc_feature (408)..(408): n is a, c, g, or t
  modified_base (455)..(455): a, c, t, g, unknown or other
  misc_feature (455)..(455): n is a, c, g, or t
  modified_base (475)..(475): a, c, t, g, unknown or other
  misc_feature (475)..(475): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctgggctgaggtgaagaagcctggggcctcagtgaaggtctcctgcaaggcttctggattcacgtttacctcctatagtatccaactgggtgcgccaggccgctggacacgacctgagtggatgggatgggcgaaccctaacacgtggtgtcacagtcgtcttcacccatccgtcgggacagacttaccatcgacccacgaacctcctaccaataaaccncacgcctaacagtggtaagttggacggagcctgacatcgtgacgacnccggtccttactacttacgngtgaccgaggacctacccgaaggtctccgggagaccgccgtacgggcacggccggttacctttgcccgtttcggtccgggg

SEQ ID NO: 206343 - DNA, 623 bp, Homo sapiens
  misc_feature: GYAE6OF01CR2JM.17.25.C03.1.454.CMB.1.raw
  modified_base (278)..(278): a, c, t, g, unknown or other
  misc_feature (278)..(278): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagaagcctggggcctcagtgaaggtctcctgcaggcttctggattcacgtttactcctatagtatcaactggtncgccaggccgctggacacgacctgagtggatgggatgggaccaaccctaagaccgtggtcgtcaacgaggttcgtccttaccaccctatcccgtaccggggacacggtacctttacccattcgaacccacgaacctccctaccaactaaaccacacgaccctaacagtcgggagttggaggacgtcccgtagaccagttcgtacggaccgaaccgaccggggtccgttacttacttaaccgtgtacgcggtacggaccggtccccaacggtacgttcccgggtagaccgtcccgtaacgggcctacgggcccggttcctttacggaccgtttccggtaccggggg

SEQ ID NO: 206344 - DNA, 588 bp, Homo sapiens
  misc_feature: GYAE6OF01D1FHB.17.25.C03.1.454.CMB.1.raw
  modified_base (301)..(301): a, c, t, g, unknown or other
  misc_feature (301)..(301): n is a, c, g, or t
  modified_base (340)..(340): a, c, t, g, unknown or other
  misc_feature (340)..(340): n is a, c, g, or t
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtcctccatccctcctgtctgcctctggtggggtcagagtcaccatcacttgccggacaagtcacggtacttaaaactatttaaattgtatcagacaagaaacctaggaaaacgcccagacctctagactctctggtncactccactctgcgtaagtcggccgtccatcgaggttcnggtgcaggtgatcgtagggacagtactttacaacttcctacaacctataccaaccctactctacgaacctaaccgtggagtattgagtactaacttactactacttagtaccaacgtacgttaacgttaccgtaccgtttcccctagtacccttacggtttcggaccgtaacggggaacctaaagttagaacgtactaaccgtaaaacgtacgttgtacggctacgtaccactacttcgtcgttaccc

SEQ ID NO: 206345 - DNA, 524 bp, Homo sapiens
  misc_feature: GYAE6OF01C6Y8P.17.25.C03.1.454.CMB.1.raw
  modified_base (290)..(290): a, c, t, g, unknown or other
  misc_feature (290)..(290): n is a, c, g, or t
  modified_base (358)..(358): a, c, t, g, unknown or other
  misc_feature (358)..(358): n is a, c, g, or t
  modified_base (411)..(411): a, c, t, g, unknown or other
  misc_feature (411)..(411): n is a, c, g, or t
  modified_base (459)..(459): a, c, t, g, unknown or other
  misc_feature (459)..(459): n is a, c, g, or t
  modified_base (484)..(484): a, c, t, g, unknown or other
  misc_feature (484)..(484): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccnctggacacgacctgagtggatgggatgggacgaaccctaacactggtgtcacagtgtcttcaaccctntccctcgggacagacttaccatcgaccacgactcctacataaacacagcctanatggagttgaggagcctgacatctagacgacacggccgtactattacngtgcgagacgtcccagacgtccggngacgccgtacggctagccgtcctttgccgttggtacgggg

SEQ ID NO: 206346 - DNA, 544 bp, Homo sapiens
  misc_feature: GYAE6OF01BL0BN.17.25.C03.1.454.CMB.1.raw
  modified_base (501)..(501): a, c, t, g, unknown or other
  misc_feature (501)..(501): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggacgaaccctaacacgtggtgtcacagtgtcttcacccatccgtccggacagtacttaccatcgaccacgaacctcctaccaataaaccacacgcctaacagtggagttgaggacgcctagacatctagacgacgaccggccgtcttacttcgtgtcgcgagacgtacccgagtcgtccggngacgcccgtacggctacggcggtcctttgaccttcggccgggg

SEQ ID NO: 206347 - DNA, 585 bp, Homo sapiens
  misc_feature: GYAE6OF01C3RX8.17.25.C03.1.454.CMB.1.raw
  modified_base (280)..(280): a, c, t, g, unknown or other
  misc_feature (280)..(280): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacaacgacctgagtggatgggatgggaccgaaaccctaacacgtggtcgtacacagtgtcttcacccactccgtcgggacagaccttacatcgaccacgaactcctacaataaacacacgacctaactatcgggattaggaggacgcctagacatcgtagaccgaccacggccgttactagtttactggtcgcggacgaccgtccccgtaacggtaccgtccgggtacgaccggtcccgtaacgggcccgtacgggccgttccctttacggccgtttccgggtaccggggg

SEQ ID NO: 206348 - DNA, 737 bp, Homo sapiens
  misc_feature: GYAE6OF01DW6VR.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctgaggtgaagagccgtgggcctcgagtgaaggtctcctgcaaggtcttcgtggattctacgtttacctctatagtatcaacgtgggtcgcgtccgaggtcccgcgtaggaaccaacgtaccgtggacggtggagtgggagtcgggaccgaaaccctaacgacgtggtacgtactaacgtagttacgtccttaccgaaccccgtaacgtcccggtacccggggaactaacggtaaccttaccgacgttacgaaccctaaccgtaacccttccctaacctaaactaaaaccacgtaaccgtaccttaactaaggttacgggtaagttacggaacggtacgtaccgttacggaaccttaacgtaccgtacggaaccgacccggtaacccgggtaccgttaccttaacgtttacgtggtaccggacggtaacggtacccgtaccccgtaacggtaccgttccgggtacggtacccggtacccggtacgggacccgtaacgggtcccggtttacccgtttacgggtcccgttcgggtacccgggggg

SEQ ID NO: 206349 - DNA, 641 bp, Homo sapiens
  misc_feature: GYAE6OF01EIK8D.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttgggtggcagcagctacaagtgcccactcccaggtgcagctggtgcagtcgtggggctgaggtgaagaagcctggggcctcagtgaaggtctcctgcaaggcttctggattcacgtttacctctatagtatcaacgtgggtgccgcaggccgctggacaacgcctggagtggagtgggatgggaccaaaccctaacgacgtggtgtcacgtagtcgttccttaccacccctatcccgtccgggacacgtacttaaccattacgaaccaaccgtaacctccctaccaactaaaccaccacgacccttaacacgtagggtacgttacggagggtacgtccgtagaacctagtcgtaggaaccgaccgaccgggtcccgttacgttaacttacgtggtacgacggtaaggtaccgttaccccgaacggtacgtcccgggtagaccggacccggtacggacgtaccgggtccggttacctttcggcccgtttgggtacccggggg

SEQ ID NO: 206350 - DNA, 566 bp, Homo sapiens
  misc_feature: GYAE6OF01EK62U.17.25.C03.1.454.CMB.1.raw
  modified_base (279)..(279): a, c, t, g, unknown or other
  misc_feature (279)..(279): n is a, c, g, or t
  modified_base (290)..(290): a, c, t, g, unknown or other
  misc_feature (290)..(290): n is a, c, g, or t
  modified_base (415)..(415): a, c, t, g, unknown or other
  misc_feature (415)..(415): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctgggctgaggtgaagagcctggggcctcagtgaaggtctcctgcaaggcttctggattctacgtttacctcctatagtatcaactgggtncgccaggccgntggacaacgcctgagtggatgggatgggcaaccctaacacgtggtgtcacagtgtcttccacccatccgtccgggacacgtacttaccatcgaccacgtactcctacaataaacacacgcctaanagtaggagttagaggacgcctgacatcagacgtagtaccggtccgttactacttacgtgtcgcgaagtccgtacccgaggtaccgtcgggtgaccggaccgtacgggaccgtacggtcccggttacctttcggaccgttcggtaccggggg

SEQ ID NO: 206351 - DNA, 555 bp, Homo sapiens
  misc_feature: GYAE6OF01C7LL5.17.25.C03.1.454.CMB.1.raw
  modified_base (280)..(280): a, c, t, g, unknown or other
  misc_feature (280)..(280): n is a, c, g, or t
  modified_base (512)..(512): a, c, t, g, unknown or other
  misc_feature (512)..(512): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacacgacctgagtggatgggatggggacaaccctaacacgtggtcgtcacgagtgtcttcacccatccctaccggggacacgacttaccatcgacccacgaacctcctaccaataaacacacgacctaacacgtagggagttggaggacgccttagacatcgtgacgacgacggcctctattacgtgtcgcgagacgtcccaacgtcgtccgggtacncggccgtacggctacggccgtcctttgccgttcggtacggggg

SEQ ID NO: 206352 - DNA, 549 bp, Homo sapiens
  misc_feature: GYAE6OF01EECSB.17.25.C03.1.454.CMB.1.raw
  modified_base (280)..(280): a, c, t, g, unknown or other
  misc_feature (280)..(280): n is a, c, g, or t
  modified_base (426)..(426): a, c, t, g, unknown or other
  misc_feature (426)..(426): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacaacggacctgagtggagtgggatgggacgaaccctaacactggtgtcacgagtgtcttcaccctatccgtaccgggacacgtacttaccatacgacccacgaacctccctccaataaacacacgacctanatggagttgaggagcctgacatctgacgacacggtccttctattactgtcgcgagacgtacccacgtacgtccgggtagccgaccgtacggctacggccgtcctttggcgttcggtacggggg

SEQ ID NO: 206353 - DNA, 739 bp, Homo sapiens
  misc_feature: GYAE6OF01EUMXU.17.25.C03.1.454.CMB.1.raw
  modified_base (219)..(219): a, c, t, g, unknown or other
  misc_feature (219)..(219): n is a, c, g, or t
tcagcgtagactagcacgaccggtgctcgatttagtagtgtagatttgggttgggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctgaggtgaagagccgtggggcctnagtgagtctctgcagctctggtattctacgtttacctccttaatacgtactctaacgtgggtgccgtaccgacgggcccgtcgtagggaaccaacgggtacctggaggtggaggttgggaagtcgggaaccgtaaccctaaggtacgtcgggtacgtaccagtacggttcgtcctacctaacccgacgttcccgtaccgggacgtaacgtaacccttaacctacgtacggaacccctaacgtaacccttaccctaacccgaaaccttaaaaccgacccgtaacgtaccccttaaacgaacgttcgggtaaaggtttacgggaacggtacgtacccttaggaaccctagttacccgtacgggaacccgaccgtaaccgggtacccggttacttaacgtttaccgtagggttccgaacggttaccgttacggtacccccgtaaggttcgtacccgggtacggaacgtccccggttaacgcgtacgggacgtttcccgtttaggaccgtttccgggacggggg

SEQ ID NO: 206354 - DNA, 560 bp, Homo sapiens
  misc_feature: GYAE6OF01B8DSQ.17.25.C03.1.454.CMB.1.raw
  modified_base (256)..(256): a, c, t, g, unknown or other
  misc_feature (256)..(256): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaggtgtccagtcccaggtccagttggtgcaatctggggctgaggtgaagacgcctgggtcctcggtgagggtctcctgcaaggcttctggaggcaccttnagcgactatagtttcaattgggtgcggacgggcctcgtggacaaggccttggaggtggagtgggaaggatcggtccctagtcgttgacactacaaactcgcacagaacgttcgagggcagactcaaccgactaaccgacggaactaaactaacgaacacaagttaatcgtaggagactagaacacgacctgtactatcgtagaggacgacggcttactactcgtgtcgacgtaggataatctaatacactgtcttcctttacaccttccttgaccttcgtcggtactacgtcgtacccccgtcg

SEQ ID NO: 206355 - DNA, 523 bp, Homo sapiens
  misc_feature: GYAE6OF01CYII9.17.25.C03.1.454.CMB.1.raw
  modified_base (331)..(331): a, c, t, g, unknown or other
  misc_feature (331)..(331): n is a, c, g, or t
  modified_base (359)..(359): a, c, t, g, unknown or other
  misc_feature (359)..(359): n is a, c, g, or t
  modified_base (414)..(414): a, c, t, g, unknown or other
  misc_feature (414)..(414): n is a, c, g, or t
  modified_base (420)..(421): a, c, t, g, unknown or other
  misc_feature (420)..(421): n is a, c, g, or t
  modified_base (512)..(512): a, c, t, g, unknown or other
  misc_feature (512)..(512): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaaacctggggcctcagtgaaggtctcctgcaaggcttctggattcacgttttacctcctatagtatcaactgggtgcgccaggccgctggacaacgactgagtggatgggatgggcgaaccctaanacgtggtgtcacagtgtctcaccatccncggacagactacatgaccacgaactctacataaacacagctacatggatgagacnctgacnnctgacgacacggccgtactatactgtgacgagacgtcccagtatcccgggtgacgcccgtacggcacggtccggtactttagaccgttcgngggggtacccg

SEQ ID NO: 206356 - DNA, 648 bp, Homo sapiens
  misc_feature: GYAE6OF01D81DU.17.25.C03.1.454.CMB.1.raw
tcagcgtagactagcacgaccggtgctcgatttagtagtgtagatttgggtttgggggagtcagtctcagtcaggacacagcatggacatgagggtccccactcagctcctggggctcctgctactctggctccgagctgccagatgtgacatccagatgacccagtctccatccctcctgtctgcctcgtggtgggggtcagacgtcaccatcacttgaccggacaagtcacggtactttaaaactatttaaatggtatcagcaagaaacctaggaaaaccgccctaagaccctctgtactctcgtggtcacacttccgactctaggacgtaaggtcggaccgtcccagtcgtaggttcgaggtgctaggtgatcggtaggactagtactttacaacttctactaaccatcccgaacctactacgtacgacctaaccgtaggaaggtattcgtgtaactaagttaccttaactaacttgtaaccaactaagtaactttaccgaccgtttccccgtctacgtttacgtttacgggaacccgtaacggggtaaaccttaagggttaacgtaacgtaacgtaaacctaaaaaccggtcgttacggtacggtactaccgtacccgtaaccgttacttcgttcgtttaaccc

SEQ ID NO: 206357 - DNA, 529 bp, Homo sapiens
  misc_feature: GYAE6OF01B896E.17.25.C03.1.454.CMB.1.raw
  modified_base (280)..(280): a, c, t, g, unknown or other
  misc_feature (280)..(280): n is a, c, g, or t
  modified_base (409)..(409): a, c, t, g, unknown or other
  misc_feature (409)..(409): n is a, c, g, or t
  modified_base (418)..(418): a, c, t, g, unknown or other
  misc_feature (418)..(418): n is a, c, g, or t
  modified_base (432)..(432): a, c, t, g, unknown or other
  misc_feature (432)..(432): n is a, c, g, or t
  modified_base (439)..(439): a, c, t, g, unknown or other
  misc_feature (439)..(439): n is a, c, g, or t
  modified_base (466)..(466): a, c, t, g, unknown or other
  misc_feature (466)..(466): n is a, c, g, or t
  modified_base (491)..(491): a, c, t, g, unknown or other
  misc_feature (491)..(491): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacaacgacctgagtggatggggatggggacgaaccctaacacgtggtgtcacgagtgtcttcacccatccctccgggacagacttaccatcgaccacgactcctaccaataaacncagcctaanatggagttgaggancctgacntctgacgacaccggtcgtactattcgngtcgcgaggctcccagtctccgggncgcctacggcacggcggtacctttggcttcggtcgggg

SEQ ID NO: 206358 - DNA, 681 bp, Homo sapiens
  misc_feature: GYAE6OF01AO8DT.17.25.C03.1.454.CMB.1.raw
  modified_base (281)..(281): a, c, t, g, unknown or other
  misc_feature (281)..(281): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctgggctgaggtgaagaagcctggggcctcgagtgaaggtctcctgcaaggcttctggattcacgtttacctcctatagtatcaacgtgggtncgcaggccgctggacaacgcctgagtggatgggatgggaccgaacccgtacgacgtggtcgtaccacgtaggtgtaccttccgaacccctacgttcccgtaccgggaactacgtaacctttaccgaagttccgaacccgtaaccgtaaccttccccgtacctaaacgtaaaccctacgaaccgtacccttaacgtaacgtacggggttaacgtttacggaaacgggtccgtacccgtaggtacctaacgttaccgtaggaacccgtaccgaccgggttacccgttacttaacggttacctggtacccgacgtaacggtccggtaccgaaccggtcgttccgggtacgccgtaccgtcggacgtacggtaccggtacgtttacgaccgtttcggaccgggg

SEQ ID NO: 206359 - DNA, 540 bp, Homo sapiens
  misc_feature: GYAE6OF01BK1XK.17.25.C03.1.454.CMB.1.raw
  modified_base (329)..(329): a, c, t, g, unknown or other
  misc_feature (329)..(329): n is a, c, g, or t
  modified_base (400)..(400): a, c, t, g, unknown or other
  misc_feature (400)..(400): n is a, c, g, or t
  modified_base (466)..(466): a, c, t, g, unknown or other
  misc_feature (466)..(466): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcaaccctanactggtgtcacagtgtcttcacccatccgtccgggacagacttacatcgaccacgaactccacactaaacncagcctacagtggtagttggagacgcctagacagtctgaccgacgaccggtcctactattacgtgngcggagaccgtcccacgtcgtccggtagacgcccgtaacggcacggtccggttcctttaggccgttcggcgggg

SEQ ID NO: 206360 - DNA, 602 bp, Homo sapiens
  misc_feature: GYAE6OF01BUYBY.17.25.C03.1.454.CMB.1.raw
  modified_base (345)..(345): a, c, t, g, unknown or other
  misc_feature (345)..(345): n is a, c, g, or t
  modified_base (461)..(461): a, c, t, g, unknown or other
  misc_feature (461)..(461): n is a, c, g, or t
  modified_base (470)..(470): a, c, t, g, unknown or other
  misc_feature (470)..(470): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagccgtggggcctcagtgaaggtctcctgcaaggcttcgtggattctacgtttacctcctatagtatcaacgtgggtgcaccgacggccgctggacaacgacctggagtggagtgggatcggggaccaacccgtaanacgtggtgtcacgtagtgtccttcgaccctagtcccgaccgggtacacgtacttaccatacgaacctaccgacctccctaccaactaaacacacgcctacagtggagttcgagganccgtagacnctcgtacgaccgacgaccgggtcctacttacgttacgtgtagacggacgtaccgtacccgacggtacgtccgggtacgcggacccgtacggccgtacggtccggttacctttcggtaccgttcggtacgggg

SEQ ID NO: 206361 - DNA, 588 bp, Homo sapiens
  misc_feature: GYAE6OF01A4O7F.17.25.C03.1.454.CMB.1.raw
  modified_base (281)..(281): a, c, t, g, unknown or other
  misc_feature (281)..(281): n is a, c, g, or t
  modified_base (448)..(448): a, c, t, g, unknown or other
  misc_feature (448)..(448): n is a, c, g, or t
  modified_base (513)..(513): a, c, t, g, unknown or other
  misc_feature (513)..(513): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagaagcctggggcctcagtgaaggtctcctgcaaggcttctggattcacgtttacctcctatagtatcaactgggtncgcaggccgctggacaacgacctgagtggagtgggatgggaccgaaaccctaacgacgtgggtcgtcacgagtcgttccttccacccctatcccgtaccggggacacgtaccttaaccatcgaaccctaaccgaacctcctaccaactaaaccaccaacgccctaanacgttgggaacgttggaaggacgcctagactatcgtagaaccgacgaccgggtccttatattacnggtcgcgagtcgtacccacggctccgggtgacgccgtacggcctacggccggtcctttgccgttcggtccggggg

SEQ ID NO: 206362 - DNA, 673 bp, Homo sapiens
  misc_feature: GYAE6OF01DIATI.17.25.C03.1.454.CMB.1.raw
  modified_base (450)..(450): a, c, t, g, unknown or other
  misc_feature (450)..(450): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcaggcacaggtgcccacgcccaggttcagttggtgcagacgtggggctgaggtgcagagccgtggggcatcagtgactgtctcctgcaaggcttctggattcacgtttacctcctatagtatcaacgtgggtgcgccaggccgctggacacgcctgagtggagtgggagtcgggaccgaaccctaacgactgggtcgtcacgtagttcgtcttaccaccctactcccgtaccgggactacggaccttaccactacgaacccaaccgaacctcctaaccaataaacccacaacgtaccctanacgtgggagttggagacgtctgaactactacgtaggaaccgaaccgtaccgggtacccgttactttaacgttaccgttggtacggaccggtaacggtacccggttaacccgacggttaaccggttacccggggtacggtaacccggtaccccggttaacggggacccgtaaccggggttcccgggttacccgtttttcggtaaccccgggttttcccgggggg

SEQ ID NO: 206363 - DNA, 582 bp, Homo sapiens
  misc_feature: GYAE6OF01DUFEJ.17.25.C03.1.454.CMB.1.raw
  modified_base (280)..(280): a, c, t, g, unknown or other
  misc_feature (280)..(280): n is a, c, g, or t
  modified_base (335)..(335): a, c, t, g, unknown or other
  misc_feature (335)..(335): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggcccgctggacaacgacctggagtggatgggatcgggacgaaccctaanacgtggtgtcacagtgtcttcacccatccctcgggacagaccttaccatcgaccacgacctcctaccaataaaccacagaccctaacagtgggagttaggaggacgcctgactagtctacgaccgaaccgaccgggtcccgttactacttaactggtagccgtaagccgtacccacggtacgtaccggtggacgtacccgtacggacgacgggtccggttcctttacggccgtttcggtaccggggg

SEQ ID NO: 206364 - DNA, 225 bp, Homo sapiens
  misc_feature: GYAE6OF01CECHC.17.25.C03.1.454.CMB.1.raw
  modified_base (222)..(225): a, c, t, g, unknown or other
  misc_feature (222)..(225): n is a, c, g, or t
tcagcgtagactagcacgaccggtgctcgatttagtagtgtagatttgggtttgggggccagggaaccctggtcaccgtctcctcagcctccaccaagggcccatcggtcttccccctggcaccctcctccaagagcacctctgggggcacagcggccctgggctgcctggtcaaggactacttccctagtctacgctgagcgggctggcaaggcgcatagnnnn

SEQ ID NO: 206365 - DNA, 617 bp, Homo sapiens
  misc_feature: GYAE6OF01AGNFP.17.25.C03.1.454.CMB.1.raw
  modified_base (242)..(242): a, c, t, g, unknown or other
  misc_feature (242)..(242): n is a, c, g, or t
  modified_base (280)..(280): a, c, t, g, unknown or other
  misc_feature (280)..(280): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagccgtggggcctcagtgaggtctcctgcaggcttcnggtattcacgtttacctcctatagtatcaacgtgggtncgccaggccgcgtggaccaacgcctgaggtggagtgggagtcggggaccaaacccgtacgacgtggtcgtcacgtgtcgtccttaccacccctactccgtaccgggactaggtaccttaccgagtacgaacccacgtaacctcccgtaccaactaaccacacgacctacacgtggagttagacggactccgtagactcgtcgtacggacgacgaccggtaccgtacttacgttacgtgtcgacgagtaccgtacccgacggtacgttccgggtacgaccgtcccgtaacggcgtacggtcccggttaccgtttacggtcccgtttcgggtaccgggg

SEQ ID NO: 206366 - DNA, 561 bp, Homo sapiens
  misc_feature: GYAE6OF01DCV1I.17.25.C03.1.454.CMB.1.raw
  modified_base (282)..(282): a, c, t, g, unknown or other
  misc_feature (282)..(282): n is a, c, g, or t
  modified_base (334)..(334): a, c, t, g, unknown or other
  misc_feature (334)..(334): n is a, c, g, or t
  modified_base (429)..(429): a, c, t, g, unknown or other
  misc_feature (429)..(429): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagccgtggggcctcagtgaaggtctcctgcaggcttctggattcacgtttacctcctatagtatcaactgggtncgccaggccgctggacaacgcctgagtggatgggatgggacgaaccctaacncgtggtgtcacagtgtcttccaccctatcccgtccggggacagtacttaccatcgaccacgtaacctcctaccaataaaccacacgaccctaacntggagttggaggacgcctggaacctatctcgaacgaccgtacggccttctattactgtagccgagaccgtcccacgtctcccggtgacggcctacggcgtacggccggtcccttttggccgtttgccggggg

SEQ ID NO: 206367 - DNA, 756 bp, Homo sapiens
  misc_feature: GYAE6OF01BOU0A.17.25.C03.1.454.CMB.1.raw
  modified_base (283)..(283): a, c, t, g, unknown or other
  misc_feature (283)..(283): n is a, c, g, or t
  modified_base (643)..(643): a, c, t, g, unknown or other
  misc_feature (643)..(643): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctgggctgaggtgaagagccgtgggctcgagtgaaggtctcctgcaaggtcttcgtggattcgtacgttacctcgtatagtatcaacgtgggtcncgccgaggcccgtctagggaaccaacgtaccgttgacggtggtaagtggggaattcggggaaccgtaaacccctaaacgccggttgggtacgtacgtaacgagttcggtaccttaccgacccctaacgtttcccgacccgggggaactaacggtaaccctttaacccgagttaccggaaacccgtaaccggtaaacccttcccgttaaccctaaacgttaaaaccgaaccgaaaccggtccctaaaccggtaaggttacgggtaacggtttacggaaacgggtacctaccgtacggtaactaaccgttcgtaacggaaccgtaacccggaacccggtccgttaacgttaacgttaaccgngggttaccgacggtacggtaccggttacccaaaggtcccgttaccgggtacgacggtacccttaccgggaacgccggttaccggttccgtttacgtccgttccgggtacgggg

SEQ ID NO: 206368 - DNA, 644 bp, Homo sapiens
  misc_feature: GYAE6OF01B1L3K.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagccgtggggcctcagtgaaggtctcctgcaaggcttcgtggattcacgtttacctcctatagtatcaacgtgggtgcgccgaggccgcgtggaccaacgacctggagtggagtgggagtcgggaccgtaaaccctaacgacgtggtcgtacaacgtaggtcgtccttaccacccctatcccgtaccgggacacgtaccttaccgatacgaccacgtaacctccctaccaactaaaccacgaacgtacctaacgagtagggtagttaggaggacgccgtagactatcgtacgaaccgaccgaccggtccgttacttacgtttacgtgtacggcgaacgtaccgtaccccgacgtaccgttcccgggtaggaccgtacccggtacggaccgtacgggtcccggttaccgttttcgtaccggttccgggtaccggggg

SEQ ID NO: 206369 - DNA, 548 bp, Homo sapiens
  misc_feature: GYAE6OF01BJVKV.17.25.C03.1.454.CMB.1.raw
  modified_base (281)..(281): a, c, t, g, unknown or other
  misc_feature (281)..(281): n is a, c, g, or t
  modified_base (449)..(449): a, c, t, g, unknown or other
  misc_feature (449)..(449): n is a, c, g, or t
  modified_base (456)..(456): a, c, t, g, unknown or other
  misc_feature (456)..(456): n is a, c, g, or t
  modified_base (509)..(509): a, c, t, g, unknown or other
  misc_feature (509)..(509): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagccgtggggcctcagtgaaggtctcctgcaaggcttctggattcacgtttacctcctatagtatcaactgggtncgccaggccgctggaacaacgacctggacgtggagtgggatgggacgaaacccgtaagacgtggtgtacacgagtcgtctacacccctatcccgtaccgggacagtaccttaaccatcgaaccacgacctcctaccaataaacacacacctacagtggagttgagacnctagacntctagacgacacggtcctactattcgtgcgcgagacgtcccgagtcgtccggngcgccgtacggctacggccggtcttcgcgttcggcgggg

SEQ ID NO: 206370 - DNA, 528 bp, Homo sapiens
  misc_feature: GYAE6OF01B4WF8.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacacgacctgagtggatgggatgggcgaaccctaacactggtgtcacagtgtcttcacccatcctcgggacagacttaccatcgaccacgaactcctaccataaacacagcctaacatggagttgaggacgcctgacatctgaccgacacggtccgtactattacgtgtcgcgagcgtacccacgtctccgggtgcgccgtacggctacggccggtcctttgcttcggtcgggg

SEQ ID NO: 206371 - DNA, 548 bp, Homo sapiens
  misc_feature: GYAE6OF01D4IK5.17.25.C03.1.454.CMB.1.raw
  modified_base (277)..(277): a, c, t, g, unknown or other
  misc_feature (277)..(277): n is a, c, g, or t
  modified_base (302)..(302): a, c, t, g, unknown or other
  misc_feature (302)..(302): n is a, c, g, or t
  modified_base (349)..(349): a, c, t, g, unknown or other
  misc_feature (349)..(349): n is a, c, g, or t
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatcctccctgtctgcctctggtgggggtcagagtcaccatcacttgccggacaagtcacggacgttaaaacctatttaaattggtatcagcaagaaacctggaaaacnccccagacctcctgatctcgtggtncatccactctgcgaagtggctccatcgagttcagtggcagtgatcgnggacagtatttacaattctacaccactcacctactctcgacaaccgtgaggtattgtacgtactaacttcctactactacgtacaacgtaagtaacgttacctaccgttcccctacgtcttacgtttcggaccgtacgggtaacctaaagttagagtactacgaaacgtacgtagtggctcgacacctacttctgttcc

SEQ ID NO: 206372 - DNA, 608 bp, Homo sapiens
  misc_feature: GYAE6OF01CDO2U.17.25.C03.1.454.CMB.1.raw
  modified_base (438)..(438): a, c, t, g, unknown or other
  misc_feature (438)..(438): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctgggctgaggtgaagaagcctggggcctcagtgaaggtctcctgcaaggcttctggattcacgtttacctcctatagtatcaactgggtgcgccaggccgctggacaacgacctggagtgggatgggagtcggggaccgaaaccccgtaacacgtgggtgtcacgagtcgtccttccaccccatcccgtccgggacacgacttaccatcgaccaccgaacctcctaccaataaaccacacgaccctaanagtgggaacgttgaggacgcctagactatccgtgaaccgacgaccgggtcccttactacttaccgtgtcggcgtaggaccgtaccccgacggtacgtcccgggtacgcggccccgttacgggaccgtacgggtcccggtaccctttcggtccgtttccgggtaccggggg

SEQ ID NO: 206373 - DNA, 721 bp, Homo sapiens
  misc_feature: GYAE6OF01CYF8W.17.25.C03.1.454.CMB.1.raw
tcagcgtagactagcacgaccggtgctcgatttagtagtgtagatttgggtttgggggagtcagtctcagtcatgacacagcatggacatgagggtccccgctcagctcctggggctcctgctactctggctccgagctgccagatgtgacatccagatcgacccagtctccatccctccctgtctgcctcgtggtgggggtcagacgtccaccatcacgttcgaccggacaagtccgacggtacgtttaaaaacctatttaaattggtatcagacagaaacctagaaacgcccacgacctctgatctcgtggtgcactccactctgcgtaaggtcgaccgtcccagtacggtaggttcgaggtcggacgtaggtacggtacgtcgtaggggacctaaggttactttacgaattccgtacaacctacctaccgtacctacctcgtaccggtacctaacccgttaggacggttacgtttacggtacgtaaccgtaacttaccgttaaccctttaacgttacgtaacccgtaaactaacggttaaccgtttaaccgtacccgtttacccccgttacgttacccgttaccggttttaccggacccgggtaaacggggtaaacccgttaaaggttacggtaacgtaaacggttaaccgaaaaccggttaacgtttacggtacgggtacccttacggaccctaacccgttacgttccgtttacccg

SEQ ID NO: 206374 - DNA, 643 bp, Homo sapiens
  misc_feature: GYAE6OF01EE0HE.17.25.C03.1.454.CMB.1.raw
  modified_base (452)..(452): a, c, t, g, unknown or other
  misc_feature (452)..(452): n is a, c, g, or t
  modified_base (463)..(463): a, c, t, g, unknown or other
  misc_feature (463)..(463): n is a, c, g, or t
tcagcgtagactagcacgaccggtgctcgatttagtagtgtagatttggttttggggactcaacaaccacatctgtcctctagagaaaaccctgtgagcacagctcctcaccatggactggacctggaggatcctcttcttggtggcagcagctacaagtcgcccactcccaggtgcagctggtgcagtcgtggggctggaggtgaagacgcgtgggcctcgagtgaaggtctctgcaggtcttcgtggacttctaccgtttacctccttaatagtatactaacgtggggtagccgccagggcccgcgtaggaccaaacgccgtggaggtgggtagtagggatggggtacccgaaaccgttaacacgtggtcgtacacgagtcgtccttaccaccctagtcccgacgggactacgtactaccatcgaaccacgaaccctcctacaataaacnctacgacctanagtgtagttagagcgtcgtacgactgtacgtcgaaccgtaccgaccggtacccgttacttaacgttgtcgtacggacggtaacgtccgtaccccgtaaggtccgttacccgggttgaaccggccccgtaaggccgtaccggtccgggttaccctttggtacccgttcgggtacccggggg

SEQ ID NO: 206375 - DNA, 568 bp, Homo sapiens
  misc_feature: GYAE6OF01DOQHU.17.25.C03.1.454.CMB.1.raw
  modified_base (282)..(282): a, c, t, g, unknown or other
  misc_feature (282)..(282): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagcctggggcctcagtgaaggtctcctgcaaggcttctggattcacgtttacctcctatagtatcaactgggtncgccacggccgctggacaacgacctgagtggagtgggagtgggaccgaaccctaacacgtggtcgtcacagttcgtccttcgaccctatcccgtacgggacagtacctaccatcgaccacgaacctccctacaataaaccacacgacctacagtggagttgagacgcctgactatctacgacgaccgacggctactattacgtgacgcgagccgtacccgacgtacgtcccggtgaccgtcccgtacggcgtacggccggttcctttcgccgtttcggaccggggg

SEQ ID NO: 206376 - DNA, 609 bp, Homo sapiens
  misc_feature: GYAE6OF01CDF4C.17.25.C03.1.454.CMB.1.raw
  modified_base (262)..(262): a, c, t, g, unknown or other
  misc_feature (262)..(262): n is a, c, g, or t
  modified_base (281)..(281): a, c, t, g, unknown or other
  misc_feature (281)..(281): n is a, c, g, or t
  modified_base (345)..(345): a, c, t, g, unknown or other
  misc_feature (345)..(345): n is a, c, g, or t
  modified_base (528)..(528): a, c, t, g, unknown or other
  misc_feature (528)..(528): n is a, c, g, or t
  modified_base (533)..(533): a, c, t, g, unknown or other
  misc_feature (533)..(533): n is a, c, g, or t
  modified_base (560)..(560): a, c, t, g, unknown or other
  misc_feature (560)..(560): n is a, c, g, or t
  modified_base (575)..(575): a, c, t, g, unknown or other
  misc_feature (575)..(575): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagaagcctggggcctcagtgaaggtctcctgacaaggcttctggattcacgtttaccnctatagtatcaactgggtncgccgaggccgcgtggaaccaacgaccttggacggtggagtgggagtcgggaccaaacccgtanaccgtggtacgtcacgagtcgtcttccaccccgatcccgtacggggactacgtaccttaccatacgaacccaacgtaacctccctaccaaactaaaccaacctacgtaccctaacacgttacgggtagttacggaggacgtccgtagactactcgtagaccgacgacggccttactattacgngacgngacgacgtcccgagtacgtccgggtanccggtaccgaccggngacggtaccggtctttcggccgttcggtacgggg

SEQ ID NO: 206377 - DNA, 766 bp, Homo sapiens
  misc_feature: GYAE6OF01CIWNP.17.25.C03.1.454.CMB.1.raw
tcagcgtagactagcacgaccggtgctcgatttagtagtgtagatttgggtttggggacgtctaacaaccacatctgtcctctagagaaaaccctgtgagcacagctcctcaccatggactggacctggaggactccgtcttcgttggtggcacgcagctacaagtcgcccactcccgaggtcgcagcgtggtgcagtcgtcgggctgaggtgaagacgcgtgggcctgagtgaacggtctccgtgacgtaaggtcttcgtaggtaactttcgtaaccggttttacctccgttaagtaacgtacgtacgaacggtgggtcgccggccgaggccgcgtaggaaccaaccggtccgtaggacggtaggacgtgggacgtcgggaaccctaaccctaacgtacgtggtacgtacgagtagttcgtccttacaaccctatcccgtacggaactacgtaccttaccgagtaccgaaccaaccgtaacctccctaacctaaacgtaaaccgacgaaccgtaccgtaaacgtacggtacgggtaagtttacggaacggaccgtaccggtaagaaccgtacgttaacggtacggaaccggtaacccggtaacccggttcgttaaccgttaacgttaccggtgggttaccggaccggtaaccgtaccggttcccccgaaacggtcccggttacccggtcgaacccggtcccgtaccggaacccggtcgggttacccggttcctttaaccgggcccggtttacccgggacccgggg

SEQ ID NO: 206378 - DNA, 763 bp, Homo sapiens
  misc_feature: GYAE6OF01DJL0U.17.25.C03.1.454.CMB.1.raw
  modified_base (307)..(307): a, c, t, g, unknown or other
  misc_feature (307)..(307): n is a, c, g, or t
  modified_base (354)..(354): a, c, t, g, unknown or other
  misc_feature (354)..(354): n is a, c, g, or t
tcagcgtagactagcacgaccggtgctcgatttagtagtgtagatttgggtttggggacgtcaacaaaccacatctcgtcctctagagaaaaccctgtgagcacagctcctcaccatggactggacctggaggatcctcttcttggtggcagcagctacaagtgcccactcccaggtgcagctggtgcagtcgtggggctgaggtgaagaagccgtggggcctcgagtgaacggtctccgtgcaaggtcttcgtggtattcacgttttacctcctaatagtactcaacgtgggtgcgccgacggccncgtaggaacaacgcctgagtggatgggatcgggacgaaaccctaaancgtggtctacacgtacgtcgtcctttaccaacccctacgtcccgtaccggggaaactacgtaaaccgtttaaccacggtaccgaacccaaccggtaacctaccctaaccctaaaacgtaaaaaccctaaccgtaaccggtaacccctaaagtaaccggttaaggggtagttttaacgggaaacggtacgtaccccgttaagggaacccttaacgttacctaacggaaacccgtaacccggtaccgggtacccgtttacgtttaacttaaccgtggacgtaaccggtaaggtaccccgtaccccgtaaaccggtaggttaccccgggtaggaacccggtacccctaacggggtacccgaccgggttccgtttaccccgtttaggtacccgtttcggggtaacccgggggg

SEQ ID NO: 206379 - DNA, 683 bp, Homo sapiens
  misc_feature: GYAE6OF01CJTMR.17.25.C03.1.454.CMB.1.raw
  modified_base (473)..(473): a, c, t, g, unknown or other
  misc_feature (473)..(473): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctgggctgaggtgaagaagcctggggcctcgagtgaaggtctcctgcaaggcttcgtggattctaccgtttacctcctatagtatcaacgtgggtgcgccaggccgcgtggacaacgacctgagtggagtgggatcggggacgaaccctaactacgtggtcgtcaacgaggttgtaccttaccaacccctacttcccggtaccggggacaacggtaacctttaacccaattacggaacccaaccggtaaccttccctacccaaataaaacccacacgaccctaanagtacgggtaagttcggaaggtacgcccgttagaaccagttacgtcggaaccggaccgacccgggtccgttacttaacgttaccgtgttccggacggtaacggaccggttaccccaacgggtcgtaccccgggttaggaacccggtccccgttaccgggctaccgggtacccgggttacccgttttggacccgtttccgggtacgggggg

SEQ ID NO: 206380 - DNA, 665 bp, Homo sapiens
  misc_feature: GYAE6OF01D4J6O.17.25.C03.1.454.CMB.1.raw
  modified_base (219)..(219): a, c, t, g, unknown or other
  misc_feature (219)..(219): n is a, c, g, or t
  modified_base (523)..(523): a, c, t, g, unknown or other
  misc_feature (523)..(523): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctggaggtgaagagcgtggggcctnagtgaaggtctcctgcgaaggtcttcgtggtactttctaccggtttacctccttaataggttatcgtaacgtgggtcgccgaccgagggcccgtacgtggaaccaacgccgtggacgtagggagtggggagtcggggaccgtaaaccccgtaagcgtggtcgtacaccgtagttcgttccttaccgaacccctacgtcccgtaccggggacacgtaccttacagtccgaacctacgaaccttccgaccaactaaacaccgaacgtaccctaacagtggtacgttgacggtactccgtaggactntcgtacgaaccgacgccggtaccgtacttaacgttcgtacgtacgaccggtaacgacccgtcccgtaacgtcggtacccgggagaccggtcccgtacggcgtaccgggtccggttccttcgtacggggggttctaccggggg

SEQ ID NO: 206381 - DNA, 575 bp, Homo sapiens
  misc_feature: GYAE6OF01C70OU.17.25.C03.1.454.CMB.1.raw
  modified_base (316)..(316): a, c, t, g, unknown or other
  misc_feature (316)..(316): n is a, c, g, or t
  modified_base (333)..(333): a, c, t, g, unknown or other
  misc_feature (333)..(333): n is a, c, g, or t
  modified_base (340)..(340): a, c, t, g, unknown or other
  misc_feature (340)..(340): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcaggctacaagtgcccactcccaggtgcagctggtgcagtcgtggggctggaggtgaagaagccgtggggcctcagtgaaggtctcctgcaaggcttctggattcacgtttacctcctatagtatcaacgtgggtgcgcgaggccgctggacacgacctgagtgagngggatgggacgaaccancgtggtntcacagtgtcttcaccctatcccgtacggacacgtaccttaccatcgaaccacgtaacctccgtacaactaaacacacgacctaacagtggtagttaggaggcgacgtcgactagtcgtagaaccgaccgacgggtcctactacgttacgtgtcgacgtacgaccgtccgaacgcgttccgggacgacgcccgtacggcgtacggtccggttctttacgtccgttcggaccgggg

SEQ ID NO: 206382 - DNA, 532 bp, Homo sapiens
  misc_feature: GYAE6OF01A54X1.17.25.C03.1.454.CMB.1.raw
  modified_base (458)..(458): a, c, t, g, unknown or other
  misc_feature (458)..(458): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcaaccctaacactgggtgtcacagtgtcttcacccatcctccgggacagacttaccatcgaccacgaactcctccaataaacacagcctacatggagttgaggagcctgacatctgacgacacgggcctactattacngtgcgagtacgtcccacgactcccgggtgacggccctacgggcacggccggtcctttcgacttcggtacggggg

SEQ ID NO: 206383 - DNA, 546 bp, Homo sapiens
  misc_feature: GYAE6OF01D40Y2.17.25.C03.1.454.CMB.1.raw
  modified_base (280)..(280): a, c, t, g, unknown or other
  misc_feature (280)..(280): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacaacgacctgagtggatgggatgggcgaaccctaacacgtggtgtcacagtgtcttcacccatccctcgggacacgacttaccatcgaccacgaacctcctaccaataaacacacgaccctacatggagttgaggagcctgacatctgaccgacgacggtccgtctattactgtgcgagacgtcccgaggacgtccggtgacgcccgtacggcgacggtccggtcccttttaggccgtttcggtacggggg

SEQ ID NO: 206384 - DNA, 549 bp, Homo sapiens
  misc_feature: GYAE6OF01BXWH0.17.25.C03.1.454.CMB.1.raw
  modified_base (209)..(209): a, c, t, g, unknown or other
  misc_feature (209)..(209): n is a, c, g, or t
  modified_base (240)..(240): a, c, t, g, unknown or other
  misc_feature (240)..(240): n is a, c, g, or t
  modified_base (242)..(242): a, c, t, g, unknown or other
  misc_feature (242)..(242): n is a, c, g, or t
  modified_base (246)..(246): a, c, t, g, unknown or other
  misc_feature (246)..(246): n is a, c, g, or t
  modified_base (450)..(450): a, c, t, g, unknown or other
  misc_feature (450)..(450): n is a, c, g, or t
tcagcgtagactagcacgaccggtgctcgatttagtagtgtagatttgggtttggggactcaacaaccacatctgtcctctagagaaaaccctgtgagcacagcctccctcgaccagtcgacgtggaaccgtggagtactcgtcttcgtggtggcaggcaggctaacgaagtcgacccagcccaggtgcagctggtgctagcgtggggngtgagagagagcgtggctgagtagagtctcngngagntgtgtatactacgttactactatatatacagtaggtgcgcgacgacgcgtacgacgacgacgtagtagaggagaggagtacggacgaacctaacgacgtagtagtacacgtagtcgtctacaccacgtacgtacgtacgacgtactacactacgacacgactacacaacaacacacactacagagtagtagagacgacgacganatacgtacgacgacgacgtacgtactactacgtacgacgagacgacgtaccgacgacgtagacgcgacgacgacgtcgtcgtacgtcgtcgtcggtcgg

SEQ ID NO: 206385 - DNA, 565 bp, Homo sapiens
  misc_feature: GYAE6OF01AOOAF.17.25.C03.1.454.CMB.1.raw
  modified_base (507)..(507): a, c, t, g, unknown or other
  misc_feature (507)..(507): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacgactggtgtcacgagtgtcttcacccatccgtccgggacacgtaccttaccatcgaccacgaacctcctaccaataaacacagcctacatggagttgaggagcctagacatctgaaccgacgacggtccgtacttagttacgtgtacgcgagacgtccccgaagtcgttcccgggngtacgcccgttacgggcctacggtccggtaccttttcggaccgtttcggtaccggggg

SEQ ID NO: 206386 - DNA, 587 bp, Homo sapiens
  misc_feature: GYAE6OF01CW1WT.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaaggcttctggattcacgttttacctcctatagtatcaacgtgggtacgcgccgaggccgcgtcggacaacgacctgagtggatggggatgggaccaaaccctaacacgtggtcgtcactagtcgtcttccaccctagtcccgtaccgggacagaccttaccatacgaccaacgaacctcctaccaataaacaacacgtacctaacagtaggagttcgaggacgcctgaccatcgtagaacgagtaccggtcgttactagttaccgtgtcgacgtagaccgtacccgaagtaccgtccggtagacgtcccgtacggacacggtcccggttcctttacggcgttcggaccgggg

SEQ ID NO: 206387 - DNA, 534 bp, Homo sapiens
  misc_feature: GYAE6OF01D1BBO.17.25.C03.1.454.CMB.1.raw
  modified_base (259)..(259): a, c, t, g, unknown or other
  misc_feature (259)..(259): n is a, c, g, or t
  modified_base (278)..(278): a, c, t, g, unknown or other
  misc_feature (278)..(278): n is a, c, g, or t
  modified_base (289)..(289): a, c, t, g, unknown or other
  misc_feature (289)..(289): n is a, c, g, or t
  modified_base (326)..(326): a, c, t, g, unknown or other
  misc_feature (326)..(326): n is a, c, g, or t
  modified_base (333)..(333): a, c, t, g, unknown or other
  misc_feature (333)..(333): n is a, c, g, or t
  modified_base (383)..(383): a, c, t, g, unknown or other
  misc_feature (383)..(383): n is a, c, g, or t
  modified_base (391)..(391): a, c, t, g, unknown or other
  misc_feature (391)..(391): n is a, c, g, or t
  modified_base (398)..(398): a, c, t, g, unknown or other
  misc_feature (398)..(398): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagagctggggcctcagtgaaggtctcctgcaaggcttctggattcacgtttaccnctatagtatcaactgggtncgccaggccgntggacaacgcctgagtggatgggatgggacaacctancgtggtntcacagtgtctcaccatccgtcgggacagtactacatcgaccacgactcncaataacncagctanatggtaagttaaggctcctagactatctagacaacgacggcctctatacgtgtgcgagtaccgtacccgagtacgtccggtaggacgcccgtacggcgacggtccggtacctttggccgtttcggcggggtaccgg

SEQ ID NO: 206388 - DNA, 521 bp, Homo sapiens
  misc_feature: GYAE6OF01B78N0.17.25.C03.1.454.CMB.1.raw
  modified_base (279)..(279): a, c, t, g, unknown or other
  misc_feature (279)..(279): n is a, c, g, or t
  modified_base (332)..(332): a, c, t, g, unknown or other
  misc_feature (332)..(332): n is a, c, g, or t
  modified_base (403)..(403): a, c, t, g, unknown or other
  misc_feature (403)..(403): n is a, c, g, or t
  modified_base (423)..(423): a, c, t, g, unknown or other
  misc_feature (423)..(423): n is a, c, g, or t
  modified_base (482)..(482): a, c, t, g, unknown or other
  misc_feature (482)..(482): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaaggcttctggattcacgtttacctcctatagtatcaactgggtncgccaggccgctggacaacgacctgagtggatggggatggggacaaccctaanactggtgtcacagtgtcttcacccatcctcgggacagacttacatcgaccacgacctccctcaataaaccncagcctacatgagttgaggncctgacatctagacgacacggtccttatattactgtgcgagcgtcccaggctccgggtncggtcctacggcacgcggtcctttggaccttggccgggg

SEQ ID NO: 206389 - DNA, 646 bp, Homo sapiens
  misc_feature: GYAE6OF01EH47H.17.25.C03.1.454.CMB.1.raw
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctcgtggtgggggtcagagtcaccatcacttgccggacagtcacggtacgttaaaacctatttaaattggtatcagcaagaaacctaggaaaacgccccaagaccctcctagtatcctcgtggtgctatcccactcgtgacgtaagtcggccttccgagtcggagttcaggtggctaggtggagtcgtagggactaggtactttacaaattcctacacctactaccacctactctacgacctaaccgtagtaggtagttgtacgtactaacttccgttaacttactagtaccaacgtaagtacgttaaccgtacccgtttccccgttaccgtaccgttacgttttaccgggacccggtaacggggtaaaccgtaaagggttacgaacggtaactaaccgaaacggtaacgttacggtacggacgttaccgaccctaaccgtacttccgttcgtttacccg

SEQ ID NO: 206390 - DNA, 580 bp, Homo sapiens
  misc_feature: GYAE6OF01BVQP4.17.25.C03.1.454.CMB.1.raw
  modified_base (280)..(280): a, c, t, g, unknown or other
  misc_feature (280)..(280): n is a, c, g, or t
  modified_base (417)..(417): a, c, t, g, unknown or other
  misc_feature (417)..(417): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacaacgcctgagtggatgggatgggacaaccctaacacgtggtgtcacagtgtcttcacccatcccgtccgggacagtacttaccatcgaccacgaacctcctaccaataacacacgcctaanatggagttgacggagcctgactatctagaaccgacgaccgggtcctcttacttacgtggtcgacggtagaccgtccccgaaggtaccgttccgggtgaccggtccccgttaagggccgtaacgggccggttacccttttcggaccgtttcgggtaccgggggg

SEQ ID NO: 206391 - DNA, 540 bp, Homo sapiens
  misc_feature: GYAE6OF01DLY81.17.25.C03.1.454.CMB.1.raw
  modified_base (260)..(260): a, c, t, g, unknown or other
  misc_feature (260)..(260): n is a, c, g, or t
  modified_base (280)..(280): a, c, t, g, unknown or other
  misc_feature (280)..(280): n is a, c, g, or t
  modified_base (329)..(329): a, c, t, g, unknown or other
  misc_feature (329)..(329): n is a, c, g, or t
  modified_base (365)..(365): a, c, t, g, unknown or other
  misc_feature (365)..(365): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttaccncctatagtatcaactgggtncgccaggccgctggacacgacctgagtggatgggatgggcgaaccctanacgtggtgtcacagtgtcttcacccatcctcggganagacttaccatcgaccacgaactcctccaataaacacagcctacagtggagttgaggagcctagacatcgtagacgacgacggtccgtactattactgtagcgagacgtcccagtactccgggtagccgccgtacggcgacggtccggtacctttcggaccgttcgtaccggggg

SEQ ID NO: 206392 - DNA, 605 bp, Homo sapiens
  misc_feature: GYAE6OF01EO74C.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgcgtggacaacgacctggagtggagtgggagtggggacgaaccctaacgacgtggtgtacgacgtaggtcgttccttacaccctacgtcccgtccggggacacgaaccttaccatacgaccacgaacctccctacaactaaaccacagcctacagtggtagttgaggacgccgtgacctatcgtagaccgacgaccgggtccttacttacttacgtcggtcgcggtaacgtaccgtccccgacgacgttcccgggtacggacgacccgtacggccgtacggccgggttaccttttcggtcgttccgggtacggggg

SEQ ID NO: 206393 - DNA, 532 bp, Homo sapiens
  misc_feature: GYAE6OF01BNQU7.17.25.C03.1.454.CMB.1.raw
  modified_base (291)..(291): a, c, t, g, unknown or other
  misc_feature (291)..(291): n is a, c, g, or t
  modified_base (409)..(409): a, c, t, g, unknown or other
  misc_feature (409)..(409): n is a, c, g, or t
  modified_base (418)..(418): a, c, t, g, unknown or other
  misc_feature (418)..(418): n is a, c, g, or t
  modified_base (466)..(466): a, c, t, g, unknown or other
  misc_feature (466)..(466): n is a, c, g, or t
  modified_base (492)..(492): a, c, t, g, unknown or other
  misc_feature (492)..(492): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgntggacaacgacctgagtggatgggatgggcaaccctaacacgtggtgtcacagtcgtcttcaccctatcccgtaccgggacagaccttaccatgaccacgacctcctaccaataaacncagcctaanatggattggagagctgactatcacgacgacacggtccttctaattacngtcgcgtagcgtacccgagctccggngcgcccgtacggcaggccgtacctttgcttcggtacgggg

SEQ ID NO: 206394 - DNA, 544 bp, Homo sapiens
  misc_feature: GYAE6OF01A85TI.17.25.C03.1.454.CMB.1.raw
  modified_base (291)..(291): a, c, t, g, unknown or other
  misc_feature (291)..(291): n is a, c, g, or t
  modified_base (429)..(429): a, c, t, g, unknown or other
  misc_feature (429)..(429): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgntggacaacgacctgagtggatgggatgggcgaaccctaacactggtgtcactaggtgtcttcacccatcccgtccgggacagacttaccatcgaccacgaactcctacaactaaacacagcctacatggattgacganccgtgacatctagacgacgacggtcctacttattactggtgacggagccgtacccgacggactccggtgacgccgtacggctacggccggtacctttgaccgttcggtaccgggg

SEQ ID NO: 206395 - DNA, 650 bp, Homo sapiens
  misc_feature: GYAE6OF01DQKTB.17.25.C03.1.454.CMB.1.raw
  modified_base (339)..(339): a, c, t, g, unknown or other
  misc_feature (339)..(339): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagccgtggggcctcagtgaaggtctcctgcaaggcttctggattcacgtttacctcctatagtatcaacgtgggtgcgccaggccgctggacaacgacctgagtggagtgggatcgggacgaacccctaanacgtggtcgtcactaggttcgtcttaccacccacgttcccgtacccggggactacgtaccttaaccagttacgaacccaaccgtaacctccctacctaataaaccacacgtacctacacgtgggtaagttggaacgggactcccgtagactacgtcgtacggaaccgaaccgtaccgggtcccgttacgttacttaccgtggtacggacgtacggtaccgtaccccacgggtacgtccggggtagaccggtacccgtacggaccgtacgggtacccggttccgtttttacgcccggttcggtaccgggggg

SEQ ID NO: 206396 - DNA, 632 bp, Homo sapiens
  misc_feature: GYAE6OF01BUUT5.17.25.C03.1.454.CMB.1.raw
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatcctccctgtctgcctctggtgggggtcagagtcaccatcacttgccggacagtcacggacttaaaactattaaatgtatcagcagaaacctggaaaacgcccagacctctgatctctggtgctactccactctgcgtaagtcggccgtccagtcgaggttcaggtcggctaggtggattcgtagggactaggtatttacgaaacttcctacaacctactccaacctactcctagtacccaaccgtggaaggtacttgtacgacgtaacttcctaacttacttacgtaacaacgtaggtaacgtttaccgacccgtttcccctacggttaccttaccggttttacggacccggtaacggggtaacccttaaaggttacggaagtaaccgttaacgaaaacccggttacgttacgggtacggtaccttacggaccctaacccgtacgttccgtcgtttacccg

SEQ ID NO: 206397 - DNA, 865 bp, Homo sapiens
  misc_feature: GYAE6OF01EIZGE.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagagccgtggggcctcagtgaaggtctcctgcaaggcttctggattcacgtttacctcctatagtatcaacgtgggtcgcgccaggccgcgtggaccaacggcctggagtggagtgggatcggggaccaaacccgtaacacgttggtcgtcgacgtaggttcgtccttccaaccccgtagttcccgtaccggggaactacgtaaccttaaccacgttaccgaaccctacgtaacccttcccgtaacccaaattaaaacccgacctaaccggtacccttaaacgtacgttacggggtaacggtttacggaacgggtaaccgtcccgtttaacggaacccgtacgttaccgttaacgggaaccccggtaacccggtaaccccggggttacccccgtttaacgtttaaaccgttttacccggttacgggtttaccgggaacccgggttaaaccgggttaacccgggttaacccccccgaacgggggtttaaacccggtttcccccggggggggttaacggtaaaccccggggttaacccccccgggtttaacccggggggaaccccgttaaccggggggttacccccccggggttttaaccccggttttttaccggggtaaacccccggggttttttccccggggtaacccccggggggggggg

SEQ ID NO: 206398 - DNA, 636 bp, Homo sapiens
  misc_feature: GYAE6OF01BHFO3.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagccgtggggcctcagtgaaggtctcctgcaaggcttctggattcacgtttacctctatagtatcaacgtggtgcgccaggccgctggaccaacggcctggagtgggagtggggagtcggggaccgaaacccctaacgacgttgggtcgtaccacgtagttcgttccttccgaccccacttcccgtaccgggaacacggtaaccttacccagtacgaacccacgtaacctccctaaccaactaaaccacaacgcctaacagtcgggtagttcggaaggacgcctaggactacgtctacggaacgaccgtaccgggtccgttacttacttacgtagtcggacgacggtaccgtacccgacgtcgtcccggtagaccggtcccgtacggcgtacggtccggtaccgtttcggtacccgttcggtaccggggg

SEQ ID NO: 206399 - DNA, 710 bp, Homo sapiens
  misc_feature: GYAE6OF01ESGD7.17.25.C03.1.454.CMB.1.raw
  modified_base (327)..(327): a, c, t, g, unknown or other
  misc_feature (327)..(327): n is a, c, g, or t
  modified_base (333)..(333): a, c, t, g, unknown or other
  misc_feature (333)..(333): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgttacctcctatagtatcaactgggtgcgcaggccgctggacaacgcctgagtggatgggatgggcaaccctaancgtggngtcacagtcgtcttacacccatcccgtacgggacagaaccttacagtcgaacccgaacgtaacctcccgtaccaactaaaacctaccaacggtaccccttaacaacgttaccggggtaagtttacggaacgggtacgtcccgtaggtaacacgtttcgaacgaacccggaaccgtaccgggggtaccccgttatttaacgtttaccggtaggtacgggaccggtaagggtaacccggttacccccgtaaacggggtaccgtttaccccgggggaggttaacccgggtaccccgggttaaacccggggacccgaacggggttccccgggttaaccccgtttttcgggaacccgtttcccgggggtaacccgggggggg

SEQ ID NO: 206400 - DNA, 589 bp, Homo sapiens
  misc_feature: GYAE6OF01C248X.17.25.C03.1.454.CMB.1.raw
  modified_base (346)..(346): a, c, t, g, unknown or other
  misc_feature (346)..(346): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttactcctatagtatcaactgggtgcgccaggccgcgtcggaacaacgaccgtgagtggagtgggatggggacgaaccctaacgacgtggtntcactagtgtcttcacccactccgtccgggacagaccttaccatcgaccacgtaacctcctaccaactaaacacacgacctacataggagttgaaggacgcctagacatctgaccgacgaccggtccgttactacttacgtacgtacggacgtacgtaccccgacgtacgtacccgggtgaccggtcccgtaccgggacacggtccggtaccgtttacgaccgtttcggtcgggggtacccgg

SEQ ID NO: 206401 - DNA, 578 bp, Homo sapiens
  misc_feature: GYAE6OF01CUPBF.17.25.C03.1.454.CMB.1.raw
  modified_base (280)..(280): a, c, t, g, unknown or other
  misc_feature (280)..(280): n is a, c, g, or t
  modified_base (428)..(428): a, c, t, g, unknown or other
  misc_feature (428)..(428): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacaacgacctgagtggatggggatggggaccgaaccctaacacgtggtcgtcacagttcgtcttacacccatcccgtccgggacagaccttaccatacgaccacgaacctcctaccaataaacacagcctaacntgggagttgaggacgtcctgaactatcgtagaccgacaccgggccttattacttactgtcgcgacgacgtcccgaaggtacgttcccgggagaccggtcccgtaagggcctaacgggccgggtcctttcggaccgtttcggtaccggggg

SEQ ID NO: 206402 - DNA, 685 bp, Homo sapiens
  misc_feature: GYAE6OF01CLF50.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagaagccgtggggcctcgagtgaaggtctcctgcgaaggcttcgtggattcacgtttacctctatagtatctaacgtgggtgcgccgaggtccgcgtacggaacaacgaccgtgaacggtgggactggggagttcggggacctaaacccgtaacgacgttggtcgtccgaacgtagtcgttaccttccgaacccacgttcccgtaccggggaacaacggtaaccttaccctagtaccggaacctaaccgaacctcccgtaaccaaacgtaaaccaacacgacctacagtagggagttacggaaggtacgccgtgactacgtcgtagaaccggacgaccggtcccgttacttaacgtttaacgtcgtacggcgaacggtcgtaccccgaaggtaccggttaccgggtacggaccggtacccgttacccgggacgtaccggtacccggttacccgtttcggtaaccgttcgggtacccggggg

SEQ ID NO: 206403 - DNA, 774 bp, Homo sapiens
  misc_feature: GYAE6OF01B1QMB.17.25.C03.1.454.CMB.1.raw
  modified_base (281)..(281): a, c, t, g, unknown or other
  misc_feature (281)..(281): n is a, c, g, or t
tcagcgtagactagcacgaccggtgctcgatttagtagtgtagatttggggtttgggggagtcagtctcagtcaggacacagcatggacatgagggtccccgctcagctccgtggggctcctgctactctggctccgagctgccagatgtgacatccagatgacccagtctccatcctccctgtctgcctcgtggtgggggtcagagtcaccatcacttgccggacaagtcacggtacgttaaactatttaattggtatcagcaagaaacctaggaaaacnccccagacctcctgactctcgtggtgcactccactcgtgacgtaaggtcggtccgtacccagttcggtacggtttcaggtggacgaggtggtactcggtggggaactaggtacttttacaaacttcctaccaaccctactaccaaccctacttaccgtacgaccctaaaccgttgggtaacggttacgtttacggtacgtaacctaacgtttacccttaacctttaaccgttacgttaaccgtaaacgtaacggttaaaccgtttaacccgttaaccccggttttaccccccgttaccgttacccgttttaaccgggtttttaccggggaaccccgggtaaaaccggggggttaaacccttaaaacgggtttaacgggtaaaccggttaaaccgttaaacccggaaaaacccggttaaccggttacgggttaaccgggtcccgttaacgggtacccctaaacccgttacgtttccggttacccggttttaccc

SEQ ID NO: 206404 - DNA, 558 bp, Homo sapiens
  misc_feature: GYAE6OF01EQW1N.17.25.C03.1.454.CMB.1.raw
  modified_base (280)..(280): a, c, t, g, unknown or other
  misc_feature (280)..(280): n is a, c, g, or t
  modified_base (343)..(343): a, c, t, g, unknown or other
  misc_feature (343)..(343): n is a, c, g, or t
  modified_base (440)..(440): a, c, t, g, unknown or other
  misc_feature (440)..(440): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacaacgacctgagtggatgggatgggacaaccctaacacgtggtgtcanagtgtccttcaccccatcccgtccgggacagtaccttaccatcgacccacgaacctccctaccaataaaccacaacgcctaacatggagttgaggancctgacatcagaccgacgacggtccgtactattactgtgcgagtacgtcccagtacgtccgggtagcgcccgtaacggccgtaacggccggtacctttggaccgttcggtaccggggg

SEQ ID NO: 206405 - DNA, 628 bp, Homo sapiens
  misc_feature: GYAE6OF01EYUW5.17.25.C03.1.454.CMB.1.raw
  modified_base (282)..(282): a, c, t, g, unknown or other
  misc_feature (282)..(282): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggtcttctggattcacgtttacctcctatagtatcaacgtgggtncgccaggccgcgtggacaacgacctgagtggagtgggatgggacaaccctaacacgtggtgtcacgtagtcgtcttccaccctactcccgtccgggacacgtaccttaccatacgacctaacgaacctcctaccaataaaccacaacgcctacgagtggagttaggacgtagccctagacctagtcgtaggaaccgaccgaccgggtccttacttaacgtttaaccgtggtcgacggtacgtacccgttacccgaacggtaccgttcccggggtagaaccggtcccgtaacgggccgtaacgggtcccggttaccgttttacggtaccgttccgggtaccgggggg

SEQ ID NO: 206406 - DNA, 627 bp, Homo sapiens
  misc_feature: GYAE6OF01DG5IC.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggagggtgaagaagccgtggggcctcgagtgaaggtcctcctgcaaggcttcgtggattcacgtttacctcctatagtatcaacgtgggtcgccgccgacggcccgcgtacggaaccaaccggaccgtggaggtggagtgggagtcgggacctaaccctaacgacgtggtgtacacgtaggttcgtcttaccaccctacgtcccgtaccgggactacgtacttaccagtaccgaaccaacgtaacctccctaacctaactaaacaccgtacgacctaacgagtgggtaggttagacggacgccgtagactatcgtacgaccgacgaccgggtccttacttacttacgtgtcgacgagaccgtacccgacgtcgtccggtcgacgtacccgtacggcgtacggtccgttccgtttacgcgttcgggcgggg

SEQ ID NO: 206407 - DNA, 566 bp, Homo sapiens
  misc_feature: GYAE6OF01AC5O1.17.25.C03.1.454.CMB.1.raw
  modified_base (282)..(282): a, c, t, g, unknown or other
  misc_feature (282)..(282): n is a, c, g, or t
  modified_base (333)..(333): a, c, t, g, unknown or other
  misc_feature (333)..(333): n is a, c, g, or t
  modified_base (449)..(449): a, c, t, g, unknown or other
  misc_feature (449)..(449): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagaagcctgggggcctcagtgaaggtctcctgcaaggcttctggattcacgtttacctcctatagtatcaactgggtncgccaggccgctggacaacgcctgagtggatgggatgggcgaaaccctaanactggtgtcacgagtgtcttaccaccctatcccgtccggggacacgaccttaccatcgacccacgaacctccctaccaataaaccacacgaccctaacagtcgggagttgaggacncctgactatcgtagaccgacgaccgggtcccgttattacttactggtcgcggagacgtccccgagtcgtccggtgacgccgtacggcacggccggtccgtttcgcgttcggtcgggg

SEQ ID NO: 206408 - DNA, 537 bp, Homo sapiens
  misc_feature: GYAE6OF01A6QIR.17.25.C03.1.454.CMB.1.raw
  modified_base (280)..(280): a, c, t, g, unknown or other
  misc_feature (280)..(280): n is a, c, g, or t
  modified_base (330)..(330): a, c, t, g, unknown or other
  misc_feature (330)..(330): n is a, c, g, or t
  modified_base (405)..(405): a, c, t, g, unknown or other
  misc_feature (405)..(405): n is a, c, g, or t
  modified_base (428)..(428): a, c, t, g, unknown or other
  misc_feature (428)..(428): n is a, c, g, or t
  modified_base (438)..(438): a, c, t, g, unknown or other
  misc_feature (438)..(438): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgcaggccgctggacaacgcctgagtggatgggatgggacgaaccctaanacgtggtgtcacagtgtcttcacccatcccgtcgggacagaccttacatcgaccacgaactcctaccaataaacncagcctaacatggagttgaggancctgacatcngacgacacggtccgtatacttacgtgtcgacgagtacgtccccaggacttcccgggagacgcccgtaggccacgccggtctttcggcgtttcggcgggg

SEQ ID NO: 206409 - DNA, 730 bp, Homo sapiens
  misc_feature: GYAE6OF01EIV69.17.25.C03.1.454.CMB.1.raw
  modified_base (246)..(246): a, c, t, g, unknown or other
  misc_feature (246)..(246): n is a, c, g, or t
tcagcgtagactagcacgaccggtgctcgatttagtagtgtagatttgggtttggggactcaacaaccacatctgtcctctagagaaaaccctgtgagcacagctccctcaccatggactggacctggaggatcctcttcttggtggcagcagctacaagtgcccactcccaggtgcagctggtgcagtcgtggggctgaggtgaagagccgtggggcctcagtgaaggtctcctgcaaggcttcnggtattctacgtttacctcctatagtatcaactgggtcgcgccgaggccgcgtcggaccaacgaccgtggaggtggagtgggagtcgggaccgaaccctaacgacgtggtgtacacgtacgtcgtctccaccctacgtcccgtaccggggaactacgtaaccttaccgacttaccgaacccgtacgtaaaccccttcccctaacctaaacgttaaaaacccacccgtaaccggtacccctaaacggtagtttacggggtaaacgggtttcggaacggggtccctaccgtacgggtaactaccggttacgtaacggaacccggaaccgtacccgggtaccctttacgttaactttacggtacggtccgaccggtaaggtaccccgtaacccgtacgggtaacccgttccgggtacggaaccggtccccggttaggccccggttaaggcccgggtttatttcccgggtacgttcgggtaccggggg

SEQ ID NO: 206410 - DNA, 652 bp, Homo sapiens
  misc_feature: GYAE6OF01CIW9X.17.25.C03.1.454.CMB.1.raw
  modified_base (333)..(333): a, c, t, g, unknown or other
  misc_feature (333)..(333): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacacgacctgagtggatgggatcgggccgaaaccctaanacgtggtctcaacgtagtcgtcttcaccctatcccgtcgggacacgtacttaccagtcgaccacgtaacctcctacctaactaaaccacacgtaccctaacgacgtaggtaagttggaaggtacgtcccgtagaacctagttcctacggaaccgtaaccggaaccggttcccgttacgtttaactttacgttcggtaccggaaccggtaggaacccgttccccaacgggtaccgttcccgggacggtaaccggccccgttaacgggccgtacgggtacccggttcccttttacggaccgtttccggggtaacccggggg

SEQ ID NO: 206411 - DNA, 655 bp, Homo sapiens
  misc_feature: GYAE6OF01BIJTZ.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagagcgtggggcctcgagtgaaggtctccgtgcaggcttctggattctacgtttacctcttatagtatcaacgtgggtgccgccgacgggccgtcgtacggaacaaccggacctggaacggtaggagtgggacgtacgggacccgtaaacccgtaacgtacgttggtacgtacacgtagtcgttccttaccacccgtacgttcccgtaccgggactacggtaccttaaccagtaccgaaccctaccgaaccttccctacctaaactaaaccacaacgtacctaactagtaggtagttcggaagtacgccgtagactacgtcgtacggaaccgacggaccggtaccgttacttaacgttcgtgtaccgagtaccgtaccgtacccgacgtaccgttccggagacccgtaccgtacggcgtacggcccggttacttcggccggttcggcgggg

SEQ ID NO: 206412 - DNA, 671 bp, Homo sapiens
  misc_feature: GYAE6OF01DXATH.17.25.C03.1.454.CMB.1.raw
  modified_base (266)..(266): a, c, t, g, unknown or other
  misc_feature (266)..(266): n is a, c, g, or t
  modified_base (283)..(283): a, c, t, g, unknown or other
  misc_feature (283)..(283): n is a, c, g, or t
  modified_base (287)..(287): a, c, t, g, unknown or other
  misc_feature (287)..(287): n is a, c, g, or t
tcagcgtagactagcacgaccggtgctcgatttagtagtgtagatttgggtttggggactcaacaaccacatctgtcctctagagaaaaccctgtgagcacagctccctcaccatggactggacctggaggatcctcttcttggtggcagcagctacaagtgcccactcccaggtgcagctggtgcagtcgtggggctggaggtgaagaagccgtggggcctcgagtgaaggtctcctgcaaggcttcgtggattcacgtttaccnctatagtatcactggtncgcnggccgcgtggacacgacctgagtggatgggatgggaccaacctaacgacgtggtcgtcacgagttcgtcttccaccctatcccgtaccgggaactacgtaacttaccgatacgaacccacgtaacctccctaccaacgtaaaccaacgacgtaccctaacgtacgtagggtacgttaggacgggtacgtcccgtagaactacgtccgtacggaacccggtaccgtaacccgggtacccgtttacgttaacgtttaccggtggttacggaccggtaggtaacccgttacccgaacggtcgttacccgggaagtaccggacccggttacgggacccgtaacgggtcccgggttaccgtttacggtaccgtttccgggtaccggggg

SEQ ID NO: 206413 - DNA, 792 bp, Homo sapiens
  misc_feature: GYAE6OF01EOSJT.17.25.C03.1.454.CMB.1.raw
  modified_base (279)..(279): a, c, t, g, unknown or other
  misc_feature (279)..(279): n is a, c, g, or t
  modified_base (290)..(290): a, c, t, g, unknown or other
  misc_feature (290)..(290): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaaggcttctggattcacgtttacctcctatagtatcaacgtggtncgccaggccgntggacaacgacctggagtggatgggatgggaccaaccctaacacgtggtgtcaacgagttcggtccttcaccccagttcccgtaccggggaacaggtaaccctttaccacgttaccgaaccctaaccgtaaacccttcccctacctaaaccgttaaaaacacccgaacgtaccccttaaacgtaacgttacggggtaacgtttacgggaacgggtaacgtaccccgttaggaaaccctagttaccgttaacggaacccggtaacccgtaacccggggtaccccggtttacctttaaacggtttaccgttacgggttacggaccgggtaaacccggtaccgggtttaacccccccgaaacgggttaccgggttcccccggggggttaaggtaacccgggttaccccccggttaacggggaccccggttaaaccgggtccccggggtttacccccttttttacgggtaaaccccggtttttcccgggggtaaccccgggggggg

SEQ ID NO: 206414 - DNA, 581 bp, Homo sapiens
  misc_feature: GYAE6OF01CN0VR.17.25.C03.1.454.CMB.1.raw
  modified_base (328)..(328): a, c, t, g, unknown or other
  misc_feature (328)..(328): n is a, c, g, or t
  modified_base (335)..(335): a, c, t, g, unknown or other
  misc_feature (335)..(335): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaggcttctggattcacgtttacctcctatagtatcaacgtgggtgcgccaggccgctggacacgacctgagtggatgggatgggcaaccctanactggtntcacagtgtcttcacccatccgtccgggacagacttaccatcgaccacgaactccctaccaactaaacacacgacctaacatcgggagttagacggacgcctagactactctcgaacgaccgaccggtccgtactaacttacgtagttcgcgtacggacgtcccgtaacggtacgtcccgggtgtaccgtacccgtaccgggcgtacgggtccggtcctttacggtaccgttcgggtacccggggg

SEQ ID NO: 206415 - DNA, 614 bp, Homo sapiens
  misc_feature: GYAE6OF01AYCZN.17.25.C03.1.454.CMB.1.raw
  modified_base (219)..(219): a, c, t, g, unknown or other
  misc_feature (219)..(219): n is a, c, g, or t
  modified_base (280)..(280): a, c, t, g, unknown or other
  misc_feature (280)..(280): n is a, c, g, or t
  modified_base (438)..(438): a, c, t, g, unknown or other
  misc_feature (438)..(438): n is a, c, g, or t
  modified_base (455)..(455): a, c, t, g, unknown or other
  misc_feature (455)..(455): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctnagtgaaggtctcctgcaaggcttctggattcacgtttacctcctatagtatcaactgggtncgccaggccgctggaccaacgacctgagtggagtgggagtgggaccgaaacccgtaacacgtggtctacacgtagtgtcttaccacccgatcccgtacgggactagaccttaccagtcgacccaacgaacctccctaccaataaacacagtccctaanatggagttggaggtacncgtacgactagtacgtagaccgtacgaccgggtccgttacttattacgtggtacgacggagtaccgtccccgtaacggacgttacccgggtagacggcccgttaacgggaccgtaacgggtcccggtaccgttttcgaccgtttccggtaaccgggggg

SEQ ID NO: 206416 - DNA, 621 bp, Homo sapiens
  misc_feature: GYAE6OF01EB872.17.25.C03.1.454.CMB.1.raw
  modified_base (450)..(450): a, c, t, g, unknown or other
  misc_feature (450)..(450): n is a, c, g, or t
  modified_base (455)..(455): a, c, t, g, unknown or other
  misc_feature (455)..(455): n is a, c, g, or t
tcagcgtagactagcacgaccggtgctcgatttagtagtgtagatttgggtttgggggtacggtacaaacgaaaccaacatccgtccgtccgtcttagaggaaaaccctgtggagcacagcctccgtcaccatggactaggacctggacgatcctcttcttggtggcaggcagctacgaagtgcccactcccaggtgcagctggtgcagtctggggctgaggtgaagagcctggggcctcagtgaaggtctcctgcaaggcttcgtggattcacgtttacctcctatagtatcaacgtgggtgcgccaggtcccgctggacaacggacctggaggtggaagtggggatggggacgaaacccctaacgaccgtggtctacgacaggtcgtcttcacccatccgtccgggacagacttaccatcgaccacgaacctccaccaataaacacancctanatggagttcgaaggacgcctacgactactcgtacgacgaaccgacgggtacccgttacttacgttaacgtgtcggacgacgaccggtacccacggtacgttcgggtacgacgacccgtacggccgacggcccggttaccgttttcggtaccgttcgggtaccgggg

SEQ ID NO: 206417 - DNA, 608 bp, Homo sapiens
  misc_feature: GYAE6OF01B726H.17.25.C03.1.454.CMB.1.raw
  modified_base (515)..(515): a, c, t, g, unknown or other
  misc_feature (515)..(515): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagagccgtggggcctcgagtgaaggtctcctgcaaggcttctggatttcacgtttacctcctatagtatcaactgggtgcgcaggcccgctgacaacgacctgagtggagtgggatcggggctaaacccgtaacaaccgtggttacgtacacgtaggttcgtctttacaccccgatacccgtcccggggaacagtaacctttaccatacggaccaaccgaaccttacctaccaactaaaccacaacgacctaacagtggagttaggaggtagcctagacatcgtagacgacgaccgtacgtactagttacngtcgcgtagtaccggtaccacggtactccgggtggaccgtccgtaccggtacgacggtcccggtaccgtttacgccgtttcggtacccggggg

SEQ ID NO: 206418 - DNA, 737 bp, Homo sapiens
  misc_feature: GYAE6OF01A1IVZ.17.25.C03.1.454.CMB.1.raw
  modified_base (244)..(244): a, c, t, g, unknown or other
  misc_feature (244)..(244): n is a, c, g, or t
  modified_base (281)..(281): a, c, t, g, unknown or other
  misc_feature (281)..(281): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcatctacaagtgcccactcccaggtgcagctggtgcagtctggggctgaggtgaagagccgtgggcctcagtgaaggtctcctgcaaggcttcgnggattcacgtttacctcttatagtatcaacgtgggtnccgcaggccgctggacaacgacctgaggtggagtgggatcgggaccgaacctaacacgtggtcgtacactacggttgtccgttaccacccctacgttcccgtcccggggaactacggtaacccttaaccgactacggaacccctaacggtaaccccttccccgttaaccaaaacttaaaacccaccctaaccggtacccttaaacctacgttacggggaagttttacgggaaacgggaccgtacccgtaggaacctagttcccgtaaggaacccgaaccggtaccggggtccccgttaacgttaacgtttaaccgtggtacccggtacggaccggtacccgttacccccgaacgggttcgttaccccggggacggacggttacccccggtagggaccccgtaacgggtccccggtttacccgttttacgggtaacccgtttcggggacccgggggg

SEQ ID NO: 206419 - DNA, 645 bp, Homo sapiens
  misc_feature: GYAE6OF01CFQR5.17.25.C03.1.454.CMB.1.raw
  modified_base (220)..(220): a, c, t, g, unknown or other
  misc_feature (220)..(220): n is a, c, g, or t
  modified_base (314)..(314): a, c, t, g, unknown or other
  misc_feature (314)..(314): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctggaggtgaagaagcgtggggcctnagtgaaggtctcctgcaaggtcttctggattctacgtttacctcctatagtatcaacgtgggtgcgccaggtccgcgtcggaacaaccgtaccnggagtgggagtggggatcgggaccgaacccgtaacgacgttggtcgtactacgagttcgtccttaccacccgtactccgtaccgggacacgtacttacatcgacctaacgacctacctacaactaaacacacgacctaacgtagtacgggtagttaggacggtacgccgtagaactacgtacgacgaaccggtacccgaccgggtacctacgttaacttacgtaggtacggtcgacggtaccgtacccgtacggtacgtacccgggtagtaccggacccgtaccgggacgacggtacccggttccgtttacggtcggttccggtaccgggg

SEQ ID NO: 206420 - DNA, 564 bp, Homo sapiens
  misc_feature: GYAE6OF01BGQD7.17.25.C03.1.454.CMB.1.raw
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatcctccctgtctgcctctgtggggtcagagtcaccatcacttgccggacaagtcacggacgttaaaacctatttaaattggtatcagcaagaaacctaggaaaacgccccagacctctgatctctggtgcatccactctgacgaagtcggcgtcccagtcgaggtcagtgcagtgatcgtggacagtatttcaatctacacactcacctactctcgacaacctgagtattgtagactaatctactactcgtacaacgagtacgttactaccgttcccctcgtcttacgtttcggacccgtaacggggtaacctaaagttacgaacgtaacgtaaccaaaacggtacgtacggtacggaccgtacgacctaacccgtaacttccgtcggttaccc

SEQ ID NO: 206421 - DNA, 671 bp, Homo sapiens
  misc_feature: GYAE6OF01A9YII.17.25.C03.1.454.CMB.1.raw
  modified_base (285)..(285): a, c, t, g, unknown or other
  misc_feature (285)..(285): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagaagccgtggggcctcagtgaaggtctcctgcaaggcttcgtggattctacgtttacctcctatagtatcaacgtgggtncgccaggccgcgtacggacaacgaccgtggaggtggagtgggagtcggggaccgtaaaccctaacgacgtggtcgtacgacgtagttcgttccttaccgacccctacgtcccgtacccggggaacaacggtaccttaccgaattccgaacccaaccgtaaccttccctaacaaacgtaaaccacgacgtacctaacagtaggtagttacggaggaccgtcctaggaacctacgtcgtaacgggaacctaaccggaccgggtaccttacttaacgtttacgcggttacgacggtaacgccgttaccccgagtacgttacccgggagtaccggcccgtacggaccgtacggtcccggttaccttttcggccgtttccgggaccggggg

SEQ ID NO: 206422 - DNA, 563 bp, Homo sapiens
  misc_feature: GYAE6OF01B2ZI7.17.25.C03.1.454.CMB.1.raw
  modified_base (278)..(278): a, c, t, g, unknown or other
  misc_feature (278)..(278): n is a, c, g, or t
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggtcgttaaaacctatttaaattggtatcagcaagaaacctggaaaacnccccagaccctcctgactctcgtggtgcactccactctgacgaagtggccgtcccatcgtaggttcaggtggctaggtggactcgtgggacagtatttcaatctacacatcacctactctgacaacgtgaggtattgcgactaatcttactactagtaccaacgtagtaacgttacctacgtttacccctcgtacttacgtttcggaccgtaggggtaaccctaaaggtcgaagtactaccaaacggtaccttaggtggactcgaccaacctcttcgttgttacc

SEQ ID NO: 206423 - DNA, 518 bp, Homo sapiens
  misc_feature: GYAE6OF01A6N85.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaacccctaacactggtgtcacagtgtcttcacccatcctccgggacagacttaccatgaccacgaactcctccataaacacagcctacatggagttgaggagcctgacatctgacgacacggccgtctattactgtgcgagagtccccacgactccggtgacgccctacggcaggcggcctttgccttcgtcgggg

SEQ ID NO: 206424 - DNA, 603 bp, Homo sapiens
  misc_feature: GYAE6OF01A9ADU.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagaagccgtggggcctcagtgaaggtctcctgcaaggcttctggattcacgtttacctcctatagtatcaactgggtgcgcaggccgctcggacacgacctgagtggatgggatgggcaaccctacactggtgtacacgagtgtcttccacccactccgtccggggacacggtaccttaccatacgaaccaaccgaacctccctaccaactaaaccaccagaccctaacaagttggtaggtttggaaggtacgcctaggaccagttcagaaccgaccgaccgggtccgttacttattacgtcggttcgaccggaagtaccgtccccgaacggtcttcccgggtagtaccttcccgtacgggctacggtcccggtaccgtttgtccgttcggtacggggg

SEQ ID NO: 206425 - DNA, 551 bp, Homo sapiens
  misc_feature: GYAE6OF01BHYP9.17.25.C03.1.454.CMB.1.raw
  modified_base (280)..(280): a, c, t, g, unknown or other
  misc_feature (280)..(280): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacaacgacctgagtggatgggatgggacaaccctaacacgtggtcgtcacagtgtccttcacccctatcccgtaccgggactagacttaccatcgaccacgaactcctaccaataaacacagcctacagtcggagttgaggacgcctagacatcgtagaccgacaccgggtccttactattactgtacgacgagtacgtcccgacgctccgggtgacgccgtacggcacggccgtacctttgccgttcggtacgggg

SEQ ID NO: 206426 - DNA, 610 bp, Homo sapiens
  misc_feature: GYAE6OF01CWO1O.17.25.C03.1.454.CMB.1.raw
  modified_base (311)..(311): a, c, t, g, unknown or other
  misc_feature (311)..(311): n is a, c, g, or t
  modified_base (340)..(340): a, c, t, g, unknown or other
  misc_feature (340)..(340): n is a, c, g, or t
  modified_base (465)..(465): a, c, t, g, unknown or other
  misc_feature (465)..(465): n is a, c, g, or t
tcagcgtagactagcacgaccggtgctcgatttagtagtgtagatttgggtttgggagtcagtctcagtcaggacacagcatggacatgagggtccccgctcagctccgtggggctcctgctactctggctccgagctgccagatgtgacatccagatgacccagtctccatccctccctgtctcgtcctcgtggtgggggtcaggacgtccacctatcctacgttcgacccggaacaacggtccaaccgggtaacgtttaaaaaccttatttaaattggtaatcagacaaacgaaaccgtaaggaaaacnccccaagaccctctgactcgtcgtggtcncactcctactcgcgacgtagtcggccctaccacgtcggtacggttcgaggtggacaggtgattcggaggactagtacttacaatccacacctactaccacctactctacgacctacgaggtagtnttagcactaatcctactacgtacgtacaagtacgtaacgttacctaccgttccctacgtactttaccggttcggaccgtaacgggaacctaaagtagacgtaactaacgaaacgtcgtgtacgctacgactactctcgtcgtacc

SEQ ID NO: 206427 - DNA, 550 bp, Homo sapiens
  misc_feature: GYAE6OF01A0485.17.25.C03.1.454.CMB.1.raw
  modified_base (338)..(338): a, c, t, g, unknown or other
  misc_feature (338)..(338): n is a, c, g, or t
  modified_base (417)..(417): a, c, t, g, unknown or other
  misc_feature (417)..(417): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctgggggcctcagtgaaggtctcctgcaaggcttctggattcacgtttacctcctatagtatcaactgggtgcgccaggccgctggacaacgacctgagtggatgggatgggcgaaccctacactggtntcacagtgtcttcacccatcccgtaccgggacagaccttaccatcgaacccacgaacctccctaccaataaaccacacncctacagtgggagtttgagagtcctagacatctgaacgacacggtcgtcttatacgtgtacgcgacggacgtcccacgtcgtaccgggtgacgcccgtaaggctacggccggtacctttgaccttggcggggg

SEQ ID NO: 206428 - DNA, 623 bp, Homo sapiens
  misc_feature: GYAE6OF01CH6C3.17.25.C03.1.454.CMB.1.raw
  modified_base (292)..(292): a, c, t, g, unknown or other
  misc_feature (292)..(292): n is a, c, g, or t
  modified_base (334)..(334): a, c, t, g, unknown or other
  misc_feature (334)..(334): n is a, c, g, or t
  modified_base (360)..(360): a, c, t, g, unknown or other
  misc_feature (360)..(360): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggcccgngtggacaacgcctgagtggatgggatgggaccgaaccctaanacgtggtgtcacagtgtcttcacccntccgtccgggacacgtacttaccatacgaccacgaacctccctaccaactaaaccacacgaccctaacacgtagggtacgttaggaaggacgaccgtggactacgtccgtacggaaccggaccgtaccgggtcccgttacgttaactttaccgttggtacggcggtagaccggtccccgaacggtaccgttccgggtcggaaccggtcccgtaccggcgtacgggtccgttccgtttacggtccgtttccgggtaccgggggg

SEQ ID NO: 206429 - DNA, 706 bp, Homo sapiens
  misc_feature: GYAE6OF01BOGSD.17.25.C03.1.454.CMB.1.raw
  modified_base (233)..(233): a, c, t, g, unknown or other
  misc_feature (233)..(233): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagccgtgggcctgagtgacggtctccgngacgaggtcttcgtggtacttcgtaccgtttacctccttaatagtactacaacgtggtcgccgccgaggccgcgtacggaaccaacggtacctggaggtacggagtaggggactacgggaccgtaaacccgtaacgtacgttgggtactaccaacgtacggttcgttacccttaccgaccctacgttcccggtaccgggtaacctaacggtacccttaaccgacgttaccgaacccgtaaccggtaacccttcccgtaaccgtaacgtaaaccaccgtaccgtacccttaacgagttacgggacgtttacggacggtacgtcctagacctacgtcgacgaaccgacgtaccggtaccgttacgttagttacgtcggtacgacggtacgaccgtacccgtagtccgttaccgggacgtaccggtcccgtacggaccgtcgggtaccgtaccgtttcggccgttcggtacccggg

SEQ ID NO: 206430 - DNA, 650 bp, Homo sapiens
  misc_feature: GYAE6OF01BRXUK.17.25.C03.1.454.CMB.1.raw
  modified_base (248)..(248): a, c, t, g, unknown or other
  misc_feature (248)..(248): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctggtgcagtcgtgggctgaggtgaagagcgtggggcctcgagtgaaggtctccgtgcaaggtcttcgnggattctacgtttacctctatagtatcgaacgtgggtcgcgccgaggccgcgtaggaaccaacgaccttggacggtggagtcgggagtcgggaccgtaaacccgtaacgacgttgggtacgtaccgacgtacggttcgttacccttaccgaccccgtaacgttcccgtaacccggggactacggtaccctttaaccgagttaccgaacccaaccgtaacctacccgtacctaactaaaccaacacgacctacgacgtacgtagtaggaggacgtaccgtacgactacgtacgtacgaccgacgaccggtacgtacttactacgtcgtcgacgtacgtacgtaccgtacgcgtccggagcgaccgtacgacgtttttacgcgtacgttcgtcgttcggtcggg

SEQ ID NO: 206431 - DNA, 835 bp, Homo sapiens
  misc_feature: GYAE6OF01CNFHX.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcgttggtggcagcagctacaagtcgcccactcccaggtgcagctggtgcagtcgtggggctggaggtgaagagccgtggggcctcgagtgaaggtctcctgcaggtctctggtattctaccgtttacctcctatagtatcaacgtgggtgccgccaggcccgtcgtaggaacaaccgacctggagtgggatggggatcggggacctaaacccgtaacaccggttgggtacgtaccaacgtacggtttcgttacctttcccgaaccccgttacgttcccccggtacccgggggtaacaaaccgggttaaccctttaaacccgaacgtttaccgggaaaccccctaaccggtaaacccctttaccccctaacccctaaaacgttaaaaaccccaacccgtaaacccggtaccctaaaccgtaggtttacgggggaaacggttttacgggaaaccggggtacggtaccccgtagggtaaccctaagttcccgtaacgggtaaacccgacccggtaacccggggtcccgttaaccgtttaaacgtttacccgttagggtaccggtacggtaacgggtacccgtaccccgtaaaccggtaccggttaccccgggttagggtaacccggtaccccggtaaccgggccgtaaccgggttccggttaccgttttccggtaaccggtttccgggtacccggggggg

SEQ ID NO: 206432 - DNA, 606 bp, Homo sapiens
  misc_feature: GYAE6OF01ADD1I.17.25.C03.1.454.CMB.1.raw
  modified_base (241)..(241): a, c, t, g, unknown or other
  misc_feature (241)..(241): n is a, c, g, or t
  modified_base (289)..(289): a, c, t, g, unknown or other
  misc_feature (289)..(289): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctgaggtgaagagcctggggcctcagtgaggtctctgcaggcttcgnggattctacgttacctcctatagtatcaagtgggtgcgccgaggccgngtcggacaacgcctggacgtggagtgggatcggggaccaaaccctaacgtacgtggtagtcacgtagttcgtcctaccaccctcgtcccgtccgggactacgaccttacagtcgaccacgtaactcctacactaaccacacgtacctacagtcggtagttagacgggactccctaggactcgtcgtaggacgtaccgtaccgggtccttactaacttacgtcggtacgaccggtacgaccgttacccacggtccgtacgggtcggtacgccccgtaaggccgtacggttcgtaccgtttcgccgttcgggaccgggg

SEQ ID NO: 206433 - DNA, 793 bp, Homo sapiens
  misc_feature: GYAE6OF01BUFAO.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagagcctggggcctcagtgaaggtctcctgcaaggcttctggattcacgtttacctcctatagtatcaacgtgggtgcgccgaggcccgctggacaacgacctggagtggagtgggagtcggggaccgtaaacccgtaacgacgtgggtacgtacacgtaggttcgtccttaccaacccctacgttccccgtacccgggggaactacggtaaccctttaacccgaacgttaccgaaccccgtaaccggtaacccttacccccgttaacccgaaacttaaaaacccacccgtaaaccgtaccccttaaaccgtaaggttaccgggtaaggtttacgggaacgggaaccggtaccccgttaggaaccctacgttaccgttaacggaaccccggtaaccggtacccggggtaccccgttacgtttaacgtttaaccggtacggtcggaccggtaacgggtaacccgttaccccccggaacgggtaccggttacccggggtaggaacccggtccccggttaaccgggcccggtaacgggttcccgggttaccccgtttttacgggtaacccggtttccggggtacccgggggg

SEQ ID NO: 206434 - DNA, 573 bp, Homo sapiens
  misc_feature: GYAE6OF01DQZQX.17.25.C03.1.454.CMB.1.raw
  modified_base (282)..(282): a, c, t, g, unknown or other
  misc_feature (282)..(282): n is a, c, g, or t
  modified_base (454)..(454): a, c, t, g, unknown or other
  misc_feature (454)..(454): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaaggcttcgtggattcacgtttacctcctatagtatcaacgtgggtcncgccaggccgctggacacgacctgagtggatgggatcggggacgaaccctaacacgtggtagtcacgtagttgtccttccaacccctatcccgtccgggacacgtacttaccatcgaccacgactccacaataaacacacgctacagtggagttgaggagtcccgtagactntctaggacgaccgacgggtccttacttaactttacgtgtcgcgtacgacgttccccgaagtacgtccggaggccgaccgtacggctacgggccgttccttttgccgtttcggtacgggg

SEQ ID NO: 206435 - DNA, 558 bp, Homo sapiens
  misc_feature: GYAE6OF01DK1GF.17.25.C03.1.454.CMB.1.raw
  modified_base (278)..(278): a, c, t, g, unknown or other
  misc_feature (278)..(278): n is a, c, g, or t
  modified_base (301)..(301): a, c, t, g, unknown or other
  misc_feature (301)..(301): n is a, c, g, or t
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatcctccctgtctgcctctggtgggggtcagagtcaccatcacttgccggacaagtcacggacgttaaaacctatttaaattggtatcagcaagaaacctaggaaaacnccccagacctctgatctctggtncatccactctgacgaagtggcctccatcgagttcagtggcaggtgatcgtggacagtactttcaattctacaccataccacctactctcgacaaccgtggaagtattgtgactaactctacttactcgtacaacgtacgtacgttacctaccgttcccctcgtactacgttttcggacccgtaacggggtaactaaacggttagaacgtactaacgaaacgtacgttagtcggactcgaccacctactcgttgtacc

SEQ ID NO: 206436 - DNA, 513 bp, Homo sapiens
  misc_feature: GYAE6OF01EQV88.17.25.C03.1.454.CMB.1.raw
  modified_base (292)..(292): a, c, t, g, unknown or other
  misc_feature (292)..(292): n is a, c, g, or t
  modified_base (405)..(405): a, c, t, g, unknown or other
  misc_feature (405)..(405): n is a, c, g, or t
  modified_base (420)..(420): a, c, t, g, unknown or other
  misc_feature (420)..(420): n is a, c, g, or t
  modified_base (447)..(447): a, c, t, g, unknown or other
  misc_feature (447)..(447): n is a, c, g, or t
  modified_base (479)..(479): a, c, t, g, unknown or other
  misc_feature (479)..(479): n is a, c, g, or t
tcagcgtagactagcacgaccggtgctcgatttagtagtgtagatttgggtttgggggactcaacaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagaagcctggggcctcagtgaaggtctcctgcaaggcttctggattcacgtttacctcctatagtatcaatgggtgcgccaggccgntggacaacgacctggagtggatgggatgggcgaacccacgactggtgtcagagtgtcttcaccctatcctcgggacagactacatgaccacgactcctcataacacagcctanatggagttgaggtancctagaccatctgacgacacggccgtntattacgtgtgcgagcgtcccacgatccgggngcgctacggctaggcggtcctttgcttgtcgggg

SEQ ID NO: 206437 - DNA, 521 bp, Homo sapiens
  misc_feature: GYAE6OF01BLXGO.17.25.C03.1.454.CMB.1.raw
  modified_base (421)..(421): a, c, t, g, unknown or other
  misc_feature (421)..(421): n is a, c, g, or t
  modified_base (481)..(481): a, c, t, g, unknown or other
  misc_feature (481)..(481): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctcgggacagacttaccatgaccacgaactcctaccataaacacagcctacatggagttgagncctgacatctgacgacacggtcctctacttactgtcgcgagacgtcccacgacttccggngacgccgtacggctaggccggtcctttgccttcggcgggg

SEQ ID NO: 206438 - DNA, 649 bp, Homo sapiens
  misc_feature: GYAE6OF01AQKC9.17.25.C03.1.454.CMB.1.raw
  modified_base (241)..(241): a, c, t, g, unknown or other
  misc_feature (241)..(241): n is a, c, g, or t
  modified_base (277)..(277): a, c, t, g, unknown or other
  misc_feature (277)..(277): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaggtctcctgcaggcttntggattctacgtttcctctatagtatcaactgggtncgcaggccgctggacacgacctggagtggatggggagtgggaccaaccctaacgacgtggtcgtacacgtacgttcgtcctccacccgtactcccggtaccgggacacgtaccttaccagtaccgacctaaccgtaaccttcccgtaaccaataaaccacgaacgtaccctaataggtacggtaaggttacggaacggtcgtacccttaggactacgtcgtacgaaccgtaccgaccgggttccttacttacgttacgtgtacgacgacgtaccgtaccccacggtacgtcccgggtaggtaacccgtcccggtaacgggccgtaaccgggttccggttacccgttttagacccggtttcggggaccggggg

SEQ ID NO: 206439 - DNA, 536 bp, Homo sapiens
  misc_feature: GYAE6OF01ALUET.17.25.C03.1.454.CMB.1.raw
  modified_base (407)..(407): a, c, t, g, unknown or other
  misc_feature (407)..(407): n is a, c, g, or t
  modified_base (434)..(434): a, c, t, g, unknown or other
  misc_feature (434)..(434): n is a, c, g, or t
  modified_base (466)..(466): a, c, t, g, unknown or other
  misc_feature (466)..(466): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacacgacctgagtggatgggatgggccgaaccctaacgacgtggtgtcacgagtgtcttcacccatcctccgggacagacttaccatcgaccacgacctcctccaataaaccncacgccctaacagtggagttgaggacncctgacatctgacgacacggtcctctattacngtgcgagcgtcccagtctccgggtgacgcccgtaggctacggccggtcctttggaccgttcggtacgggg

SEQ ID NO: 206440 - DNA, 533 bp, Homo sapiens
  misc_feature: GYAE6OF01DW828.17.25.C03.1.454.CMB.1.raw
  modified_base (341)..(341): a, c, t, g, unknown or other
  misc_feature (341)..(341): n is a, c, g, or t
  modified_base (430)..(430): a, c, t, g, unknown or other
  misc_feature (430)..(430): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctaggacaacgacctgagtggatgggatgggacgaaccctaacacgtggtntcacagtgtcttcacccatcctccgggacagacttaccatcgaccacgaactcctaccaataaacacagacctacatggagttgaggancctgacatctgacgacacggtcgtctattacgtgtgtgagcgtcccacgcgtccggtgacgccgtacggactacggccggtcctttggccgttcggtacgggg

SEQ ID NO: 206441 - DNA, 552 bp, Homo sapiens
  misc_feature: GYAE6OF01BA2GY.17.25.C03.1.454.CMB.1.raw
  modified_base (423)..(423): a, c, t, g, unknown or other
  misc_feature (423)..(423): n is a, c, g, or t
  modified_base (434)..(434): a, c, t, g, unknown or other
  misc_feature (434)..(434): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggccgaaaccctaacactggtgtcacagtgtcttcacccactcctccgggacagacttaccatcgaccacgactcctccaataacacagcctacatgagttgagngcctgacatcngaccgacgaccggtccgtacttattacctgtcgcgaggaccgtcccgacgtcgtcccgggtagacgacccgtacggccgacggccgggttaccttttcggccgtttcggtaccggggg

SEQ ID NO: 206442 - DNA, 711 bp, Homo sapiens
  misc_feature: GYAE6OF01DRO78.17.25.C03.1.454.CMB.1.raw
  modified_base (291)..(291): a, c, t, g, unknown or other
  misc_feature (291)..(291): n is a, c, g, or t
tcagcgtagactagcacgaccggtgctcgatttagtagtgtagatttgggtttgggggagtcagtctcagtcaggacacagcatggacatgagggtccccgctcagctccgtggggctcctgctactctggctccgagctgccagatgtgacatccagatgacccagtctccatcctccctgtcctgcctcgtggtgggggtcagagtcaccatcacttcgaccggacagtccacggtacctttaaaactatttaaacttggtactcagacgaagaaacctaggaaaaccncccaagtacctcctgactccgtcgtggtcgccactccacttcgtacggacgtaaggtcggccgtaccccaggtcgtaggttcgaaggtggactaggtcggtaattccggtagggtaactagttaactttacgaaaccttcttaaccgaacctactacccaaccctacttaccgtacgtaacccgtaaccgtagtaacgtacgtttagtactacctaattaccttaacttaccgttaacgtactaaacgtacggttaaccgtttacctacccggtttcccctacgtaccgtttaccggtttcggaacccgggtaacggggtaaaccttaaaggttagaaacgtaccgttaaaaccggaaacgttaaccgttggtaccggtaccctacggtaaccctacggtttactccgttcgtttacccc

SEQ ID NO: 206443 - DNA, 672 bp, Homo sapiens
  misc_feature: GYAE6OF01AZX8D.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagaagccgtggggcctcagtgaaggtctcctgcaaggcttctggattcacgtttacctcctatagtatcaacgtgggtgcgccaggccgctggacaacgcctggagtcggagtgggagtgggaccgaaaccctaacgacgtggtgtccaacgagttgtcctccaccccgtactcccgtaccgggacacgtaccttaccagtacgaccaacgtaacctaccgtaccaactaaaccaccacgacccttaacagtacgggtagttacggagggacgtacccgtgaacctagttccgtaacggaaccgaccggtacccgggtccctttaacgttaacgtttaccgtgggttacgaccggtacggtacccgttacccccgaggtaccgttcccggggttacggacccgtacccggttacgggcctaacgggcccggtttcccttttcggaacccgtttcgggtacccgggggg

SEQ ID NO: 206444 - DNA, 757 bp, Homo sapiens
  misc_feature: GYAE6OF01EBK8A.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctggtgcagtcgtgggctggaggtgaagacgccgtgggcctgagtgaaggtctctgcaggtcttcgtggtacttccgtacgtttacctcttaatacgtataccgaacggttcgggtcgccggccgacggggtcccgtcgtacggaacccgaaccggtaccgtggtaacggtggtaggttggggtaagtaccggggaaccctaaacccgtaacgacggttagggtccgtacgaacgtacggttcgttaccttacccaacccgtacgtcccgtaaccgggaactaacgtaacccttaaccgaagtaccggaaccctaaccgtaacccttaccctaacctaaactaaacccaacgtaacctaccgtaaacgaggttacgggtagttaacgggacggtaccaccgtacgactcgttacgcggaaccgtaccggaccggtccgttacttacgttacgtggtaacggccgtacggtacccgttaacccgacggttaccggtaccggtacggacccggtaccggtaccggtacggtacccggtaccgtttaccggtttacgtaccggttcgggggtaacccgggg

SEQ ID NO: 206445 - DNA, 873 bp, Homo sapiens
  misc_feature: GYAE6OF01EAJM4.17.25.C03.1.454.CMB.1.raw
  modified_base (248)..(248): a, c, t, g, unknown or other
  misc_feature (248)..(248): n is a, c, g, or t
  modified_base (291)..(291): a, c, t, g, unknown or other
  misc_feature (291)..(291): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctggaggtgaagagccgtgggcctcgagtgaaggtctcctgacaaggtcttcgnggattctacgtttacctctaagtagtactacgaacgtgggtcnccgtccgacgggcccgtcgtacggaaccaacggtaccgtggacggttgggagtggggtagtcgggacccgtaaaccccgttaaacgcggttcggtacgtaccgacgtacggttcgttcctacccgaccccgtacgttccccggtacggggtaaccacggtaacctttaaccgaacgttaccggtaaaccccgaaacgttaaacccctccccgttaaaccctaaacttaaaaacccgaccgtaaccgtaacccgttaacgaacggtttacggggtaaacgtttacgggaaacgggttaccggtaaccccttaaggtaacccgttacgttaccggttaccgggaaaacccggtacccgggaccccgggtttacccgtttacgtttaaccgtttaccggtacgggtaccgtaaccggggaaccggttaacccgtacccccgggtaaacgggttacccgtttacccgggggtacggtaaccccgttacccccgggtttaacccgggaccgggtaccgggtttacccccgggtttacccgggtttttacccggtaaccggttttcccgggggtaacccccggggggg

SEQ ID NO: 206446 - DNA, 720 bp, Homo sapiens
  misc_feature: GYAE6OF01BFJGA.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggggctggaggtgaagaagccgtggggcctcagtgaaggtctcctgcaaggcttcgtggattcacgtttacctcctatagtatcaacgtgggtcgcgccgaggccgcgtggaccaacgcctggagtggagtgggagtcgggaccgtaaacctaacacgttggtcgtaccacgtacggttcgttccttaccaacccgtacgttaccccggtaccggggaacctacggtaaccctttaaccgacgttaaccggaacccaaccgtaaaccctcccttaacccgaaacttaaaccaccacgtaccctaacgagttcgggtagttaggacggtacgcctagaacctactttccgaaggaacccgaaccgacccgggttcccgttacttacgttaccgtacggtaaccggacgtacccggtaccccgaacgtaaccggttccgggtaggaccggtaccccggtaacgggccgtaacgggttcccggttacccttttacgggtaacccgtttcggggtccgggggtaaccccggg

SEQ ID NO: 206447 - DNA, 629 bp, Homo sapiens
  misc_feature: GYAE6OF01B5LJI.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagaagccgtggggcctcagtgaaggtctcctgcaaggcttctggattcacgtttacctcctatagtatcaacgtggtgcgccaggccgctggacaacgacctggagtggagtgggagtcgggaccgaaaccctaacacgttggtcgtccaacgtacgtgttccttcgacccctactcccgtaccgggacacgtaccttaccactcgaacccacgtaacctccctaccaactaaaccacacgaccctaacgagtgggtagttgaggacgcctagacacttcgtacgaacgaccgaccgggtccgttacttagttaccgtggtacgacgaacggtaccgtaccccgacggtacgtcccgggtacggacggtacccgtacggccgacgggtcccggttacccgtttcggtccgtttcgggtccggggg

SEQ ID NO: 206448 - DNA, 576 bp, Homo sapiens
  misc_feature: GYAE6OF01AW18N.17.25.C03.1.454.CMB.1.raw
  modified_base (279)..(279): a, c, t, g, unknown or other
  misc_feature (279)..(279): n is a, c, g, or t
  modified_base (327)..(327): a, c, t, g, unknown or other
  misc_feature (327)..(327): n is a, c, g, or t
  modified_base (408)..(408): a, c, t, g, unknown or other
  misc_feature (408)..(408): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaaggcttctggattcacgtttacctcctatagtatcaactgggtncgccaggccgctggacaacgcctgagtggatgggatgggccaacctanactggtgtcacagtgtcttcgaccctatcccgtaccgggacagtaccttaccagtcgaccacgaactcctaccataaaccncacgacctaacagtcggagttgacggacgccctagacatcgtaggaaccgacaccgggtcttacttaagttaccgtgtcgacgacgtacgtccccaaggtcgtcccgggagaccgtacccgtagggcctacggccggttaccttttcggcctttcgggtacccggggg

SEQ ID NO: 206449 - DNA, 548 bp, Homo sapiens
  misc_feature: GYAE6OF01EVJIO.17.25.C03.1.454.CMB.1.raw
  modified_base (434)..(434): a, c, t, g, unknown or other
  misc_feature (434)..(434): n is a, c, g, or t
  modified_base (447)..(447): a, c, t, g, unknown or other
  misc_feature (447)..(447): n is a, c, g, or t
  modified_base (454)..(454): a, c, t, g, unknown or other
  misc_feature (454)..(454): n is a, c, g, or t
  modified_base (510)..(510): a, c, t, g, unknown or other
  misc_feature (510)..(510): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggaacaacggacctggagtggagtgggatcggggaccgaaaccctaacgacgtggtcgtacacgtagtcgtccttccacccctatcccgtcgggacacgtacctacatcgaaccacgaacctccacaataaacacagcctanagtggagttgagnccagacntcgcgacgacgacggtcctctattcgtgtcgcgacgacgtcccacgcgtccggganccgccgtaggcacgggtccgtccttggcgttcggcggg

SEQ ID NO: 206450 - DNA, 557 bp, Homo sapiens
  misc_feature: GYAE6OF01E5PID.17.25.C03.1.454.CMB.1.raw
  modified_base (445)..(445): a, c, t, g, unknown or other
  misc_feature (445)..(445): n is a, c, g, or t
  modified_base (469)..(469): a, c, t, g, unknown or other
  misc_feature (469)..(469): n is a, c, g, or t
  modified_base (492)..(492): a, c, t, g, unknown or other
  misc_feature (492)..(492): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggagtatcctcttcttggtggcagcagctacaagtgcccactcccaggtgcagctggtgcagtcgtggggctggaggtgaagaagcctggggcctcgagtgaaggtctcctgcaaggcttctggattcacgttttacctcctatagtatcaacgtgggtgcgccaggccgctggacaacgcctgagtggatgggatcgggacctaaacccctaacacgtgggtcgtcaacgtaggttcgtccttccacccctagtcccgtccgggaacacgtaccttaaccatacgaccaacgaacctcctacaataaacacacgcctanagtggagttgagcgcctgacatcngacgacgcggtccttactattcngtagcgagccgtaccagcgtcggagcgccgtacgcgacggtcgtaccttcgccgttcggtacggg

SEQ ID NO: 206451 - DNA, 569 bp, Homo sapiens
  misc_feature: GYAE6OF01DEG9W.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgactgagtggatgggatgggacgaaccctaacgactggtgtcactagtcgtcttcaccctagtcctaccgggacacgtacttaccatcgaccacgaactcctacactaaacacagacctacatgggattgagtacgcctgacatcgagacgacgcggtccttactattactgtcgacgagacgtccccgaacggtacttcccgggtagacggccccgtacgggacctacgggcccgggttcccttttggaccgtttcgggtaccgggggg

SEQ ID NO: 206452 - DNA, 761 bp, Homo sapiens
  misc_feature: GYAE6OF01CGPEF.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagagccgtggggcctcagtgaaggtctcctgcaaggtcttcgtggattcacgtttacctcctatagtatcaacgtgggtgccgccgaggcccgcgtcggaacaacgaccgtgaggtggagtgggacgtcggggaccgtaaaccctaacgacgtgggtacgttaccaacgagttcgtacctttacccgaacccctaacgttccccgtaccgggggaacctaacggtaacctttaacccgaacgtccgaaaccccgaaccggtaaacccttccctaacccctaaactaaaacccgaacctaacggtacccctaaaccgtaaggtacggggtaaggtttacggaaacggggtacgtacccgttagaacctacgttcgtaaccggaaccgaaccggaacccgggttacccgtacttaacgttaccgtggtaccggtcggtaacggtaccgttaccccgtaacgggtaccgttacccgggtacgtaccggacccggtaccgggaccgtaccgggtcccgggttacccgtttacggtacccggtttccgggtacccgggggg

SEQ ID NO: 206453 - DNA, 733 bp, Homo sapiens
  misc_feature: GYAE6OF01AZBVT.17.25.C03.1.454.CMB.1.raw
tcagcgtagactagcacgaccggtgctcgatttagtagtgtagatttgggtttgggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgtctaaggcttctggattctacgtttacctcctatagtatcaacgtggtgcgacgagccgctggacaacgactgagtcggagtgggagtgggaccgaacccgtaacgacgtcggtgtaccgacgtagttgtaccgttaccacccgtaagttcccggtaccgggtaacgtacgtaaccgttaaccgacttacggaaccctaacggaaccttcccgtacgaaaccttaaaaccgacctaacggtacccttaaagtacgttagggaaacgttttgggaaccggtacggtacccgttaaggtacctaacgtttacgacggttaaaccgaacccggtaccggggttacccctttacttaaacgtttacccgtacgttaccgggacgtaaccgggttaccgtacccccgtaacggtaaccgggttcccggtaaggtacgtaccccggtaacgggaccgacgggttcccgggttaccttttacggaaccgttttccgggaccgggg

SEQ ID NO: 206454 - DNA, 656 bp, Homo sapiens
  misc_feature: GYAE6OF01AM82M.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacacgcctggagtggatgggatgggacaaccctaacacgtggtcgtcacgagtcgtcttcaccctatcccgtccgggacagtaccttaccatcgaccacgaacctcctaccaataaaccaccacgtaccctaacgagtacgggtacggtttaggaacgggtacgtcccgttacggaacctagttacccgtaggaacccggtaaccgaccgggtacccgtttacgttaacgttttaccgtaggttcggaccggtagtacccggttacccccgaacggtaccgttacccgggtaggaccgtaccccggtacggaccgtacgggtcccggttaccgtttccggtacccgttcgggtacccggggg

SEQ ID NO: 206455 - DNA, 556 bp, Homo sapiens
  misc_feature: GYAE6OF01A7VOG.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagccgtggggcctcagtgaaggtctcctgcaaggcttctggattcacgtttacctcctatagtatcaactgggtgcgccaggccgctggacaacgacctgagtggatgggatgggacgaaccctaacgactggtgtcactagtgtctcaccctatccctccgggacacgacttaccatacgacctaacgaacctcctacaactaaacacacgacctaacagtacgggtagttagaggacgcctagacagtcgtagaccgacgacggtccgtacttatactgtcgcgagtacgtcccgacgtcgtccggagaccgccgtacggcagccggtaccttcgtcgtcggtcgggg

SEQ ID NO: 206456 - DNA, 624 bp, Homo sapiens
  misc_feature: GYAE6OF01EDOHU.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagaagcctggggcctcgagtgaaggtctcctgcaaggcttctggattcacgtttacctcctatagtatcaactgggtgcgccaggccgctggacaacgcctgagtggatgggatgggacgaaaccctagactggtgtacacgagtgtcttccaccctatcccgtccgggacacgtaacttaccagtcgaacccacgaactcctaccaataaaccacaacgtacctacaagtagggagttaggaacggagtccctagaaccatcgtacgaaccggaccgtaccgggtccgttacttaacttaccgtaggtacggacgtaacggtacgtaccccaacggtacgtcccggggtacgtacggaccccgttacggccgtaacggtcccgggtacccttttaggacccgtttcgggtaccgggggg

SEQ ID NO: 206457 - DNA, 777 bp, Homo sapiens
  misc_feature: GYAE6OF01B2DVA.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctggtgcagtcgtgggctggaggtgaagaagccgtggggcctcgagtagaggtctccgtgcgaaggtcttcgtggattcctacgtttacctctatagtatcaacgtgggtcgccgccgagggcccgtcgtacggaaccaaccgtaccgtaggtaggtgggagtaggggacgtcggggaaccgtaaaacctaacgtacggttggtacgtactacgtagttcgtaccttaccaaccccgtacgttcccgtaccggggtacctacggtaacctttaaccagttaccgaaccctaacgtaacccttaccctaacctaaactaaacccaacctaacggtacccctaaacgtaggttagggtaacggtttacggaacgggtacgacccgttaaggaaccctattccggaacggaacccggtaccgtaaccccgggtccgttaacgtttaacgttacccgtggtaccggaccggtaacggtcccggttaaccccgacggtacccggtacccggggtaggacccggttaccccgtaccggggaccgttaccggggtccccggtttacccgttttcgggacccggttttccggggtaacccgggggg

SEQ ID NO: 206458 - DNA, 653 bp, Homo sapiens
  misc_feature: GYAE6OF01BE3Y5.17.25.C03.1.454.CMB.1.raw
  modified_base (230)..(230): a, c, t, g, unknown or other
  misc_feature (230)..(230): n is a, c, g, or t
  modified_base (281)..(281): a, c, t, g, unknown or other
  misc_feature (281)..(281): n is a, c, g, or t
  modified_base (309)..(309): a, c, t, g, unknown or other
  misc_feature (309)..(309): n is a, c, g, or t
  modified_base (549)..(549): a, c, t, g, unknown or other
  misc_feature (549)..(549): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctggaggtgaagaagccgtgggcctgagtgaggtcnccgtgcaggcttctggattcacgtttacctctatagtatcaacgtgggtcncgcaggccgctggacacgctgagtggangggatacgggacgtaaccctagtacgtggtctacacgtgtcgtcttccaaccagtcccgtacggggactaaggtaccttaccgaagttaccgaaccctaacggtaccctaccctaaccgtaaactaaacccgaccaacggtcccttaaacgagtacgggtaacgttggaacggtacgtcctaggaaccagttacgacggaaccgtacccgaacccgggtccgtttaactacgtttaacgnggtacgacggacgttacccggtaccccaaggtcccgttacgggacgttaccgccccgtaacggtcgagggttcccgttacgtttcgaccgttcgggtaacgggg

SEQ ID NO: 206459 - DNA, 525 bp, Homo sapiens
  misc_feature: GYAE6OF01BLZZ0.17.25.C03.1.454.CMB.1.raw
  modified_base (280)..(280): a, c, t, g, unknown or other
  misc_feature (280)..(280): n is a, c, g, or t
  modified_base (404)..(404): a, c, t, g, unknown or other
  misc_feature (404)..(404): n is a, c, g, or t
  modified_base (426)..(426): a, c, t, g, unknown or other
  misc_feature (426)..(426): n is a, c, g, or t
  modified_base (452)..(452): a, c, t, g, unknown or other
  misc_feature (452)..(452): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacacgacctgagtggatgggatgggcgaaaccctaacacgtggtgtcactagtgtcttcacccatccgtcgggacagacttacatcgaccacgaactcctacaataaacncagcctacatggagttgagacncctgacatctagacgacacggccttntacttacgtgtgcgagtacgtcccaggtactccggtagcgcctacggcacggccgtccttgccgttggcgggg

SEQ ID NO: 206460 - DNA, 544 bp, Homo sapiens
  misc_feature: GYAE6OF01BL9BP.17.25.C03.1.454.CMB.1.raw
  modified_base (379)..(379): a, c, t, g, unknown or other
  misc_feature (379)..(379): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagaagcctggggcatcagtgactgtctcctgcaaggccagtggatatatcttacaacaaaatatggtatgaattggggtgcgacgacgggccccggagaagggcttggaggtggggtggggtgggtcaggcggctttggacggtaggcacgagtatgcacgaagagtagaagggnagagtcacgatacgacgaccaccccacgaacacagtctacatgacaacgtgacgacgccctagagagctagacgacgaccggtccgtctattacgtgtcgacgtagtacgttgttttctgtctacgttacgttaacgtaacgtttagaattacggtctgttacgg

SEQ ID NO: 206461 - DNA, 649 bp, Homo sapiens
  misc_feature: GYAE6OF01DGX4Z.17.25.C03.1.454.CMB.1.raw
  modified_base (291)..(291): a, c, t, g, unknown or other
  misc_feature (291)..(291): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctggaggtgaagagccgtggggcctcagtgaaggtctccgtgcgaaggtcttcgtggtattctaacgttttacctcttatagtatcaacgtgggtcncgcctaggcccgcgtaggaccaacgaccgtggacggtggacgtgggagtcgggacctaaacccgtacacgttaggtcgtaccacgtagttcgttaccttaccgaccctactcccgtaccgggtacacgtaccgttaccagtacaacccgacgaaccctctacccaaactaacacacgtacctagtagtaggagttaggacgtagccgtagactagtacgtagaaccgaacgtcccgggtccttactaacgtttacgtggtacggacgtaacggtaccgtacccgaggtaccgtcgggtgaacccggccgttaccggcggaacggttcccggacttttcggacgttcggggtaccgggg

SEQ ID NO: 206462 - DNA, 590 bp, Homo sapiens
  misc_feature: GYAE6OF01EZGR4.17.25.C03.1.454.CMB.1.raw
  modified_base (437)..(437): a, c, t, g, unknown or other
  misc_feature (437)..(437): n is a, c, g, or t
  modified_base (495)..(495): a, c, t, g, unknown or other
  misc_feature (495)..(495): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagaagccgtggggcctcgagtgaaggtctcctgcaaggcttctggattcacgtttacctcctatagtatcaactgggtgcgccaggccgctggaacaacgacctgaggtggagtgggatcgggacgaaccctaacgacgtggtgtcacgtagtgttccttacaccctactcccgtccgggacacgtaaccttaccagtcgacccacgaacctcctacaataacacacgactanagtgtagttagagacgctgacagtctacgacgaccgaccgggtccttattacttacgngtcggacgaacggtaccgtacccgacggtacgttcccggtagacgtcccgtacggaccgtacggcccggttactttcggacgttcgggaccgggg

SEQ ID NO: 206463 - DNA, 701 bp, Homo sapiens
  misc_feature: GYAE6OF01DB4JJ.17.25.C03.1.454.CMB.1.raw
  modified_base (581)..(581): a, c, t, g, unknown or other
  misc_feature (581)..(581): n is a, c, g, or t
  modified_base (628)..(628): a, c, t, g, unknown or other
  misc_feature (628)..(628): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggactcctcttcgttggtggcagcagctacaagtgcccacttcccgaggtgcagctggtgcagtcgtgggctgaggtgaagagccgtggggcctcagtgacgtctcctgcaggcttctggattcgacgtttacctctattagtatctaacgtgggtgcgccgaggcccgtcgtcggaccaacgacctgacggtggagtgggagtcgggaccgaaaccctaacgacgtggtacgtaccgagtaaggttcgtaccgttaccacccgtagttcccggtaccgggactacggtaccttacccgacgttacgaaccctaacgtaacccttccctaaccgaaattaaacccgactaaccgtccttaaacgagtacgggaggtttagaacgggtactccgtaagaactacgttacgtacgaaccggtacccgaccgggtccttaacttaagtttacccgnggtacgtacgacgtcccggtacccaacgggtacgttcccgggttaanccggttcccgtaaaccgggtcctacgggttccccgttcccgttttacggtaccgtttccggggtacccggggg

SEQ ID NO: 206464 - DNA, 692 bp, Homo sapiens
  misc_feature: GYAE6OF01ARI4A.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagaagcctggggcctcagtgaaggtctcctgcaaggcttctggattcacgtttacctcctatagtatcaactgggtgcgccgaggcccgcgtggaaccaacgtacctggaggtggagtgggagtcggggaccgtaaaccctaacgacgttgggtcgtaccgtacgagttcgtccttaccaccccgtactcccgtacccggggaccacggtaccttaaccagttccgaacccgtacgtaaccctccctacccaaactaaaccaaccaacgtaccctaactacgtagggtacgtttagggaacggtacgccgtagaacctattccgtagaacccggtacgacccgggtccgttacgtttaacgttaccgtaggttcggaccggtaaggtacccgttacccgaacggtaccggttcccggtaggtaccgacccggtaccgggccgtacggtccccggttactttacggttaccggttcgggtacccggggg

SEQ ID NO: 206465 - DNA, 548 bp, Homo sapiens
  misc_feature: GYAE6OF01AWWT3.17.25.C03.1.454.CMB.1.raw
  modified_base (331)..(331): a, c, t, g, unknown or other
  misc_feature (331)..(331): n is a, c, g, or t
  modified_base (356)..(356): a, c, t, g, unknown or other
  misc_feature (356)..(356): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggacaaccctaanactggtgtcacagtgtcttcacccntcctcgggacagacttaccatcgaccacgaacctcctaccaataaaccacacgcctacatggagttggagagcctgactatcgtgacgacacgggtccgttactattaccgtgtgcgtagacgtcccgaggtacgtccggtagacgcccgtacgggcctacggccggtacctttggaccgttcggtacgggg

SEQ ID NO: 206466 - DNA, 770 bp, Homo sapiens
  misc_feature: GYAE6OF01ALWKL.17.25.C03.1.454.CMB.1.raw
  modified_base (300)..(300): a, c, t, g, unknown or other
  misc_feature (300)..(300): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctggaggtgaagagccgtggggcctcgagtgaaggtctccgtgcaggtcttcgtggacttctacgtttacctctatagtatcaacgtgggtgccgccgaggcccgngtcggacaacgcctggagtggagtgggagtcgggacctaaaccccgtaacgacgtgggtctaccgacgtacgttcggttaccttaccgaaccccgtacgttaccccggtaccggggaactacggtaacccttaacccgacgttaccggaaccccgtaacccgtaacccttaccccgtaacctaaacgtaaacccacccgtaaccgtaacccgttaacgtaacggttacggggtaacggtttacgggaaccgggtaaccgtacccggtacgtaaccgtaccgtaccgtaccgggaaacccgtacccggtaccccgggtacccgtttaccttaacgttaccgtacggtcggtacccggaagtaccccgtaccccgtaacggtaccggttacccgggacggtccgtacccggtaccggtaccgtaccggttccccggttaccgtttcgggtacccgttggggtaccccggggg

SEQ ID NO: 206467 - DNA, 698 bp, Homo sapiens
  misc_feature: GYAE6OF01EVXJD.17.25.C03.1.454.CMB.1.raw
  modified_base (215)..(215): a, c, t, g, unknown or other
  misc_feature (215)..(215): n is a, c, g, or t
  modified_base (463)..(463): a, c, t, g, unknown or other
  misc_feature (463)..(463): n is a, c, g, or t
tcagcgtagactagcacgaccggtgctcgattttagtagtgtagatttgggtttggggtacgtcaacaaccacagtctcgtcctcctaggagaaaccctgtgagtcactagctcctcaccatggactggacctggaggatcctcttcgttggttgggcagcgagcttacagtacccacttcccgtaaggtgcagtctggtgcagtcgtgggctgngggtgagagcctggggcctcggagtcgaaggtctcctcgcaggtcttcgtggtacttcgaccgttttaccctccctttaatacgtaacttcaacgttcgggtcgacgtccgacggccgcgtgacgacggaccgtgaggtggagtgggatgggcgaacctacgcgtggtgtcacgtagtgtcttaccacctctcccgaccggacacggtacttaccgatcgaccgactaacctccctaccgataaaccnctaacgaccctaccgaagttaccggaagtttggacggtactacccgttgaactacgtactaacggacgttacgacccggtaccgttgtaaacgttccgtacggtacgaccggttacgttacccggtaccccgtaagtaccgggtaccggttaggaaccgtcccgggttaaacgggcccttaacgggtcccggtttacccttttagggaccccgttttccggggcggggtacccgg

SEQ ID NO: 206468 - DNA, 739 bp, Homo sapiens
  misc_feature: GYAE6OF01EA7T1.17.25.C03.1.454.CMB.1.raw
  modified_base (247)..(247): a, c, t, g, unknown or other
  misc_feature (247)..(247): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagccgtggggcctcgagtgaaggtctcctgcaggcttcnggattcacgtttacctcctatagtatcaacgtgggtgcgccaggccgctggacaacgcctgagtggatgggagtcgggaccgaacccctaagacgtggtacgtcacgtagtcgtccttaccaaccccgtattcccgtacccggggacacgtaccttaacccgagtacgaacccaaccgtaacccttcccgtaaccaattaaaacccaccgtacgtaaccctaagtacggttcgggtaacgtttacggaaacgggacggttacccctaggtaaaccctacgttaccggtaaccggtaacccgggaacccgtacccggggtacccctttaacgtttaacgtttaacccgttgggtacggtacggaaaccgggtacccgttaccccgtaacgggtaccttaacccgggtacgttcggaacccgggtaccccgtaacccgggtaccgtaaccgggtcccgggtttacccttttacggcccggtttaacccgggggg

SEQ ID NO: 206469 - DNA, 549 bp, Homo sapiens
  misc_feature: GYAE6OF01A01WL.17.25.C03.1.454.CMB.1.raw
  modified_base (463)..(463): a, c, t, g, unknown or other
  misc_feature (463)..(463): n is a, c, g, or t
  modified_base (470)..(470): a, c, t, g, unknown or other
  misc_feature (470)..(470): n is a, c, g, or t
  modified_base (500)..(500): a, c, t, g, unknown or other
  misc_feature (500)..(500): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacacgacctgagtggatgggatgggcgaaccctaacacgtggtgtcacagtcgtcttcacccatccctccgggacacgtacttaccatcgaccacgaacctccctaccaataaaccacagccctacagtcggaagttggagagcctgacatctgacgacgacggtcctntattacngtcgcgagtacgtcccacgacgtcccgggngacggccgtacggcctacggccggtcctttcggccgttcggtacggggg

SEQ ID NO: 206470 - DNA, 683 bp, Homo sapiens
  misc_feature: GYAE6OF01CR2A5.17.25.C03.1.454.CMB.1.raw
  modified_base (340)..(340): a, c, t, g, unknown or other
  misc_feature (340)..(340): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggaccaaccctaacacgtggtntcacaggttcgtcttccacccatcccgtccgggacacgtacttaccatacgaccaacgtaacctcctaccaataaacacacgaccctaacagttcgggagttggacggacgtcccttaggaacctattccgtacggaccggtaacccgtaaccggggtcccctttagttaaccgttttaacgtcgggttaggccggtaaaccggtaccggttacccccgtaaaccgggtaccgtttccccggggttacggaaacccggtaccccggttaacccggggaccggtaaccgggccccgggtttacctttttacgggaaccccgttttcggggtaacccgggggggg

SEQ ID NO: 206471 - DNA, 532 bp, Homo sapiens
  misc_feature: GYAE6OF01EEL8D.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacggacctggagtggatgggatgggcgaaaccctaacgactggtgtcacgagtcgtctcacccatcctcgggacagactaccatcgaccacgaactcctccaataaacacacgcctacatggtagttgagagcctgacatctgaccgacgaccggtcctctattacgtgtcgcgagacgtcccacgcgtcgggtagcgcctacggcgacggcggtccctttgccgttggtcgggg

SEQ ID NO: 206472 - DNA, 787 bp, Homo sapiens
  misc_feature: GYAE6OF01CLNLR.17.25.C03.1.454.CMB.1.raw
tcagcgtagactagcacgaccggtgctcgatttagtagtgtagatttgggtttgggggaccatatttggactcaactctcttgtccaccttggtgcagtctggggctgaggtgaagaagcctggggcctcagtgaaggtctcctgcaaggcttctggattcacgtttacctcctatagtatcaactgggtgcgccaggccgctggacaacgcctgagtggatgggatgggcgaaaccctaacactggtgtcacagtgtcttcaccatccctccgggacagaccttaccatcgaccacgaactcctaccaataaaccacagcctaacagtggagttgaggagcctagacatctgaaccgacgaccggtccgttactacttacgtgtcggacgtacggacgtcccccaacggacgttcccgggtgaccggtaccccgttaaccgggccgaacggggtccccgggttacccgttttcggaacccgttttccggtacgggggggccccgtaacgggggacccgggttacccccgttgggttacccgtaaccccggttccgaacccggttaccgtaacggtccctttaaccccgaaaccccggtaaacccgggggtcccccttaacgtttcccccgggttaccccctttcccccccggtacgggtcccccgtcccccgttcggaccccttaccccggaacgggtacccgtacccgtaacccccgttcccgggaaacggacccgacccgaaacccgacccgggtcccccccggtccccgggtcggggtccccg

SEQ ID NO: 206473 - DNA, 627 bp, Homo sapiens
  misc_feature: GYAE6OF01BGAQV.17.25.C03.1.454.CMB.1.raw
  modified_base (333)..(333): a, c, t, g, unknown or other
  misc_feature (333)..(333): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagccgtggggcctcagtgaaggtctcctgcaaggcttctggattcacgtttacctcctatagtatcaacgtgggtgcgccaggccgctggacaacgcctgagtggatgggatcgggacaaccctaancgtggtcgtcacagttgtccttacacccctatcccgtccgggaacacgtaaccttaccagtcgaaccctaacgaaccttccctacaactaaacacctaacgaccctaacagttacgggagttcggacggtacgccctagactatcgtacgacgaccgcgggtcccttacttacgttacctggttcgaccggtacgtaccggtaccccgaacgtaccgtccgggtagaccgccccggttaacgggccgtacggtcccgggttacccgttttggacccggtttcggtaccgggggg

SEQ ID NO: 206474 - DNA, 568 bp, Homo sapiens
  misc_feature: GYAE6OF01AW5PM.17.25.C03.1.454.CMB.1.raw
  modified_base (241)..(241): a, c, t, g, unknown or other
  misc_feature (241)..(241): n is a, c, g, or t
  modified_base (432)..(432): a, c, t, g, unknown or other
  misc_feature (432)..(432): n is a, c, g, or t
  modified_base (527)..(527): a, c, t, g, unknown or other
  misc_feature (527)..(527): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgagtctcctgcaaggcttcnggattcacgtttacctcctatagtatcaactgggtgcgccaggccgctggacaacgcctggagtggagtgggatgggaccgtaaccctaacgacgttggtcgtacacgagtcgtcttccaacccctatcccgtaccgggactagacttaccatcgaccacgaacctcctacaataaaccacagtaccctanagtggagttggagacgtcctagactatcgtagaaccgacgtaccggtccgttactacttacgtggtcgacgagtccgtacccagtacgtccgggnacgccgtacgcacggtccggtacctttgaccgttggcgggg

SEQ ID NO: 206475 - DNA, 686 bp, Homo sapiens
  misc_feature: GYAE6OF01BOI04.17.25.C03.1.454.CMB.1.raw
  modified_base (243)..(243): a, c, t, g, unknown or other
  misc_feature (243)..(243): n is a, c, g, or t
  modified_base (280)..(280): a, c, t, g, unknown or other
  misc_feature (280)..(280): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctggtgcagtctggggctgaggtgaagagcctggggcctcagtgaaggtctcctgcaaggcttntggattcacgtttacctcctatagtatcaactgggtncgccaggccgctcggacaacgacctggagtggagtcgggatcgggacgaaccctaacaccgtgggtgtcacgagttcgtccttcacccgtacgtcccgtacgggactacgtaccttaaccagtacgaccaacgtaaccttccctaccgaacttaaaccacaacgtacctaacagtgggtaacttaggacggtaacgtcccgtagaacctacgttcgtacgaaccgaaccgaccgggtcccgttacgttaacttaaccgttggtaccggacggtaaacgacccggttaccccgaacggtaccggtttacccggggtcggaaccggttcccccgtaacggggcccttaacggggtccccgggtttaccgtttttaccgggtaaccggttttcccggggaccggggggg

SEQ ID NO: 206476 - DNA, 615 bp, Homo sapiens
  misc_feature: GYAE6OF01CBQ5W.17.25.C03.1.454.CMB.1.raw
  modified_base (240)..(240): a, c, t, g, unknown or other
  misc_feature (240)..(240): n is a, c, g, or t
  modified_base (383)..(383): a, c, t, g, unknown or other
  misc_feature (383)..(383): n is a, c, g, or t
  modified_base (430)..(430): a, c, t, g, unknown or other
  misc_feature (430)..(430): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctgggctgaggtgagaagcctgggcctcagtgaaggtctcctgcaaggcttntggattcacgtttacctcctatagtatcaactgggtgcgccaggccgctggacacgacctggaggtggagtggggatcggggaccgaaacccctaacgacgttgggtgtcacgagtgtccttcaccccatcccgtaccggganagaccttacatcgaccacgaactccaccaataaaccacacgcctaanagtggagttgaggacgtcctgaccatcgtacggaccgaacgtaccgggtacccgttacttaagttaccgtgtcgtacggaacgtacccggtacccgaacggtcgttcccggggttaagcccggtaccccgtacggacgtacggtaccccggtacgttttccggtaacgttccgggtaccgggggg

SEQ ID NO: 206477 - DNA, 652 bp, Homo sapiens
  misc_feature: GYAE6OF01EW4TD.17.25.C03.1.454.CMB.1.raw
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgaccaagtctccatcctccctgtctgcctctgtgggggtcagagtcaccatcacttgccggacaagtcacggacgttaaaacctatttaaattggtatcagcaagaaacctaggaaaacgcccagaccctctagatctcgtggtcgcatcccactctgacgaaggtcgccgtcccagtcggaggttcaggtggctaggtggactcggtagggacaaggtatttcaattcctaccacctatcccaacctactctacgaccaaccgtgacggtattggtcgactaacgtctaactacttagtaccaaacgtacggtaacttacccgtaccgttttacccccgtacggttaccctttaaccggttttacggggaaccccggtaaagggggtaaaccccttaaaagggttacggaacgttaaccgtaaaccgtaaaacggtacgttacggtacgggcccttaacggaccctaaacccgttacttaccgttcgttacccg

SEQ ID NO: 206478 - DNA, 707 bp, Homo sapiens
  misc_feature: GYAE6OF01BKJ4S.17.25.C03.1.454.CMB.1.raw
  modified_base (280)..(280): a, c, t, g, unknown or other
  misc_feature (280)..(280): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagagccgtggggcctcagtgaaggtctcctgcaaggcttctggattcacgtttacctctatagtatcaagtgggtnccgccgaggccgacgtggaaccaacgtaccgtgacggtggagtgggagtcgggaccgaaacccctaagaccgtggtacgtacctaacgagttcggtctttaccgacccctattccccggtaccgggaccaacgtaccttaacccagtaccgaaccctaaccgtaaccttacccgttaccaacttaaaaccgacaaacgtaccctaacgtagtacgggaacggtttaggacggtaacgtacgtacgactaacgtcgtaacggaaccgaaccgaccggttacccgttctttaaacgttaccgtcggtacggaccggtacggtaacccggtaccccgtaacggtaccggttaccgggagggtacccgtacccggtaccgggctaccggggtcccgtaccggtttacggtacccgttcgggtacccggggg

SEQ ID NO: 206479 - DNA, 614 bp, Homo sapiens
  misc_feature: GYAE6OF01AW1IY.17.25.C03.1.454.CMB.1.raw
  modified_base (443)..(443): a, c, t, g, unknown or other
  misc_feature (443)..(443): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactggtgcgccaggccgctggacaacgacctgagtggatgggatgggacgaaccctaagacgtggtgtcacgagttgtcttccacccatcccgtaccggggactagaccttaccatcgaccacgtactcctaccaataaaccacacgcctaacagtggagttggaaggacncctagacattcgacgaccgaccgtaaccggccgttacttagttaccgtggtacgacggtacgaccgtaccccgaacggtaccggttcccgggtacggaaccggtcccgttaacgggccgtacgggtcccgggttacccgttttacggtacccggtttcggtacccgggggg

SEQ ID NO: 206480 - DNA, 643 bp, Homo sapiens
  misc_feature: GYAE6OF01DBV1Z.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagaagcctggggcctcagtgaaggtctcctgcaaggcttctggattcacgtttacctcctatagtatcaactgggtgcgccaggtcgctgacaacgacctgagtggagtgggatgggaccgaaccctaacgacgtggtcgtcacagtcgtcttcaccctatcccgtccgggactacgacttaccatacgaccacgaacctcctaccaactaaacacacgacctaacagtagggtagttacggacgggacgtcccgtagacctacttcgtacggaaccggtaaccgtacccgggtcccgttacttaacgtttaccgtaggtcggaccggtacgacccggtacccgaacggtacggttcccgggtaggaccggtacccgttaaccgggaccgtacgggtcccggttacccgttttcggtaccgtttccggggtaccggggg

SEQ ID NO: 206481 - DNA, 549 bp, Homo sapiens
  misc_feature: GYAE6OF01BOYH3.17.25.C03.1.454.CMB.1.raw
  modified_base (506)..(506): a, c, t, g, unknown or other
  misc_feature (506)..(506): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggagtgggatgggacaaccctaacacgtggtgtcacagtcgtcttcacccatcctccgggacacgtacttaccatcgaccacgaactcctaccaataaacacagcctaacagtaggagttagaggacgcctagacacgtctgaaccgaccgaccggccgttactattacgtgtcgcgagacgtacccagtacgtcggngcgccgtacggcacggtccggcctttcggcgttcggtacgggg

SEQ ID NO: 206482 - DNA, 869 bp, Homo sapiens
  misc_feature: GYAE6OF01CQFNY.17.25.C03.1.454.CMB.1.raw
  modified_base (189)..(189): a, c, t, g, unknown or other
  misc_feature (189)..(189): n is a, c, g, or t
tcagcgtagactagcacgaccggtgctcgatttagtagtgtagatttgggtttgggagtcagtctcagtcaggacacagcatggacatggacgggtccccgctcagctccgtggggctcctgctactctggctccgagctgccagatgtgacatccagatcgaccctagtcctccactcctccctgtcngtcctgtggtggggtacaggatcaacctatccacgttcggacccgggaactaacggtccgtaaccgggtaaacctttaaaaaccttaagttttaaaagttgggtaactcgaaggacctaaacggtaaaaacctacggggaaaaacctccccgaaggtaccccttaccggtataaccgttcctaccggtgggtcacctaacttcccgtaacgttcgtacggacgggttaaacgtcccgggtaacccgttccccgaaggttcgtacggggtttacgaggttacgggactaagggttcggaaacgtttcccgggaaggggtaactaacggttactttttaacgaaaccgttccgtaaccaacccgtaactacccttaacccgaccttacgtaccgaaacccgtaacgttaggggtaacgtttaacggtcgtaccggtaaactaacctttaaccgtaacctaccgtttagggaaacctaaacggttacggtaaccgttaaccccgtaccgggttttaacccccctggttaaacccgttttcccgggttacgggaaacccccggggtaaggggttaaacccgtaaacgggtttaccggaaagtaacccggttaaaccggaaacggtaacgtttcgggtacggtaacctccggtaaactacccggttattacccggttcttaaccg

SEQ ID NO: 206483 - DNA, 961 bp, Homo sapiens
  misc_feature: GYAE6OF01CR47X.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctggtgcagtcgtggggctggaggtagaagaacgtccgtgggggcctcgaggtaggaacgggttcctcccgtggacgtaacgggtcctttcgtagggtacttttccgtaacccggtttttaaccctaccttaagttaacgttaacttaccgtaaaccggttggggtcgcccggaccccgaggggccccggtaccggttacgggaaacctaaacccggtaccgttagggacggttaggggtaaggttcgggggtaaaggttccgggggaaacccgtaaaaccccgttaaaccgtaacggttgggtacgtacccgaacgtaggttccgttaccctttacccaccccgttacgtaccccgtaccggggaactaacggtaaccttaacgtacgtaccggaaccctaacggtaaccctacccttaaccaaacttaaaacccgaaccgtaaccgtacccttaaacgtaacggttacgggtaaacgggtttacggaacgggtacccgtaccggttaacgtaaccgttaccgttaccgttaaccgggaacccggtaacccgggttacccgggttacccgttttaaccgttaacgttttaaccggtgggtacccgggtaaaccggtaacccgggttaaacccgtaccccggtaaacggttaaccgggttccccggggtaacggtaaccccgggtaccccggttaaccggggtaccgttaaccggggtttaccccgggttacccggtttttacccgggtaacccggtttcccgggggggtaaccccgggggg

SEQ ID NO: 206484 - DNA, 560 bp, Homo sapiens
  misc_feature: GYAE6OF01BDE0O.17.25.C03.1.454.CMB.1.raw
  modified_base (282)..(282): a, c, t, g, unknown or other
  misc_feature (282)..(282): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagccgtggggcctcagtgaaggtctcctgcaaggcttctggattcacgtttacctcctatagtatcaacgtgggtncgccaggccgctggacaacgacctgagtggagtgggatgggacaaccctaacacgtggtgtcgacgtagtgtccttcaccctatcccgtccgggacagtaccttaccatcgacctacgaacctcctaccaactaaaccacacgcctacatggtattggagacgcctagacatctacgacgacacggtccgttacttacttactggtcgacgacgaccgtacccgacgacgtccgggagacgccgtacggcacggccgtacttcgtcgttcggccgggg

SEQ ID NO: 206485 - DNA, 873 bp, Homo sapiens
  misc_feature: GYAE6OF01ENSSM.17.25.C03.1.454.CMB.1.raw
  modified_base (693)..(693): a, c, t, g, unknown or other
  misc_feature (693)..(693): n is a, c, g, or t
tcagcgtagactagcacgaccggtgctcgatttagtagtgtagatttgggtttggggactcaacaaccacactgtctctagagaaacctaacgtgagcacacgctcctccaccaactggtacgtacgaccgtcggaggagtccttcctttcgtttggtggcagcgagactacaagtcgcccacctcccaggtggcagcgtggtgcagtcgtggggcgtgaggtaggaacgaagccgtcggggccgtctaggtaggtaaggtccttccctggacgaacggtccgttttcttagggatttaccgttaccgttttaaccccgttcctaagtttaagtaacgttaccaaccgttgggggtggccgacccgaacgggccggtccgttacgggaaccgaaaacccgtaaccggttggaggggttaggtaacggtacgggggtagtaccgggaacccggtaaaaaccccttaaaaccgtacggttgggttacggtaccaaaccgtaaggtttcggttccctttacccaaaccccgtacgttcccccggtttacccggggaaacgtaaacttaaccccggtttaacctaagttacccggaaaccccgtaaaccccgtaaccttaccccttaaccccaaattaaaacccaacccgaacgtaccctaaaccgtaggttaacgggtaggttaaggcgggaaccnccgttacgaactaccgtgtaccgaaccggaaccggacccggtaccggtttaccttaagttaccggttggtaacggcggaaacggtacgtaccccgaaacgtccggttaccgggtacgtacgacccggtaccgaggaccggtccggttaccgttacgtacggttccggcggggaacccggg

SEQ ID NO: 206486 - DNA, 709 bp, Homo sapiens
  misc_feature: GYAE6OF01C049V.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagaagccgtggggcctcgagtgaaggtctcctgcgaaggcttctggattctacgtttacctcctatagtatcaacgtgggtcgcgccgaggcccgcgtggaccaacgtaccgtgaggtgggtagtgggagtggggaccgaaacccgtaacgtcgttggtcgtacgacgtaggtcgttccttccgaccctacgtcccgtaccgggtacacgtaaccgtttaaccgaacgtaccgaacccgaaccgtaaccttacccctaacctaaaccgtaaaaccgaacctaaaccgtacccgtaaacgtaacgttacggggtaacggttaacggaacgggtacgtacccgtagaaccgtaccgttacgtacggtaaccgacccgtaccgggtacccgttacttaacgtttacgtcggtacgacggagacccgtacccaacggtaccgtccggtagaccggtacccgtaggcccgtacggccgttaccgtttcggtccgttccgggtaccggggg

SEQ ID NO: 206487 - DNA, 589 bp, Homo sapiens
  misc_feature: GYAE6OF01BG3AQ.17.25.C03.1.454.CMB.1.raw
  modified_base (399)..(399): a, c, t, g, unknown or other
  misc_feature (399)..(399): n is a, c, g, or t
  modified_base (434)..(434): a, c, t, g, unknown or other
  misc_feature (434)..(434): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctggagtggatggggatggggaccgaaaccctaacactggtgtcacagtgtcttcacccatccctcgggacagaccttacatcgaccacgaactccnccaataaacacagcctacatggagttagaggtacncctagacatcgagacgtagtaccgggtccgttacttaacttacgtggtcgaccggaggtaccgtaccccaacggtacgttcccgggtagaccggacccgttacgggaccgtacggtcccgggtacccttttcgggccgtttcgggtaccgggggg

SEQ ID NO: 206488 - DNA, 732 bp, Homo sapiens
  misc_feature: GYAE6OF01D8P19.17.25.C03.1.454.CMB.1.raw
  modified_base (290)..(290): a, c, t, g, unknown or other
  misc_feature (290)..(290): n is a, c, g, or t
  modified_base (336)..(336): a, c, t, g, unknown or other
  misc_feature (336)..(336): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctgggctgaggtgaagaagcctggggcctcagtgaaggtctcctgcaaggcttctggattcacgtttacctcctatagtattcaactgggtgcgccaggccnctggacaacgacctgacgtggatgggatggggacaaaccccgtaanacctggtcgtcaacgtaggtgtccttacacccattcccgtacggacagtaccttaccatcgaacccaacgaacccttccctaccgaaacttaaaaccacctaacgaccccttaacaacgttcggggtaaacgtttagggaacgggtacgaccccttagggaacctagtacccttaggaacccggaaccgtaacccggggtacccgtttacgttaaccgtttaaccgttagggtaccgtaccgggaaaggtaacccggtacccccgtaaacgggtaccgttaccccgggggtacggtaacccggggtccccgttaaaacccgggggtcctaaaccggggcccgggtttacccggtttttacggtaaaccccggtttcccggggttacccgggggggg

SEQ ID NO: 206489 - DNA, 613 bp, Homo sapiens
  misc_feature: GYAE6OF01DG5NW.17.25.C03.1.454.CMB.1.raw
  modified_base (280)..(280): a, c, t, g, unknown or other
  misc_feature (280)..(280): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacaacgcctgagtggagtgggatgggacaaccctaagcgtggtgtcacagtcgtcttcaccctatcccgtaccggacagtaccttacatacgaccaacgaacctcctaccaataaaccacaacgccctaacagtagggagttcggaggacgcctagactatcctagaccgacgaccggtaccgttctaactttacgtgtcgaccgtaggtaccgttaccccgaacggtacgttaccccgggtagacccggtacccctaacggggaccctacgggtcccgggttacccttttacgggacccgtttcgggtacccgggggg

SEQ ID NO: 206490 - DNA, 576 bp, Homo sapiens
  misc_feature: GYAE6OF01E15B1.17.25.C03.1.454.CMB.1.raw
  modified_base (468)..(468): a, c, t, g, unknown or other
  misc_feature (468)..(468): n is a, c, g, or t
  modified_base (502)..(502): a, c, t, g, unknown or other
  misc_feature (502)..(502): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgagggtgaagaagccgtggggcctcagtgaaggtctcctgcaggcttctggattcacgtttacctcctatagtatcaactgggtgcgccaggccgctggacaacgacctgaggtggagtgggagtcggggaccgaaaccctaacacgtggtgtcactagtgtccttccaccctacgtcccgtaccgggacacggtaaccttaccatcgaccacgaacctccctacaactaaaccacacgacctacatggtagttgaggacgccctgacctntcgtagaccgacgaccgggccttcttattaccgnggtgacgagaccgtcccgagtcgtccggagcgccgtaacggcgacggtcggtccctttggcgttcggtacgggg

SEQ ID NO: 206491 - DNA, 663 bp, Homo sapiens
  misc_feature: GYAE6OF01CDQXN.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctgaggtgaagaagccgtggggcctcagtgaaggtctcctgcaaggcttctggattcacgtttacctcctatagtatcaacgtgggtgcgccgaggccgctcggacaacgaccgtggaggtggagtggggagtcggggaccgaaaccctaaacgacgtgggtgtacaacgtaggttcgtccttaccacccctacgtccccgtccggggacacggtaaccttaacccatacgaacccaacgtaacctccctaccaactaaaccaccacgaccctaactagtaggtagttaggacggacgccgtagactactcgtacggaaccgaccgaccgggtccgttacttacgtttacgtggtacgacgacggtaccgtaccccgaacgtaccgttcccgggtacgaccgggtacccgtaaccgggacgtaaccgggtcggttacccgttttacggtccgtttccgggtaccggggg

SEQ ID NO: 206492 - DNA, 654 bp, Homo sapiens
  misc_feature: GYAE6OF01B3FTI.17.25.C03.1.454.CMB.1.raw
  modified_base (337)..(337): a, c, t, g, unknown or other
  misc_feature (337)..(337): n is a, c, g, or t
  modified_base (344)..(344): a, c, t, g, unknown or other
  misc_feature (344)..(344): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagagccgtggggcctcagtgaaggtctctgcaggcttctggatttcacgtttacctctatagtatcaacgtgggtgccgccaggccgcgtcggacaacgacctgaggtggatgggatgggacctaacctaacncgtggtntacacgtagtcgttactaccacccgactcccgtaccgggactacggtaccttaaccgatacggaccctaaccgaacctccgtaccaactaaaccacacgacctaacagttaggagttacggaaggtacgaccgtagactacgttactacggaaccgaccgaaccgggtccttacgttaacgtttaccgtaggtcggtaccggacgtaccggttaccccgaacggtaccggttccgggacgtaccgggtaccctaacgggccggtacgggcccgtttacccggtttcgttacccgttcgggtacccggggg

SEQ ID NO: 206493 - DNA, 663 bp, Homo sapiens
  misc_feature: GYAE6OF01CBVWI.17.25.C03.1.454.CMB.1.raw
  modified_base (519)..(519): a, c, t, g, unknown or other
  misc_feature (519)..(519): n is a, c, g, or t
  modified_base (525)..(525): a, c, t, g, unknown or other
  misc_feature (525)..(525): n is a, c, g, or t
  modified_base (599)..(599): a, c, t, g, unknown or other
  misc_feature (599)..(599): n is a, c, g, or t
tcagcgtagactagcacgaccggtgctcgatttagtagtgtagatttgggtttggggactcaacaaccacatctgtcctctagagaaaaccctgtgagcacagctcctcaccatgactggacctggagatcctcttcttggtgcagcagctaacgaagtcgcccactcccgaggtgcagctggtgcagtcgtggggctggaggtagaagaagccgtggggcctcgagtgaaggtctccgtgacaaggcttcgtggattctacgttttacctcctatagtatacgtaacgtgggtcgcgccgacggccgtcgtacgggaacaaccggacctaggaagttgggaagttgggagtacgggaaccgtaaacccctaaacgtacgttgggtcgtacgaaacgtgttcgttccttaccaccctactcccggtaccgggacaacgtaccttaaccgataccgaacccaacgtacctaccctaccaaataaaaccacaacgacctaacagtacggtagtagaggacnccgtanactatcgtagacgaaccgacgtccgttatacttagtcggtagaccgtaggacctacccgaagtcgttaccgggngtaaccggtcccgtaacggccgtaacggtcccggttacctttaggtccgttcgggtaaccgggg

SEQ ID NO: 206494 - DNA, 614 bp, Homo sapiens
  misc_feature: GYAE6OF01ASOI2.17.25.C03.1.454.CMB.1.raw
  modified_base (201)..(201): a, c, t, g, unknown or other
  misc_feature (201)..(201): n is a, c, g, or t
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatcctccctgtctgcctctggtgggggtcagngtcacatcacttgccggacagtcacggtacgttaaaacctattaaattggtatcagcagaaacctggaaaacgccccagacctcctgatctctggtgcatccactctgcgaagtggccgtccatcgaggttcaggtggcagtgatcgtgggacagtactttacaatctacaacctactccaacccacttctacgaccctaaaccgtggaacggttattcggtacgtacaacttcctaacttaccgtacgtaccaaacgtagttaacgttacctaccgtttcccccgtacgttaccttaccgttttaccggacccggtaaggggtaaccctaaacgggttagaacggtaacttaaccgaaaacggtaccgtggtacggaccgttacgaccctaacctacgtccgttggttaccc

SEQ ID NO: 206495 - DNA, 804 bp, Homo sapiens
  misc_feature: GYAE6OF01ALWOB.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctgaggtgaagaagccgtggggcctcagtgaaggtctcctgcaaggtctctggattcacgtttacctctatagtatcaacgtgggtgccgccgaggccgcgtaggaccaaccgacctggaggtgggagtaggggacgtcggggaccgtaaacccgtaacgacgtggttcgtcgaacgtagttgtccttaccacctctccgtaccggacacgtactacatcgaccacgaacctccctacaactaaacacacgtaccctaacgtagtacgggtagttacgggaacgtacgtcccgttaaggaacctaacggttaccgttaccgggaacccggtaacccgtaccccggggggttacccttaaccgtttaaaccgttttaccggttaaccggggttaccgggtaacccggggtaaacggttaacccccgggttaccccccggaaaacccgggtttaccggggtttaccccccggggggttaacggtaaccccggggttaacccccgggtttaaaccccggggaccgggtttaaccccggggtaccccggggttttaccccgtttttaacccggggttaccccggtttttacccggggggtaaccccgggggggg

SEQ ID NO: 206496 - DNA, 805 bp, Homo sapiens
  misc_feature: GYAE6OF01A7ATW.17.25.C03.1.454.CMB.1.raw
tcagcgtagactagcacgaccggtgctcgatttagtagtgtagatttgggtttggggacgtcaacaaccacatctgtcctctagagaaaaccctgtgagcacagctcctcaccatggactggacctggaggatcctcttcgttggtggcagcagctacaagtgcccactcccaggtgcagctggtgcagtcgtggggctggaggtgaaggagccgtggggcctcgacggtgaaggtctcctgcaaggcttcgtggattcgacgtttacctccttagtagtatactaacgttgggtacgcggccgacggtcccgcgtaggaccaaccggaccgttagggacgtgggtagtggggagtcgggaaccgaaaccctaacgacgtagggtacgtacgacgtaggttacgtacctaccgacccgtagtccgtccgggaacacggtaaccgtttaccgaacgttaccggaaccctaaccggtaaaccttccccgttaaccaaacgttaaaacccaccgaacgtaacccgttaaacgtacgttacggggttaaagtttacgggaacgggtaccgtacccgttaggaacctacgttaaccgttacggaaacccggtacccggtaaccggggttacccccgttaattaaccgttttaacgtcgggttaacggaccggtaaaggtacccgttaacccccgaaggtaacccggttcccgggttacgggaacccgttaaccccggtacccgggacgggtaaacccgggtccgggttttaacccgtttcggttacccggtttcggggtaaccccggggg

SEQ ID NO: 206497 - DNA, 673 bp, Homo sapiens
  misc_feature: GYAE6OF01ACZL8.17.25.C03.1.454.CMB.1.raw
  modified_base (442)..(442): a, c, t, g, unknown or other
  misc_feature (442)..(442): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagagcctggggcctcagtgaaggtctccgtgcaaggtcttcgtggattctaccgtttacctcctatagtatcaagtggtgccgcaggccgctggacacgacctgagtggagtgggagtcgggaccgaaaccctacgtacgtggtgcacgagtcgtcttccacccgactccgtaccgggacacgtaccttacactacgaacctacgtaacctcctaccaataaaccgacacgccctaanagtacgggtagttaggaacggtacgtccgtacgacgtacgtaccgtacggaacccgtaaccgcccgggttacccgttacttaacgtttaaccgtcgggttacggaccggtaaggtacccggttaccccgtaacggtaccggttacccggggtaggaccccggtacccgtaccgggaccgttaaccgggtcccggttacgtttaccggtccggtttccggggtacccggggg

SEQ ID NO: 206498 - DNA, 727 bp, Homo sapiens
  misc_feature: GYAE6OF01BERPE.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctggtgcagtcgtggggctggaggtgaagaagccgtggggcctcgagtgaaggtctcctgcaaggcttcgtggattctacgtttacctctatagtatcaacgtgggtgcgccgaggccgcgtggaaccaacgacctggacgtggagtgggagtcgggaccgtaaacccgtaacgacgttgggtcgtacgaacgtaggttcgttccttaccaccccgtacgtcccgtaccggggaactaacggtacctttaaccgacgttaccgaacccgaacgtaacccttccctaaccgaaacttaaaaccgactaacgtacccttaacgagttacgggtaagttacgggaacggtacgtcctagaacctacgttacgtacggaaccgaccgtaacccgggtccgtttaacttaacgtttaccgtcggtacggaccggtaaacgtaccggttaccccgtaacggtaccggtttcccgggtacggaccggtaccccgtaacggggcctacgggtccccggtttacttttccgggaacccgttcggggtacccgggggg

SEQ ID NO: 206499 - DNA, 694 bp, Homo sapiens
  misc_feature: GYAE6OF01B7T9A.17.25.C03.1.454.CMB.1.raw
  modified_base (307)..(307): a, c, t, g, unknown or other
  misc_feature (307)..(307): n is a, c, g, or t
  modified_base (336)..(336): a, c, t, g, unknown or other
  misc_feature (336)..(336): n is a, c, g, or t
  modified_base (345)..(345): a, c, t, g, unknown or other
  misc_feature (345)..(345): n is a, c, g, or t
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatcgacccagtctccatcctccctgtctcgcctcgtggtcgggggtcaggacgtccaccatcacgttcggaccgacaaggtactacggtaaccgtttaaaaccttaattttaaagttggttatacgtaagacaacgaaacctaggaaaaccnccccaagacctccgtgactctactggtcnctactaccnctcgtcgacgtaagtcgtccgtccagtcgtacgtcaggtgcgtagtggtacgtcgtagggaactaggtactttacaacttcgtaccactactacctaaccgtaccttcgtacgtaacccgtaaacgtacggtaagttacttgggtacaacgttaacgttaccttaacgtacgttaacgtaacgaaacgttaacggttaacgttaaccgttccgtttaccccgtacgttacctttaaccggtttcggaaccgggtaacgggtaaccgtaaaggttacggaacgtaacgtaaccgaaaacgttaccgtacggtacgtacgtaccgacctaaccgttcttccgcgtttaccg

SEQ ID NO: 206500 - DNA, 582 bp, Homo sapiens
  misc_feature: GYAE6OF01DRD7Z.17.25.C03.1.454.CMB.1.raw
  modified_base (170)..(170): a, c, t, g, unknown or other
  misc_feature (170)..(170): n is a, c, g, or t
  modified_base (178)..(178): a, c, t, g, unknown or other
  misc_feature (178)..(178): n is a, c, g, or t
  modified_base (182)..(182): a, c, t, g, unknown or other
  misc_feature (182)..(182): n is a, c, g, or t
  modified_base (245)..(245): a, c, t, g, unknown or other
  misc_feature (245)..(245): n is a, c, g, or t
  modified_base (279)..(279): a, c, t, g, unknown or other
  misc_feature (279)..(279): n is a, c, g, or t
  modified_base (311)..(311): a, c, t, g, unknown or other
  misc_feature (311)..(311): n is a, c, g, or t
tcagcgtagactagcacgaccggtgctcgatttagtagtgtagatttgggtttggggactcaacaaccacatctgtcctctagagaaaccctgtgagcacagctcctcaccatggactggacctggagatcctcttcgtggtgcagcagctacagtcgcccactccaggncagctggnacgngtcgtgggctaggaggtgaagagccgtgggcctgagtgacgtctcagcgagcagtcgaatgtntcctacaataaagtgtggtaatgtaacggttggngccgaacgccgggtaccccgaagacggttggnggtgggtagggtcggagtacggtcggtacgtacgtacgggacgtagcggaacgtgtacgtacgacgacgagtagagagagagtacgtacgtacgtacgacgaccgaccgaccgacgacgacgactacgtacgacgtacgacgacgtacgacgacgacgacgacgtacgacgacgacgacgtacgtacgtacgtacgtacgtacgtacgtagtacgtacgtagttgtcgtatacgtcgtagtagttacgtacgtacgtagtcgtagtgtacg

SEQ ID NO: 206501 - DNA, 637 bp, Homo sapiens
  misc_feature: GYAE6OF01BHO8O.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtagaagaagccgtggggcctcgagtgaaggtcctcctgcaaggtcttctggattcacgtttacctcctatagtatcaacgtgggtgcgccaggcccgcgtggaccaacgacctggagtggagtgggagtcgggaccgaaaccctaacgacgttggtcgtacacgtgttcgttccgttccaccctactcccgtaccggggacacgtaccttaccatcgaaccacgtacctcctaccaactaaaccaccacgcctaacgagtaggtaggttaggacgggtactacccgtagactacgtcgtacgaaccggaaccgacccgggtccgttacttacgttacgtcggtcgacggtaacgccgtacccgacgtacggtcccgggtagaccgccgtaccggcgtacgggtccggtcctttcggtaccgttcgggtaccgggg

SEQ ID NO: 206502 - DNA, 620 bp, Homo sapiens
  misc_feature: GYAE6OF01AN8LH.17.25.C03.1.454.CMB.1.raw
  modified_base (281)..(281): a, c, t, g, unknown or other
  misc_feature (281)..(281): n is a, c, g, or t
  modified_base (562)..(562): a, c, t, g, unknown or other
  misc_feature (562)..(562): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaacgtgggtncgccaggccgctggacaacgacctgagtggatgggatgggcaaaccctacactggtgtcacagtcgtcttcaccctatccgtccgggacgacgttaccatcgaccaaccgacctcctacctaactaaacaacacgaccgtaccagtaggacggttaggaggacgtctacgacactcgtagaccggaacgaccgggtcccgtccttaattacgttaggtcgtcggaacgacggttccccgaccgtaacggttcccggtaggaccggaccgttacccgggacncgggtacccgggttcccgtttacggttaaccggttcccgggtcggggtaccccggggg

SEQ ID NO: 206503 - DNA, 655 bp, Homo sapiens
  misc_feature: GYAE6OF01CR6RF.17.25.C03.1.454.CMB.1.raw
  modified_base (174)..(174): a, c, t, g, unknown or other
  misc_feature (174)..(174): n is a, c, g, or t
  modified_base (185)..(185): a, c, t, g, unknown or other
  misc_feature (185)..(185): n is a, c, g, or t
  modified_base (199)..(199): a, c, t, g, unknown or other
  misc_feature (199)..(199): n is a, c, g, or t
  modified_base (339)..(339): a, c, t, g, unknown or other
  misc_feature (339)..(339): n is a, c, g, or t
  modified_base (578)..(578): a, c, t, g, unknown or other
  misc_feature (578)..(578): n is a, c, g, or t
  modified_base (647)..(647): a, c, t, g, unknown or other
  misc_feature (647)..(647): n is a, c, g, or t
tcagcgtagactagcacgaccggtgctcgatttagtagtgtagatttgggtttgggactcaacaaccacatctgtcctctagagaaaaccctgtgagcacagctcctcaccatggactggacctggagactcctcttcgttggtgcagcagctacagtcacccactcccgaggngcagtcgtggngcgtagtggtgggntaggaggagaagacgcgtcggctagagtaggacgtctcgagacgtagtcttgtacgtacttaccgttacttacctagtaagtacgtacgtacgtaggtcggcgaccgaccggacggtaccgtacgaacgacgttaaccgngtggacggtaggtacgaggtacgaaccggacctaaccgagtagtcgtctacgtacgtcgttccactaccacgtccgtaccggacgtaactaccgtaacacgtacaccgtaacccgtactacctaacccaaacgaacaacaccgtacgtagtaacggtaggtagtacggagtaccgacgtacgactagtacccgtacggtaaccgaccggtacgtaccgttacgttaacgttagtaccgnggtaaccgacgtaaccgccgtacgtcggacgtcggacgccgtacgcgtacgtcgttcgtactgggccgnggtaccgg

SEQ ID NO: 206504 - DNA, 760 bp, Homo sapiens
  misc_feature: GYAE6OF01CK9SP.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctggaggtgaagaagccgtggggcctcgagtgaggtctccgtgcgaaggtcttcgtggattctacgtttacctctatagtatcaacgtgggtgccgcgaggccgcgtggaacaacgaccgtgagtggaagtgggagtcgggaccgaaacccgtaacgaccgtggtcgtccaagtacgttcgttccttaccacccgtacgtccgtaccgggactaacgtaaccttaccaagtcgaaccctaaccgtaacccttccgtaaccctaaacgtaaaaccgaccgtaacggtaccccttaaacgaaggttcgggtaaacggtttacgggaaacggggtaaccgtccccgttaaggtaaaccctaagtttccggtaaacggaaccccggtaacccggaacccggggttacccgtttaactttaaacgttttaaccggtcggttaccggaaccggtaacggtaacccgttaccccggaacggttacccggttacccggggtagaacccggttcccggtaacggccgtacgggtaccccggttccttttacggacccggtttcgggtaccggggg

SEQ ID NO: 206505 - DNA, 579 bp, Homo sapiens
  misc_feature: GYAE6OF01B1ZI6.17.25.C03.1.454.CMB.1.raw
  modified_base (281)..(281): a, c, t, g, unknown or other
  misc_feature (281)..(281): n is a, c, g, or t
  modified_base (291)..(291): a, c, t, g, unknown or other
  misc_feature (291)..(291): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagccgtggggcctcagtgaaggtctcctgcaaggcttctggattcacgtttacctcctatagtatcaactgggtncgccaggccntggacaacgcctgagtggatgggatgggaccaaccctaacacgtggtcgtcacagttcgtccttcaccctatcccgtccgggacacgacttaccatcgaaccacgactccctacaataaaccacacgcctacagtggagttgaggacgcctagactatcgtacgaccgacgaccgggtccttacttattaccgtgtacggccgtagtaccgtacccacgtacgttcccgggaggaccgtcccgtaacggcctacggccggttacctttggacccgttcggtacggggg

SEQ ID NO: 206506 - DNA, 651 bp, Homo sapiens
  misc_feature: GYAE6OF01BMGX6.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggaccaacgacctgagtggatgggatcgggacgaaccctaacacgtggtgtcacagtcgtcttcaccctatccgtccgggacacgtaccttaccatcgaaccacgtaactccctacaataaaccacacgtccctaacgagtacgggagtttaggagggtacgtccgtaggaacctacgtcgtacggaaccggtaaccgacccggggtcccgtttacttaacgttaccgttggtacggtaccggaggtaacccggtaccccgaaccggtacgttacccggggttacggaccggtccccggtaacgggcccgtacgggtcccggttacccgttttcggacccgttttccggggaccggggg

SEQ ID NO: 206507 - DNA, 691 bp, Homo sapiens
  misc_feature: GYAE6OF01BMHZS.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagaagcctggggcctcagtgaaggtctcctgcaaggcttctggattcacgtttacctcctatagtatcaacgtgggtgcgccgaggccgcgtggacaacgcctgagtggagtgggagtcgggaccgaaccctaacgacgtggtcgtacacgtacgttcgtaccttcaccctacgtcccgtaccgggacacgtaccttaaccacgttacgaaccctaacgtaacctaccctactaactaaacacaacgtacctaactagtagggtaacgttggaacggtacgtcctagaacctactacgtacggaaccggtaccgaccgggtacccgttacttaacgtttacgtcggttaacgacggtaaccggtaccgttaccccgaaccggttacggtacccggggtacggaacccggtacccggttaaccgggccggtaacccgggtcccggttacccggttttaccggtcccggttttcccgggacccgggggg

SEQ ID NO: 206508 - DNA, 559 bp, Homo sapiens
  misc_feature: GYAE6OF01CCGM0.17.25.C03.1.454.CMB.1.raw
  modified_base (282)..(282): a, c, t, g, unknown or other
  misc_feature (282)..(282): n is a, c, g, or t
  modified_base (333)..(333): a, c, t, g, unknown or other
  misc_feature (333)..(333): n is a, c, g, or t
  modified_base (403)..(403): a, c, t, g, unknown or other
  misc_feature (403)..(403): n is a, c, g, or t
  modified_base (412)..(412): a, c, t, g, unknown or other
  misc_feature (412)..(412): n is a, c, g, or t
  modified_base (439)..(439): a, c, t, g, unknown or other
  misc_feature (439)..(439): n is a, c, g, or t
  modified_base (450)..(450): a, c, t, g, unknown or other
  misc_feature (450)..(450): n is a, c, g, or t
  modified_base (510)..(510): a, c, t, g, unknown or other
  misc_feature (510)..(510): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctgggggcctcagtgaaggtctcctgcaaggcttctggattcacgtttacctcctatagtatcaacgtgggtncgccaggccgctggacacgacctgagtggatgggatcgggacaaccctaanacgtggtgtcacagtgtccttcaccctatcccgtaccgggcagtaccttaccatcgaccacgtacctccnccaataacncacgcctaagatagggagttgacggcncgtgacagtcncggacaccgaccgtccgtacttattacgtgtcgcggacgcgtacccgacgcgttaccggngaccgtccgtaggccaggccccggttatttcggaccttgggaccggggg

SEQ ID NO: 206509 - DNA, 669 bp, Homo sapiens
  misc_feature: GYAE6OF01BCBEB.17.25.C03.1.454.CMB.1.raw
  modified_base (507)..(507): a, c, t, g, unknown or other
  misc_feature (507)..(507): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagccgtggggcctcgagtgaaggtctccgtgcaaggtcttcgtggtattctacgtttacctactatagtatacaacgtgggtcgccgccgacgggccgcgtaggaaccaacggaccgttggaggtggagtgggagtcggggacctaaacccgtagcgtggtcgtcacgagttcgtcctaccacccgtacgtcccggtacggacaacgtacctttaaccagtaccgaacctaaccgtaacctaccctactaaactaaaccacgaacctacctaacgacgtggtaacgttggaacggtacncgtacggactaagtccgtacggaaccgaccggtaccggtccttacttaacgttacgtcggtacgacgacggtacccgtacccgacggtacgttaccgggacgccggtacccgtacggacgtacgggtccgttacccgtttcggtaccgttcgggtaccgggg

SEQ ID NO: 206510 - DNA, 812 bp, Homo sapiens
  misc_feature: GYAE6OF01CE1TQ.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagcgtgggcctcagtgagtctctgcaggcttcgtggattctacgtttacctctaatagtactacgtaacgtggggtacgccgtccgagggcccgtcgtacggggaaccaaccggacccgttagggaacggttgggtaaggtcggggtaagtacgggggaaccctaaaaccccgtaaacgtaccggttagggtcgttaccgaaacgttaggttccggttacctttaccgaaacccctagttaccccggtacccggggaactaacccggttaaacctttaacccgaagttacccgaaccccgtaaacccggtaaacccttaccccgttaaccctaaaccttaaaaacccgaaccgtaaccggtaacccttaaccgtaaggttacgggtaaacggtttacgggaacgggtacgtaccgtacggtaactaacgttacggtacggtaaccgtaccggtaaccgggtcccggttaacttaacgttacgttaggtacggaacggtacgtaaccggtcccggtaacggtacgttccgggtacggaacggtacccgtacgggacgtcgggtacccgggttacgtttacgggtaccgtttcggggtaccggggg

SEQ ID NO: 206511 - DNA, 557 bp, Homo sapiens
  misc_feature: GYAE6OF01DYJLW.17.25.C03.1.454.CMB.1.raw
  modified_base (441)..(441): a, c, t, g, unknown or other
  misc_feature (441)..(441): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgcctgagtggagtgggatgggaccgaacctaacgcgtggtcgtcacgagtcgtcttcacccacccgtcggacacgtacttaccatcgaccacgaacctcctacaactaacacacgcctacagtaggagttgagacgctgacntcgagacgacgacggtccttatacgttacgtgtcgcgtacgcgtcccgagtacgtccgggtagaccgtccgtacggcgacggtccggtacctttggaccttcggtcggggacccgg

SEQ ID NO: 206512 - DNA, 574 bp, Homo sapiens
  misc_feature: GYAE6OF01CYEUB.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaatgggtgcgccaggccgctggacaacgacctgagtggatggggatgggaccgaaccctaacgacgtggtgtcacgagtgtcttaccaccctatcccgtccgggacagaccttaccatcgaccacgaacctcctaccaataaaccacacgcctacagtggagttgaggacgcctgactatcgtacgaccgacgaccgggtcccttacttacgttacgtggtcgacgaggaccgtcccacggtactccgggtagacgcccgtaggctacgggtcccgtaccgtttcgcgttcggtttacggggg

SEQ ID NO: 206513 - DNA, 846 bp, Homo sapiens
  misc_feature: GYAE6OF01AD36E.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagccgtggggcctcagtgaaggtctcctgcaaggcttctggtattctacgtttacctcctatagtatcaacgtgggtgcgccgaggccgcgtcggacaacgacctggagtggagtgggagtcggggaccgtaaacccgtaacacgtgggtcgtaccgaacgtaggttcgtcctttaccaacccctacgttcccgtacccggggaacaacggtaacctttaacccgaacgttaccggaacccctaaccggtaacccttaccccttaacccctaaacttaaaaaccccaacccgtaaaccggtaccccttaaacgtaacgttacggggttaaacggtttacgggaaacgggtaaccgtaccccgttaacggtaacctaacgtttaccgttaacgggaaacccggtaacccggtaaccccggggttacccgtttaccgtttaaaccgttttaacccggttcgggttaccgggtaccggtaaacggtaacccggttacccccggtaaaccgggttaaccggttaccccggggtacggtaacccggtacccccgggttaaccggggacccggttaaaccggggtccccgggtttaccccgtttttaccgggtaacccggttttcccggggtaccccggggggg

SEQ ID NO: 206514 - DNA, 644 bp, Homo sapiens
  misc_feature: GYAE6OF01AOC2Q.17.25.C03.1.454.CMB.1.raw
  modified_base (283)..(283): a, c, t, g, unknown or other
  misc_feature (283)..(283): n is a, c, g, or t
  modified_base (309)..(309): a, c, t, g, unknown or other
  misc_feature (309)..(309): n is a, c, g, or t
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctcgtggtgggggtcagagtcaccatcacttgccggacaagtcacggtacgttaaaacctatttaaattggtatcagacaagaaacctaggaaaacncccagaccctctgactctcgtggtcncactccactcgtgacgaaggtcggccgtaccagtcggtagttcgaggtcggactaggtgactcggtagggactagtatttacaatcacacctatccacctactctacgacctaaccgtggtaaggtattcgtacgtaactaacttaccgtaacttcgtacgtaaccaaacgtacggttaacgtttacctaccggtttccccttacgtaccgtttaaccggtttacgggaaccggtaacggggtaacccttaaagggtacgtaaacgtacttaaccgaaaacggttcgttacgggtacgtaccgtacgaccgaacttaccgttcgtcggtttaccc

SEQ ID NO: 206515 - DNA, 548 bp, Homo sapiens
  misc_feature: GYAE6OF01AJ0UZ.17.25.C03.1.454.CMB.1.raw
tcagcgtagactagcacgaccggtgctcgatttagtagtgtagatttgggtttgggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatggggccgaaccctaacactggtgtcacagtgtcttcacccatcctccgggacacgacttaccatcgaccacgaacctcctaccactaaacacacgcctacatggagttgaggacgcctagacatctgacgacacggtcctactattactgtacgcgagacgtcccacgtacgtccgggtgcgtacccgtacggcgtacgccggtactttcggacgtttcggtaccggggg

SEQ ID NO: 206516 - DNA, 777 bp, Homo sapiens
  misc_feature: GYAE6OF01A1BB2.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgcgtggacaacgacctggagtggatggggatcggggacaaaccctaacgacgtgggtcgtacacgagttcggttccttccgacccctacgttcccgtacccggggactaggtaaccctttaccacgttacgaacccaaccgtaacccttcccctaccaaacttaaaacccacctaacggtacccctaaacgtaacgttacggggtaacgtttacgggaacgggtaaccggtccctttaagggaaccctaagtttaccgttacggaaacccgggtaacccgtaccccgggggtaccccggtttaactttaaccgtttaaccgtaccgggtttacggacccgggaacggtaacccgttccccccgaaaacgggtcccgtttccccgggggtaaggtacccggtaccccggttaaccgggggaccctaacggggtacccggggtttacccccttttttagggaaccccgttttccggggtacccggggggg

SEQ ID NO: 206517 - DNA, 542 bp, Homo sapiens
  misc_feature: GYAE6OF01CYHC9.17.25.C03.1.454.CMB.1.raw
  modified_base (335)..(335): a, c, t, g, unknown or other
  misc_feature (335)..(335): n is a, c, g, or t
  modified_base (417)..(417): a, c, t, g, unknown or other
  misc_feature (417)..(417): n is a, c, g, or t
  modified_base (438)..(438): a, c, t, g, unknown or other
  misc_feature (438)..(438): n is a, c, g, or t
  modified_base (501)..(501): a, c, t, g, unknown or other
  misc_feature (501)..(501): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagccgtggggcctcagtgaaggtctcctgcaaggcttctggattctacgtttacctcctatagtatcaacgtgggtgcgccaggccgctggacaacgcctgagtggatgggatgggaccaaccctaacncgtggtgtcacagtcgtcttcaccctatccctccgggacagtacttaccatcgaccaacgaacctcctaccaataaacacanacctacagtggagttgaggancctgacatctgacgacgacggtccgtcttattactgtcgcgagacgtcccacgtacgtccggngacgcctacggctacggcggtcctttcgcgttcggtcgggg

SEQ ID NO: 206518 - DNA, 605 bp, Homo sapiens
  misc_feature: GYAE6OF01EVMLX.17.25.C03.1.454.CMB.1.raw
  modified_base (458)..(458): a, c, t, g, unknown or other
  misc_feature (458)..(458): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaggtctcctgcaaggtcttcgtggattcacgtttacctcctatagtatcaacgtggtgcgccaggccgctggacaacgcctgagtggagtgggatgggaccgaaccctaacgcgtggtcgtacgactaggtctcttccaccctactcccgtccgggacagtaccttaccgatcgacccaacgaaccctcctaccaataaaccacacgtacctacagttacggtagttaggaggacnccgtagactatcgtagaccgaccgacggtccttacttagttacgtgtcgacgacgtaccgacccgtacggtacgtacccgggtgtaccggcccgttacggccgaccgggtccgttacccgtttacggtcgttccgggtacccggggg

SEQ ID NO: 206519 - DNA, 523 bp, Homo sapiens
  misc_feature: GYAE6OF01D4JKN.17.25.C03.1.454.CMB.1.raw
  modified_base (260)..(260): a, c, t, g, unknown or other
  misc_feature (260)..(260): n is a, c, g, or t
  modified_base (280)..(280): a, c, t, g, unknown or other
  misc_feature (280)..(280): n is a, c, g, or t
  modified_base (291)..(291): a, c, t, g, unknown or other
  misc_feature (291)..(291): n is a, c, g, or t
  modified_base (406)..(406): a, c, t, g, unknown or other
  misc_feature (406)..(406): n is a, c, g, or t
  modified_base (440)..(440): a, c, t, g, unknown or other
  misc_feature (440)..(440): n is a, c, g, or t
  modified_base (448)..(448): a, c, t, g, unknown or other
  misc_feature (448)..(448): n is a, c, g, or t
  modified_base (455)..(455): a, c, t, g, unknown or other
  misc_feature (455)..(455): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttaccncctatagtatcaactgggtncgccaggccgntggacaacgacctgagtggatgggatgggacaaccctaacgactggtcgtcacagtgtcttcacccatcctcgggacagacttgccatcgaaccacgaacctccacaactaaacncagcctacatggagttgaggagcctgaccagtcngaccgacncggcctntattactgtcgacgagacgtcccgagactccggtgacgccgtaggcacggccgtcctttgccttcggg

SEQ ID NO: 206520 - DNA, 734 bp, Homo sapiens
  misc_feature: GYAE6OF01BNQIX.17.25.C03.1.454.CMB.1.raw
  modified_base (248)..(248): a, c, t, g, unknown or other
  misc_feature (248)..(248): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctgaggtgaagaagcctggggcctcgagtgaaggtctcctgcaggtcttctggnttcgtacgtttacctcctatagtatcaacgtgggtcgcgccgacggccgcgtggaaccaacggtaccgtggaggtggagtgggagtcggggacctaaaccccgtaacgtacgtgggtcgtaccgaacgtaagttcggttacctttaccgacccccgtacgttaccccgtacccggggactaaccggtaaccctttaacccgaacgtaccgaaccccgtaaacccggtaacccttccccgtaacctaaaccttaaaaccgaaccctaaccggtaccctaaccgtaagttacgggtaaggttggaacggtaccgtcccgtagacctaacgtcgtaacgaacccgaccgtaccgggtccgttacgttacgttaccgtagtacgccggacgtacccgttacccgaccgtaacggttcccggaggtaccggtacccgttacgggaccgtaacggtccggttacccgtttcggtccgttcgggtaaccgggg

SEQ ID NO: 206521 - DNA, 580 bp, Homo sapiens
  misc_feature: GYAE6OF01C95S7.17.25.C03.1.454.CMB.1.raw
  modified_base (281)..(281): a, c, t, g, unknown or other
  misc_feature (281)..(281): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaacgtgggtncgccaggccgctggacaacgactgagtggagtgggatggggaccaaaccctaacactggtgtcacgagtgtcttcacccatcccgtccgggacacgacttaccatacgaccaacgaacctcctaccaataaaccacacgcctaacagtaggagttaggaggacgcccgttagacctagtctacgaccggaccgaccggtccgtactagttactgtcggacgagacgtcccgacgcgtaccggtggacgacccgtacgggccgtacggtccggtccttttacgcgttcggtacccggggg

SEQ ID NO: 206522 - DNA, 681 bp, Homo sapiens
  misc_feature: GYAE6OF01CHN3J.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagagccgtggggcctcgagtgaaggtctccgtgacgaaggtcttcgtggtacttcgtaccgtttacctctatagtatcaacgtggtgccgcgaggccgcgtggaacacgactggagtggagtgggagtcgggacctaaacccgtaacgacgttggtacgtcgaacgtacggttcgtacctaccgaaccctacgttcccgtaccggggactaacgtacctttaccgaacgtacgaacccgaacgtaaccctcctaaccaaactaaaccaccaacgtacctaacgtagtaggtacggttacggaacggtacgtcctagaactacgtcgtaacggaaccgaacgtaccggtccttacttaacgttacgtcggtacgaccgtacgtaccgtacccgacggtaccggtcccgggtagaacccggtcccggtacggaccgtacgggtcccggttccgtttacggtccgttcgggtaccgggg

SEQ ID NO: 206523 - DNA, 540 bp, Homo sapiens
  misc_feature: GYAE6OF01A8KP5.17.25.C03.1.454.CMB.1.raw
  modified_base (411)..(411): a, c, t, g, unknown or other
  misc_feature (411)..(411): n is a, c, g, or t
  modified_base (425)..(425): a, c, t, g, unknown or other
  misc_feature (425)..(425): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggacgaaccctaacacgtggtgtcacagtgtctcacccatccctcgggacagacttacactgaccacgaactccacaataaacacagacctanatggagttgacganccctgacatcagacgaccgacgggtccgtcttaattaccgtgtcgcgagactcccgacggtctaccgggtgacgcctacgggcacggccggtcctttgaccgtttcggacggggg

SEQ ID NO: 206524 - DNA, 685 bp, Homo sapiens
  misc_feature: GYAE6OF01AOPNW.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagagccgtggggcctcgagtgaaggtctcctgcaaggcttctggattcgaccgtttacctctatagtatcaactgggtgcgccaggccgctggacacgcgtgagtggagtgggagtcgggacgaaccctaacgacgtggtcgtcgacgtagttcgtcttacgacccactcccgtaccgggactacgtaccttaaccgagtaccgaaccaccgtaaccttccccactaactaaaccaccacgtccctaacgtagtacggtagttaggacggtacgtccctagacctacgttcgaacggaacccggtacgaccccggggtcctacttaacgtttcggacggttcgaccggtaacggtacccgtaccccgtaacgggtaccggttcccggggtagaacccgggtacccccgttaacggggacccgtacgggttcccccgggtttaccgttttaccgggaacccgtttccccggggaacgggggg

SEQ ID NO: 206525 - DNA, 838 bp, Homo sapiens
  misc_feature: GYAE6OF01BCLBG.17.25.C03.1.454.CMB.1.raw
tcagcgtagactagcacgaccggtgctcgatttagtagtgtagatttgggtttggggactcaacaaccacatctgtcctctagagaaaaccctgtgagcacagctccctcaccatggactggacctggaggatcctcttcttggtggcagcagctacaagtgcccactcccaggtgcagctggtgcagtcgtggggctggaggtgaagagccgtggggcctcgagtgaacggtcctccgtgacgaaggtcttcgtggtacttccgtaaccgtttacccgtccttaagtacgtaactcgtaaacgttcggggtacgtaccgccgaacgggcccgtacgtacgggaaaccaaccggtaccgttagggaggttagggaggtacggggaaggttaccgggggaaacccgtaaaccccgtaaacgtaccgttacgggtacgttaccgaacgtacggttacgttccctttaccacccgttacgtccccggtaccgggaacacgttaaccgttaaccagttaccgacccgtaaacgtaaccccttccctaaaccaaactaaaacccgaccgtaaaccgtaacccgtaaagtaacggttacgggtaacgttacgggaagtaaccggttccaaacgtaccctacgtaccgttacggaaccctacccgggtaccccgggttccgttaccgtttaaacgtccggtaggttaccggacggtaaccgtaacccggttaccccgaacggttcccggtaaccgggtacgtaacccgggtaccccgaaccggggaccgtacgggtccccgggttttaccgtttaccggtaaccgggtttcccgggacccggggg

SEQ ID NO: 206526 - DNA, 741 bp, Homo sapiens
  misc_feature: GYAE6OF01B9KUU.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagccgtggggcctcgagtgaaggtctccgtgcaaggcttcgtggtacttcgtacgtttacctcctaatagtatacaacgtgggtcgccgccgaggccgacgtacggaaccaaccgacctggaggtggagtgggagtcgggacctaaacccgtaagacgtggtacgtacacgtacgtcgttaccttaccgacccctacgtcccgtaccgggaactacggtaaccttaaccgagtaccgaaccctacgtaacctacccgtacctaaacgtaaaccaacgaacgtaccctaaacgtagtacgggtaacgtttagggaacggtacgtcccgttaacggacctaacgttccgtaacggaacccgtaacccggtaacccgggttacccgttacgtttaacgttaaccgttacggtacggacggtaacgtaccggttacccgaaccggtacggtacccgggttacggaccgtacccggtaaccggacggtaccggtacccggttaccgtttacggtacccggtttcgggtaaccgggggg

SEQ ID NO: 206527 - DNA, 553 bp, Homo sapiens
  misc_feature: GYAE6OF01C8BAM.17.25.C03.1.454.CMB.1.raw
  modified_base (280)..(280): a, c, t, g, unknown or other
  misc_feature (280)..(280): n is a, c, g, or t
  modified_base (332)..(332): a, c, t, g, unknown or other
  misc_feature (332)..(332): n is a, c, g, or t
  modified_base (340)..(340): a, c, t, g, unknown or other
  misc_feature (340)..(340): n is a, c, g, or t
  modified_base (472)..(472): a, c, t, g, unknown or other
  misc_feature (472)..(472): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggaacaacgcctgagtggagtgggatgggacaaccctaanacgtggtntcactagtcgtcttcaccctatcccgtaccgggacagtacttaccatcgaccacgtaacctcctaccaataaacacacgacctaacagtaggagttgaggagtcctagacatctagaccgacgacggtcttnttacgttactgtcgcgtagactcccgacgtcgtaccgtgacgccgtacggctcgtaccggtctttcgcgttcggtacgggg

SEQ ID NO: 206528 - DNA, 571 bp, Homo sapiens
  misc_feature: GYAE6OF01AYBWJ.17.25.C03.1.454.CMB.1.raw
  modified_base (341)..(341): a, c, t, g, unknown or other
  misc_feature (341)..(341): n is a, c, g, or t
  modified_base (469)..(469): a, c, t, g, unknown or other
  misc_feature (469)..(469): n is a, c, g, or t
  modified_base (526)..(526): a, c, t, g, unknown or other
  misc_feature (526)..(526): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatcgggacgaaccctaacgactggtntcacaggttcgtccttccacccctactcccgtccggggacaggtacctttaccatcgaaccacgaacctccctaccaactaaaccacacgtccctaacgacgtgggagttagaggacgcctgacatcngacgacgaccggtcctctagttactgtcgacggtagacgtcccaggtacgtccgggnaccgccgtacggcacggtccggtcctttcgtccgttcggtcgggg

SEQ ID NO: 206529 - DNA, 604 bp, Homo sapiens
  misc_feature: GYAE6OF01EAYAF.17.25.C03.1.454.CMB.1.raw
  modified_base (243)..(243): a, c, t, g, unknown or other
  misc_feature (243)..(243): n is a, c, g, or t
  modified_base (434)..(434): a, c, t, g, unknown or other
  misc_feature (434)..(434): n is a, c, g, or t
  modified_base (453)..(453): a, c, t, g, unknown or other
  misc_feature (453)..(453): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctgggctgaggtgaagagccgtggggcctcagtgaaggtctcctgcaaggcttcnggattcacgtttacctcctatagtatcaacgtggtgcgccaggccgctggacaacgcctggagtggagtgggatcgggaccgaaccctaacgtatggtgtacacgtaggtcgttccttcaccctatccgtaccgggacaggtaccttaccatcgaaccacgaaccttccacaactaaaccacacgacctanagtagtagttaggaggacnccctagaacatcgtacgaacgtaccacgggtaccttacgtacttacgtgtcggaccgagtcgtacccacggtacgttaccgggtgaaccggtcccggtaaggaccgacggtacccgggttccgttttacgtccgtttcgggtacccggggg

SEQ ID NO: 206530 - DNA, 698 bp, Homo sapiens
  misc_feature: GYAE6OF01CXSHT.17.25.C03.1.454.CMB.1.raw
  modified_base (282)..(282): a, c, t, g, unknown or other
  misc_feature (282)..(282): n is a, c, g, or t
  modified_base (292)..(292): a, c, t, g, unknown or other
  misc_feature (292)..(292): n is a, c, g, or t
  modified_base (372)..(372): a, c, t, g, unknown or other
  misc_feature (372)..(372): n is a, c, g, or t
  modified_base (438)..(438): a, c, t, g, unknown or other
  misc_feature (438)..(438): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagaagcctggggcctcgagtgaaggtctcctgcaggcttcgtggattcacgtttacctcctatagtatcaactgggtncgcaggccgntgacacgctgagtggatgggatgggacaaccctaagacgtggtcgtcacagtcgtccttcaccctatccgtacccggganacggtacttacccatacggacccaacgtaaccctccctacctaactaaaacgaccacgaccctaanagtacgggaagtttacggaacgggtacgacccttaggaaccctaagttaccgtaacggaacccgaaccgtaccggggtcccgttactttaacgttttaaccggtcggttaggccggtaaacgggtacccggttacccccgtaaccgggtaacggttccccggggttacggtaacccgggtaccccggttaaccgggccggtaaaccgggtcccgggttcccgtttttaaccgggtccgtttccggggttacccggggggg

SEQ ID NO: 206531 - DNA, 543 bp, Homo sapiens
  misc_feature: GYAE6OF01E3FEO.17.25.C03.1.454.CMB.1.raw
  modified_base (334)..(334): a, c, t, g, unknown or other
  misc_feature (334)..(334): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctgtggcctcagtgaaggtctcctgcaaggcttctggattcacgtttacctcctatagtatcaactgggtgcgccaggcccgcgtggacaacgacctgagtggatgggatgggacgaaccctaanacgtggtgtcacagtgtcttcacccatccctccgggacacgacttaccatcgaccacgaactccacataaacacagcctacatggagttgagagcctgacagtctagacgacgaccggtccgtcttattacgtggagcggacgacgttccccacggtatccgggtgaccgccgtaacggacgcggtacctttggacttcggtccggggg

SEQ ID NO: 206532 - DNA, 564 bp, Homo sapiens
  misc_feature: GYAE6OF01AXP0R.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagaagccgtggggcctcagtgaaggtctcctgcaaggcttctggattcacgtttacctcctatagtatcaactgggtgcgccgaggccgctggacaacgacctgagtggatgggatggggaccgaaccctaacacgtggtgtcacagtcgtcttccacccatcccgtccgggacacgaccttaccatcgaccacgaacctcctaccaataaacacacgcctaacagtggagttgacggacgcctagacatctgacgaccgacggtccgtactattactgtcgcgagaccgtcccgacgtacgtccgggtgaccggcccgtacggcgtacggtcggtacccgtttgtccgttcggtcgggg

SEQ ID NO: 206533 - DNA, 668 bp, Homo sapiens
  misc_feature: GYAE6OF01A5M6E.17.25.C03.1.454.CMB.1.raw
  modified_base (281)..(281): a, c, t, g, unknown or other
  misc_feature (281)..(281): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagccgtggggcctcagtgaaggtctcctgcaaggcttctggattcacgtttacctcctatagtatcaactgggtncgcaggccgctggacacgacctgagtggagtggagtgggcgaaccgtaacacgtggtgcagagtgtcctcacccactccgccggacacgtacttaccagtcgaaccaacgtaacctcccgtaccaaactaaacactacgtaccctaacgagttaggtacgttggaacgggtacgcccgttaggacctaacgttccgtaacgaaccggtaaccgtacccggggtacccgttacgttaactttaccggtaggtaccgggacgaaggtacccgtacccccgtaacggtaacgttccccggggttagaacccggtaccccgttaacggggccctaacggggtccccgggtttacccttttaacgggcccgttttccggggtacccgggggg

SEQ ID NO: 206534 - DNA, 609 bp, Homo sapiens
  misc_feature: GYAE6OF01A7H0K.17.25.C03.1.454.CMB.1.raw
  modified_base (378)..(378): a, c, t, g, unknown or other
  misc_feature (378)..(378): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagagccgtggggcctcagtgaaggtctcctgcaaggcttctggattcacgtttacctcctatagtatcaacgtgggtgcgccaggccgcgtggacaacgcctgagtggatgggatgggacaaccctaagacgtggtctacacgagtcgtcttcaccctagtccgtaccggganacgtacttaccagtcgaacctacgaacctccctaccaactaaaccacaacgtccctaacagtaggagttagaggacgcctagactatcgacgaacgaccgaccgccgttacgttattacgtgtcgacgtaacgcgtaccccgaacggtacgtcccgggtacgaccggtacccgtaacgggaccgtcgggtacccggttaccgtttcgaacccggtttcggtaacccggggg

SEQ ID NO: 206535 - DNA, 622 bp, Homo sapiens
  misc_feature: GYAE6OF01BIBP3.17.25.C03.1.454.CMB.1.raw
  modified_base (284)..(284): a, c, t, g, unknown or other
  misc_feature (284)..(284): n is a, c, g, or t
  modified_base (294)..(294): a, c, t, g, unknown or other
  misc_feature (294)..(294): n is a, c, g, or t
  modified_base (431)..(431): a, c, t, g, unknown or other
  misc_feature (431)..(431): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagaagcctggggcctcgagtgaaggtctcctgcaaggcttctggtattcacgttttacctcctatagtatcaactgggtncgcaggccgntggacacgcctgagtggatgggatgggaccaaccctaacacgtggtgtacacgagtcgtcttccaccctatcccgtccgggacagtaccttaccatcgaaccacgaacctacctaccaactaaacacacgccctaanagtagggtagttaggaaggacgtccgtagactatcgtcgaaccgaccgaccgggtcccgttacttacttacgtcggtacgaccggtaggtaccgtaccccaaggtacgtacccgggtaggaccggtacccgtacggggacctacggggtcccggttacccttttcgggtaccgttccggggtaccgggggg

SEQ ID NO: 206536 - DNA, 584 bp, Homo sapiens
  misc_feature: GYAE6OF01D4EUF.17.25.C03.1.454.CMB.1.raw
  modified_base (280)..(280): a, c, t, g, unknown or other
  misc_feature (280)..(280): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacaacgcctgagtggatgggatgggacgaaaccctaacacgtggtgtcactagtcgtcttccacccatcccgtcgggacagtaccttaccatcgaaccacgaacctccctaccaataaaccacacgacctaacagtgggagttggaggacgcctagacactctaggaccgaccgacgggtcccttacttacttactggtagcgagtaccgtcccaacggtcgtcccgggtagaccggtccctacgggccacgggtccggtacccttttggaccgttccgggtaccggggg

SEQ ID NO: 206537 - DNA, 623 bp, Homo sapiens
  misc_feature: GYAE6OF01DZSJ7.17.25.C03.1.454.CMB.1.raw
  modified_base (433)..(433): a, c, t, g, unknown or other
  misc_feature (433)..(433): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagaagccgtggggcctcagtgaaggtctcctgcaggcttctggattcacgtttacctctatagtatcaacgtgggtgcgccaggccgctggacaacgctgagtggagtgggatcgggacgaaccctaagacgtggtcgtcacgagtgtcttcacccactcccgtaccgggacacgtaccttaccatacgaccaacgtaacctcctaccaataaaccacgacgacctaanagtgggtaagttcggaaggacgcctagactatactagaccgtacgacccgggtcctacgttacttacgtggtacgaccgtaaggaccgtacccctaacgggtaccgttccggggtacgaccggtaccccgtaacgggaccgtacgggtacccggttacccttttagggtcccgtttcgggtaccgggggg

SEQ ID NO: 206538 - DNA, 677 bp, Homo sapiens
  misc_feature: GYAE6OF01DEALA.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagctggggcctcagtgaaggtctcctgcaaggcttctggattcacgtttacctcctatagtatcaacgtgggtgcgccgaggcccgcgtcggacaacgacctggagtgggatggggatcgggaccgaaaccctaaacgacgtgggtgtcaacgagttcgtcctttaccaccctagtcccgtacccggggactacgaacctttaccagtacgaccaacgtaacctaccctaccaactaaaaccacacgtacctaacgacgttagggtacgttaggacggtacgcccgttacgaacctacgttacgtacggaacccggtaaccgacccggggtcccgtttacgttaacttttaacgtggttacgaccggtaagacccgttaccccgaacggtacttacccggggtgaaccggccccgtaacgggccgtacgggtacccggttccttttacggaccgtttccgggtaccggggg

SEQ ID NO: 206539 - DNA, 626 bp, Homo sapiens
  misc_feature: GYAE6OF01BTBIP.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaaggcttctggattcacgtttacctcctatagtatcaactgggtgcgccgaggccgctggacaacgcctgaggtggagtgggatggggaccaacccgtaacacgttggtgtcacgagtgtccttcacccactcccgtaccgggactagaccttaccacgtcgaacccacgaacctccctaccaactaaacacacgcctacaagtggagttggagacgcctgactactcgtcgaacgtaccgaccgggtcccgttacttaacgtttacgtggttacgacggtacggtaccgtcccccgaacggtaccgttcccgggtaggaaccggtccccggtaacgggcccgtaacgggtcccggttacccgttttcggacccgtttcggtacccgggggg

SEQ ID NO: 206540 - DNA, 774 bp, Homo sapiens
  misc_feature: GYAE6OF01ENMI0.17.25.C03.1.454.CMB.1.raw
  modified_base (397)..(397): a, c, t, g, unknown or other
  misc_feature (397)..(397): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagagcgtgggcctgagtgaacggtctcctgcgaaggtctttcgtaggtattccgtaacgttttaccctaccgttaagttagtactctaacgtgggttcggccgcccgtagggcccgtacgtacgggaaccaaccggtaccgtggtaaggtcggtaggtggggacgtacggggaaccctaaaccccgttaaacncgttagggtcgtacctaacgtaggttcgttaccttaccgaacccctagttaccccgtaccggggaactacggtaaccttaccgtagtaccgaacccgtaacgtaacccttccctaacctaaactaaaccacccgaaccgtcccttaacgacgttagggtacgttacggaagggtaccgtacccgtagtaacctagttcgaacggtaaccgtaaccggtacccggtacccgttacgtttaaccgtttcggtacggtacgaccgggtacgtacccggtaccccgaagggttaccgtttccgggacgaaccggttaccccggcgggtaaccggcggttaccgggttcccttttacgggtaccggttccgggtaccggggg

SEQ ID NO: 206541 - DNA, 557 bp, Homo sapiens
  misc_feature: GYAE6OF01A917U.17.25.C03.1.454.CMB.1.raw
  modified_base (281)..(281): a, c, t, g, unknown or other
  misc_feature (281)..(281): n is a, c, g, or t
  modified_base (292)..(292): a, c, t, g, unknown or other
  misc_feature (292)..(292): n is a, c, g, or t
  modified_base (329)..(329): a, c, t, g, unknown or other
  misc_feature (329)..(329): n is a, c, g, or t
  modified_base (337)..(337): a, c, t, g, unknown or other
  misc_feature (337)..(337): n is a, c, g, or t
  modified_base (468)..(468): a, c, t, g, unknown or other
  misc_feature (468)..(468): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagccgtggggcctcagtgaaggtctcctgcaaggcttctggattcacgtttacctcctatagtatcaactgggtncgccaggccgntggacacgctgagtgatgggatgggacgaaccctaanacgtggtntcacgagtgtctcacccatcccgtcgggacagtacttaccatacgaccacgtaacctcctaccaataaacacagacctacagtggagttgagacgctgactatctagaccacgaccggtcctactattacngtcgacgagtaccgtcccacggtacgtccgggacgacgcccgttaacggccgtaacggtccgtaccgttttcgacgttcggtccggggg

SEQ ID NO: 206542 - DNA, 738 bp, Homo sapiens
  misc_feature: GYAE6OF01DDSQF.17.25.C03.1.454.CMB.1.raw
  modified_base (290)..(290): a, c, t, g, unknown or other
  misc_feature (290)..(290): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagccgtggggcctcgagtgaaggtctccgtgcaaggcttctggtattctacgttttacctcctatagtatcaacgtgggtcncgccaggccgcgtggaaccaacgaccgtgaggtggacgtggggatcggggacctaaaccctaacgtacgttgggtcgtaccaacgtaggttcgtccttaccacccctacgttcccgtaccggggacacgtacctttaaccagtacgaccctaaccgtaaccctaccctaccaaacgtaaacccaaccgtaaccgtacctaaccgtaagtacgggtacggtttacggaacgggtacgcccgttacggaactaccgttacggtaccggaaccggaccgtaacccgggtacccgttaaccttagttaccgttggtacggaccggaacgtacccgttacccggaaaccggtccggttaccccgggtagtaacccgggtacccgttaacccgggaccgtaccgggtaccccggttaccggttttaccggtccgtttccggggtacccgggggg

SEQ ID NO: 206543 - DNA, 647 bp, Homo sapiens
  misc_feature: GYAE6OF01DXQCU.17.25.C03.1.454.CMB.1.raw
  modified_base (151)..(151): a, c, t, g, unknown or other
  misc_feature (151)..(151): n is a, c, g, or t
  modified_base (351)..(351): a, c, t, g, unknown or other
  misc_feature (351)..(351): n is a, c, g, or t
  modified_base (364)..(364): a, c, t, g, unknown or other
  misc_feature (364)..(364): n is a, c, g, or t
  modified_base (403)..(403): a, c, t, g, unknown or other
  misc_feature (403)..(403): n is a, c, g, or t
  modified_base (606)..(606): a, c, t, g, unknown or other
  misc_feature (606)..(606): n is a, c, g, or t
tcagcgtagactagcacgaccggtgctcgatttagtagtgtagatttgggtttgggagtcagtctcagtcaggacacagcatggacgatggacgggtccccgctcagctccgtggggctcctgctactctggctccgagctgccagatgtnacatccagatacgacccagtcctccactccctccctgtctcgcctgtgggtggggtcaggactcaacctatctacgttcgaccggaacaaggtccaacggtaaccgtttaaaaactaattttaaagttggtaactcaagacaaacgaaaaccgtaggaaaaaccgccccaacgtacctaccgtgtacttctcgtggtacnccactccactcgngacgtaaggtcgtcctaccagtcggagttcgaggtcggntaggtgatcggtacgactagtacttacatacctcaacctactaccaccgtacttacgacaaccgtacgttagggagttattcggacactaacgttctaacttcctagaacctaacgtgtactacccgttacgttccctgtacttacggttacggacggaaacggttaacgaagttacgaacgtaactaaacgaacggttcggnggtacgtaccgtacgaccctattaacgttcgtactttaccc

SEQ ID NO: 206544 - DNA, 647 bp, Homo sapiens
  misc_feature: GYAE6OF01DFUD4.17.25.C03.1.454.CMB.1.raw
  modified_base (243)..(243): a, c, t, g, unknown or other
  misc_feature (243)..(243): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagcctggggcctcagtgaggtctctgcaaggcttnggattctacgtttacctcctatagtatcaacgtgggtgcgcgaggccgcgtggaacaaccgacgtggaggtggagtggggagtcggggaccgaaccctaacgacgtggtcgtcacgtagttcgttccgttaccacccctacgttcccgtacccggggactaacggtacctttaaccatacggacccaacgtaacctccctaccaataaaccacacgtacctaacgaagttgggagttggacggacgtccgtagactactcgtacgaaccgaccgccggtaccgttacttaacgttcgtggcggtacggtagtacccggtacccgaaccgtaggttcccggtaggccggaccccgtacggccgtacgggtccggttccgtttcgaccggttttcggaccgggggg

SEQ ID NO: 206545 - DNA, 623 bp, Homo sapiens
  misc_feature: GYAE6OF01B8WK2.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagccgtggggcctcgagtgaaggtcctccgtgcaaggcttctggattctacgtttacctcctatagtatcaacgtgggtgcgccaggccgctggacaacgcctgagtggatgggatcgggaccgtaaaccctaacgacgtgggtcgtcacgtagtcgtccttccacccctagtcccgtaccgggacacgtaccttaccatacgaccacgaacctcctaccaataacacacgacctacagtggtagttgaggacgcctaggactagtcgtacggaaccgaccgtaccgggtaccgttacttacttacgtggtacgtacggaacgaccgtacccgaacggtacgtcccgggtagtacggccccgtaacgggccgtacgggtcccggtcgttttacggtcccgttcgggtaccggggg

SEQ ID NO: 206546 - DNA, 572 bp, Homo sapiens
  misc_feature: GYAE6OF01CYGU5.17.25.C03.1.454.CMB.1.raw
  modified_base (336)..(336): a, c, t, g, unknown or other
  misc_feature (336)..(336): n is a, c, g, or t
  modified_base (342)..(342): a, c, t, g, unknown or other
  misc_feature (342)..(342): n is a, c, g, or t
  modified_base (346)..(346): a, c, t, g, unknown or other
  misc_feature (346)..(346): n is a, c, g, or t
  modified_base (422)..(422): a, c, t, g, unknown or other
  misc_feature (422)..(422): n is a, c, g, or t
  modified_base (440)..(440): a, c, t, g, unknown or other
  misc_feature (440)..(440): n is a, c, g, or t
  modified_base (446)..(446): a, c, t, g, unknown or other
  misc_feature (446)..(446): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggggctggaggtgaagaagccgtggggcctcagtgaaggtctcctgcaaggcttctggattctacgtttacctcctatagtatcaacgtgggtagcgccaggccgcgtggaacacgactgagtggatgggatgggacaacctanactggntcanagtgtccttcaccatcccgtcgggacagtactacatcgaccaacgaactccctacaataaaccactacgacctaanagtagggattggaggacnccgtanactatcgagaccgacaccgggtccgttacttagttacgtggtacgacgagtaccgtacccgaggtactccgggtagaccgtacccgtacggcacggccggttcctttggaccttcgggtaccgggg

SEQ ID NO: 206547 - DNA, 536 bp, Homo sapiens
  misc_feature: GYAE6OF01DXW7O.17.25.C03.1.454.CMB.1.raw
  modified_base (290)..(290): a, c, t, g, unknown or other
  misc_feature (290)..(290): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctctatagtatcaactgggtgcgccaggccgntggacaacgacctgagtggatgggatgggcaaccctaagactggtgtcacagtgtctcacccatccgtcgggacagacttaccatcgaccaacgaactcctaccataaacacacgacctacagtggagttgaggtagcccttagacatctagacgacacggccgtctattacgtgtgcgagacgtcccacgactccgggtgcgacccgtacggcgtacggccggtcctttgccgttcggtcggggg

SEQ ID NO: 206548 - DNA, 696 bp, Homo sapiens
  misc_feature: GYAE6OF01AYZKG.17.25.C03.1.454.CMB.1.raw
  modified_base (246)..(246): a, c, t, g, unknown or other
  misc_feature (246)..(246): n is a, c, g, or t
  modified_base (285)..(285): a, c, t, g, unknown or other
  misc_feature (285)..(285): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagccgtggggcctcgagtgaaggtctcctgcaggcttntggtattcgacgtttacctctatagtatcaacgtgggtncgccaggccgcgtggaacacgaccgtgagtggagtgggatcgggaccaaaccctaagacgtggtcgtcacgagtcgtaccttcaaccctatcccgacggactacgtaaccttacatcgaacctacgtaacctcctaaccaataaaccaccgacgaccctaagtaggtacgggttaacggttacggaacggtacgtacccgtaagtaccgtaacgtttccgaacggaacccggtaaccccggaaccgggttccccgttaattaaccggtttacgcggtacggaccggtaacggtacccggtaaccccgaaggttaccgggtaccgggtaacggaaccggccccggtaagggacccgtaacgggtttccccggtaccggtttttacggaccggttttccggggaacccggggg

SEQ ID NO: 206549 - DNA, 570 bp, Homo sapiens
  misc_feature: GYAE6OF01DD6SI.17.25.C03.1.454.CMB.1.raw
  modified_base (298)..(298): a, c, t, g, unknown or other
  misc_feature (298)..(298): n is a, c, g, or t
tcagcgtagactagcacgaccggtgctcgatttagtagtgtagatttgggtttggggggagtcagtctcagtcaggacacagcatggacatgagggtccccgctcagctcctgggctcctgctactctggctccgagctgccagatgtgacatccagatgacccagtctccatcctccctgtctgcctctggtggggtcagagtcaccatcacttgccggacaagtcacggacttaaaactatttaaattggtatcagcaagaaacctggaaaacgcccagacctctgatctctggtncatccactctgacgaaggtcggccgtacccagtcgaggtttcaggtggacaggtggatcgtaggacagtactttcaatctacaccatccacctactctcgactaaccgtagaggtattgtgactaactacttactactcgtaccaacgtaagtacgttacctaccgttccccgtcgtccttacgttttcggaccgtaacgggtaacctaaaggttgaagtaactaacgaaacgtacgttaggtcggacgtcgactactactcgttcgttacc

SEQ ID NO: 206550 - DNA, 606 bp, Homo sapiens
  misc_feature: GYAE6OF01A5ALZ.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggtcttctggattcacgtttacctcctatagtatcaactgggtgcgccgaggccgctggacaacgacctggaggtggatgggagtcgggaccgaaacccgtaacacgtggtgtacacgtagttgtccttacaccccatcccgtccgggacagtaccttaccgatcgaccacgacctccctaccaactaacacacgcctaacagtggagttgaggtacgccgtagacattcgtagaccgacgaccggtccgtacttagttaccgtgtcgccggaagtaccggtaccccaggtccgtaccgggtcgtacgccccgttaaccgggcgtaaccgggtccggttacccggttttcgacgttcccggtcgggggg

SEQ ID NO: 206551 - DNA, 653 bp, Homo sapiens
  misc_feature: GYAE6OF01A10WT.17.25.C03.1.454.CMB.1.raw
  modified_base (337)..(337): a, c, t, g, unknown or other
  misc_feature (337)..(337): n is a, c, g, or t
  modified_base (366)..(366): a, c, t, g, unknown or other
  misc_feature (366)..(366): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagaagcctggggcctcagtgaggtctcctgcaaggcttctggattccacgtttacctcctatagtatcaacgtgggtgcgccaggcccgctggacaacgacctgagtggatggggatcggggccaaaccctanacgtggtcgtcacgagtgtcttccacccntcccgtccggggacacgtaccttaccatcgaacccacgaacctccctaccaactaaaccacacgtacctactagtgggtagttggacggtacgtccgtagaacacttcgtacggaaccgaccggaccgggtacccgttaccttaacgttacgttcggtacgacggtacggtacccgtaccccgaaccggtaacggttccccgggtaaggcccggtacccggttaccgggccgtaaccgggtcccgggttaccccgtttcggtacccggtttcgggtacccggggggg

SEQ ID NO: 206552 - DNA, 821 bp, Homo sapiens
  misc_feature: GYAE6OF01CN1FW.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgctagtcgtggggctggaggtgaagaagccgtggggcctcagtgaaggtctccgtgcaaggcttcgtggtacttcgtaaccgtttacctcctaagtagtactcaacgttgggtcgccgccgacggcccgtcgtacggaaccaacggtaccttggacggtcgggaagtggggaacgttcgggggaaccctaaaccccgtaacgaccgttgggtacgtaccgaaaccgtaggttcggttactttacccgaccccgtaaccgttccccggtacccggggtaacaaccggttaacctttaacccgtaacgttaccggaaaccccgaaccgtaacccttaccccgttaccctaaacttaaaacccaacgtaacgtaccccgtaaacgtacggttaggtacgggtttacggaaacgggacgtaccgttaacggacctaacgtaccgttacgaaccggtaccgtaacccgggtacccgtttacgttaacgtttaccgtagggttacggcgtaacggtacccggtacccgtaaccggtccggttacccggggtacggtaccggtaccccgggttaaccggacccggtaacgggttccccgggttaccgtttttcgggtacccggttttccggggttacccgggggg

SEQ ID NO: 206553 - DNA, 660 bp, Homo sapiens
  misc_feature: GYAE6OF01CAD07.17.25.C03.1.454.CMB.1.raw
  modified_base (210)..(210): a, c, t, g, unknown or other
  misc_feature (210)..(210): n is a, c, g, or t
  modified_base (263)..(263): a, c, t, g, unknown or other
  misc_feature (263)..(263): n is a, c, g, or t
  modified_base (299)..(299): a, c, t, g, unknown or other
  misc_feature (299)..(299): n is a, c, g, or t
  modified_base (344)..(344): a, c, t, g, unknown or other
  misc_feature (344)..(344): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcgagtcgtgggctggaggtgaagaanccgtggggcctgagtgaaggtctcctgcaaggcttctggattcacgtttaccnccgtatagtatctaacgtggtcgccgccgaggccgntacggacaacgacctggacgtggagtgggatcgggacaaccgtanacgtggtagtcacgtagttcgtaccgttaccaccctcgtacccgaccggggaactacgtaccttaaccgagttacggaaccctaaccgtaaccctccctaaccgaaacttaaaccaccgtaacgtaccctaatacgtaggtaggttacgacgggactccgtagaactactcgtacgaaccgaccgtaccggtccgttacttaacgttacggtagccggtacggtacgtaccgttacccgacggtaccgtccgggtagtacccgaccggtacgacgacggtacccggttactttacggtccggttcggtaccggggg

SEQ ID NO: 206554 - DNA, 862 bp, Homo sapiens
  misc_feature: GYAE6OF01B40XA.17.25.C03.1.454.CMB.1.raw
  modified_base (284)..(284): a, c, t, g, unknown or other
  misc_feature (284)..(284): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagaagccgtggggcctcagtgaaggtctcctgcaaggcttcgtggattctacgtttacctcctatagtatcaactgggtncgccaggccgcgtggacaaccgacctggacgtggagtcgggagtcggggaccgtaaacccctaacgaccgttgggtacgtacgacgtaggttcgttcctttaccaaccccgtacttccccggtaccggggaacctacggtaaccctttacccgaagttaccgaaccccgtaaccgtaaacccttaccccttacccaaaacttaaaacccgaaccgtaacggtaacccctaaaccttaaggttacggggtaacggttttacggggaaagggtaccgttacccgttaacggaacctaacgttttacccggaaccggttaacccgggaaaccccggtaaccccggggttaccccggtttaacccttttaaacgtttacccggttacggttccgggtaaacccgggtaacgggttaaacccccgggttacccccggtaacccgggtaaaccgggtttaccccggggttaacgggtaccccgggttacccggttaaacccggggacgtacccggggttacccccggggttttacccgtttttacgggtaacccccggttttcgggggttaacccccggggggg

SEQ ID NO: 206555 - DNA, 592 bp, Homo sapiens
  misc_feature: GYAE6OF01BMP8C.17.25.C03.1.454.CMB.1.raw
  modified_base (288)..(288): a, c, t, g, unknown or other
  misc_feature (288)..(288): n is a, c, g, or t
  modified_base (503)..(503): a, c, t, g, unknown or other
  misc_feature (503)..(503): n is a, c, g, or t
  modified_base (535)..(535): a, c, t, g, unknown or other
  misc_feature (535)..(535): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaggtctcctgcaaggcttctggattcacgtttacctcctatagtatcaatgggtgcgccaggccgntggacacgacctgagtggatgggatgggacaacctaacgactggcgtcacgagtcgtccttccaccctactcccgtccgggacacggtaccttaacccgatcgaacccacgtaacctccctaccaataaaaccacaacgtcctaacagtggtaacgttgaggtacgcctagaactactcgtacgaccgacgaccgggaccgttactacttaccgngtcgcgacgtcgtacccgacgtacgtccgggnggaccgcccgtaccggcgtacggccggttcctttacggaccgttcgggtaccggggg

SEQ ID NO: 206556 - DNA, 744 bp, Homo sapiens
  misc_feature: GYAE6OF01AD71C.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctgaggtgaagagccgtggggcctcgagtgaggtctctgcaggtcttcgtgacttctacgttacctctatagtatctacgtgggtcgcgccgacggccgtcgtacggaccaacgaccgtagaggtggagtgggtagtcgggaccgtaaaccctagacgtggtcgtacgacgtacgttcgtccttacccacccgtacgtcccgtaccggggaactacggtaaccttaaccgacgtaccgaacccgtaaccgtaaccctcccttaaccgaaactaaacccaccgtaacgtacccgtaacgtacggtacgggtacggttaacgggacgggtaccgtaccgtaggaccttaaccgtaccggtaaccggtaacccggaacccgggttacccgggttacccgttaacgtttaaccgtttacggtggttaccggacggaaccgtacccggtaccccgaacgggtccggttacccggggtacgaccggtaccccggtacggtaccgtacgggtacccggtttaccggttacggttcccggttcggggtaacccggggg

SEQ ID NO: 206557 - DNA, 924 bp, Homo sapiens
  misc_feature: GYAE6OF01DRN2O.17.25.C03.1.454.CMB.1.raw
tcagcgtagactagcacgaccggtgctcgatttagtagtgtagatttgggtttggggactcaacaaccacatctgtcctctagagaaaaccctgtgagcacagctccctcaccagtggacgtcggaccgtggaggactccttctttcgttggtggcagcagctaacgaagtcgacccacctacccgaggtcgcgagtcgtggtcgcgtaggtcggtggggctggaggtagaagacggccggtcggggccctgaggtaggaacggttcctccgtgacgaacggtcttcgtggtacttaccgtaaccgttttaccctacgtaagttaacgtactaccgtaacggttcgggtcgccggaccggacgggtcccgtacggttacggaaacccgtaaccgtaccgtaggtacgggttacgggtacggtacggggtaacggttaccggggaaaccccgttaaaaccccgtaaacggtccggttgggttaccgtaaccgaacgttacggtttccgttaccctttaccccgaaccccgttacgttacccccggtaaccggggtaacctaaccgttaaacccgttacccgaagttacccggaaacccgtaacccgtaacccttacccctaaccaaaacgttaaaccccaccgtaaccgttacccgtaaacgttaaggtacggggtaacggttacgggaaccggtaccgtacccgtaacggtaactacgttaccgtaaccgaaaccccgggtaccgtaccccggggttccttaacgtttacgttaaccggtcgggaccgtaacggacccggttaccccgtaaccccgtaacggttccggttacccgggacggtaacccggtccccggtaagggcccggtaaccgggtttcccggttacccgttttacgggtacccggttcggggaaccccggggg

SEQ ID NO: 206558 - DNA, 604 bp, Homo sapiens
  misc_feature: GYAE6OF01DF2Z5.17.25.C03.1.454.CMB.1.raw
  modified_base (245)..(245): a, c, t, g, unknown or other
  misc_feature (245)..(245): n is a, c, g, or t
  modified_base (282)..(282): a, c, t, g, unknown or other
  misc_feature (282)..(282): n is a, c, g, or t
  modified_base (294)..(294): a, c, t, g, unknown or other
  misc_feature (294)..(294): n is a, c, g, or t
  modified_base (338)..(338): a, c, t, g, unknown or other
  misc_feature (338)..(338): n is a, c, g, or t
  modified_base (344)..(344): a, c, t, g, unknown or other
  misc_feature (344)..(344): n is a, c, g, or t
  modified_base (349)..(349): a, c, t, g, unknown or other
  misc_feature (349)..(349): n is a, c, g, or t
  modified_base (433)..(433): a, c, t, g, unknown or other
  misc_feature (433)..(433): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctggtgcagtcgtggggctgaggtgaagagccgtggggcctgagtgaaggtctctgcaggtcttgnggtattcacgtttacctctatagtatcaacgtgggtnccgccagggccngtaggaaccacgacctgaggtggatgggatcgggacaaccctangtggtntacanagttcgtcttccaccctagtcccgacgggacagtaccttacagtacgaccaacgtaacctccaacaataaaccacacgcctaanagtgtagtagagacgcctagactactcgtagaccgaaccgaccgggtaccttagttaacgttacgtcggtacgacggtaacgtacccgttacccgaaggtccgtaccgggtacgaccgttacccgtacgtcggaccgtacggtccggttactttcgggaccgtttcggggg

SEQ ID NO: 206559 - DNA, 707 bp, Homo sapiens
  misc_feature: GYAE6OF01CBDZF.17.25.C03.1.454.CMB.1.raw
  modified_base (289)..(289): a, c, t, g, unknown or other
  misc_feature (289)..(289): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagaagccgtggggcctcagtgaaggtctcctgcaaggcttcgtggattctacgtttacctcctaatagtatcaacgttggggtcncgccgaggccgcgtacgggaccaacgaccgttggaaggtcgggacgtggggacgtacgggggacctaacccgtaacgtacggtggtacggtacaacgtgttacgtccttcaaccctacgtccgtaccggggaactacggtaaccttacaactcgaacccacgtaacctcctacaactaaacacgaaccgtctaactagtacggtaggttaggaccggtacgtacctaggtaactagttacgacgggaacgtaaccggtcccggttaccgttactttaaccgttaacgttcggaaccggtacggtaaccggtacccgttacccgaaacgggtccgttacccgggtacgaaccggttcccggtaacggaccgtacggttacgggtccccgttttggtacccgtttggggaaccccggggg

SEQ ID NO: 206560 - DNA, 592 bp, Homo sapiens
  misc_feature: GYAE6OF01EYJCT.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagaagctggggcctcagtgaaggtctcctgcaggcttctggattcacgtttacctcctatagtatcaacgtgggtgcgccaggccgcgtcggacaacgacctggagtggatgggatggggaccaaccctaacgacgtggtgtacacgagtgtccttccacccctactcccgtccgggacacgtaccttaccatacgaccacgaacctccaccaataaaccacacgacctacagtggtagttggagacgcctgacatcagaccgaccgaccgggtccgtacttagttacgtcgtcggcgtacggtaccgtacccgacggtacgttaccggtcgacggtcccgtacgggctacgggtccgggtacctttcggtacgttcggtaccggggg

SEQ ID NO: 206561 - DNA, 549 bp, Homo sapiens
  misc_feature: GYAE6OF01BMMWW.17.25.C03.1.454.CMB.1.raw
  modified_base (245)..(245): a, c, t, g, unknown or other
  misc_feature (245)..(245): n is a, c, g, or t
  modified_base (334)..(334): a, c, t, g, unknown or other
  misc_feature (334)..(334): n is a, c, g, or t
  modified_base (415)..(415): a, c, t, g, unknown or other
  misc_feature (415)..(415): n is a, c, g, or t
  modified_base (426)..(426): a, c, t, g, unknown or other
  misc_feature (426)..(426): n is a, c, g, or t
  modified_base (444)..(444): a, c, t, g, unknown or other
  misc_feature (444)..(444): n is a, c, g, or t
  modified_base (485)..(485): a, c, t, g, unknown or other
  misc_feature (485)..(485): n is a, c, g, or t
  modified_base (509)..(509): a, c, t, g, unknown or other
  misc_feature (509)..(509): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagaagcctggggcctcagtgaaggtctcctgcaaggcttcnggattcacgtttacctcctatagtatcaactgggtgcgcaggccgctggacaacgcctgagtggagtgggatgggaccgaaccctaacncgtggtgtcacgagtcgtcttcaccctatcccgtccggacacgtacttaccatcgaccacgaactccctaccaataaaccnctacgcctaanagtcggagttagacgganccctagacagtctggacacgaccggtcttactattacgtgngacgagaccgtcccgagctccggngaccgccgtacgcgacggccgttcgttcgcgttcgcgggg

SEQ ID NO: 206562 - DNA, 611 bp, Homo sapiens
  misc_feature: GYAE6OF01AX19T.17.25.C03.1.454.CMB.1.raw
  modified_base (276)..(276): a, c, t, g, unknown or other
  misc_feature (276)..(276): n is a, c, g, or t
  modified_base (295)..(295): a, c, t, g, unknown or other
  misc_feature (295)..(295): n is a, c, g, or t
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggacgttaaaacctatttaaattggtatcagcagaaacctaggaaaacnccccagacctctgactctntggtgcatccactctgacgtaagtggccgtaccagtcgacggttcaggtcggcaggtggatcgtagggactagtactttacaactctaccaacctaactccgtaacctacttcgtacgacctaaaccgtgggtaagtacttggtacgtactaactaccttaacctactgtaccaaacgtacgtaacgtttaaccaccgtttacccctagtcccttacgtttacggacccgtaaggggtaacctaagttaggaacgtaacttaccgaaaccggtagtcggtagtaccgtcgaccctaactacttcgtacgtttaccg

SEQ ID NO: 206563 - DNA, 680 bp, Homo sapiens
  misc_feature: GYAE6OF01BQO99.17.25.C03.1.454.CMB.1.raw
  modified_base (234)..(234): a, c, t, g, unknown or other
  misc_feature (234)..(234): n is a, c, g, or t
tcagcgtagactagcacgaccggtgctcgatttagtagtgtagatttgggtttggggactcaacaaccacatctgtcctctagagaaaaccctgtgagcacagctccctcaccatggactggacctggaggatcctcttcttggtggcagcagctacaagtcgcccactcccgaggtgcagcgtggtgcagtcgtggggctggaggtagaagagccgtgggcctgagtgagtcncgtgcgaggtcttctggtacttcgtaccgtttacctcctaatagtatacaacgtgggtcgccgacgaggccgtcgtacggacaacgaccgtaggaggtggaggtgggagtacgggacctaaacccgtaagtacgtggtcgtacgaacgtagttcgtcccttaccgacccgtacgtccccgtaccgggtaacaccgttaccttaaccacgttaccgaaccctaaccgtaccctaccctaaccgtaaactaaacccaacgtaaccgtacctaacgtaggttaggtacgttacgggaacggacgtccgtagactacgtacgtacggaacgtaccggaccggtcctacgttaacttcgtagcgacggacgaccgtacccgaaggtccgttccggagccggtacccggacgtacgacggtccgttacgtccggtacgttcgggtaccgggg

SEQ ID NO: 206564 - DNA, 600 bp, Homo sapiens
  misc_feature: GYAE6OF01AGVEI.17.25.C03.1.454.CMB.1.raw
  modified_base (453)..(453): a, c, t, g, unknown or other
  misc_feature (453)..(453): n is a, c, g, or t
  modified_base (513)..(513): a, c, t, g, unknown or other
  misc_feature (513)..(513): n is a, c, g, or t
tcagcgtagactagcacgaccggtgctcgatttagtagtgtagatttgggtttggggacgtcaacaaccacatctgtcctctagagaaaaccctgtgagcacagctccctcaccatggactggacctggaggatcctcttcttggtggcagcagctacaagtgcccactcccaggtgcagctggtgcagtctggggctgaggtgaagaagccgtggggcctcgagtgaaggtctcctgcaaggcttctggtatctaccgtttacctcctatagtatctaactgggtgcgccgaggccgctggaacaaccgacctggaggtggagtgggagtcgggaccgaaaccctaacacgtggtcgtacactagtcgtccttccaccctactccgtccgggactacgacttaccatacgtacccaacgtacctaccctaccaactaaaccacacgccctanacgtgagtggtacgacgtcctgactactcgtgaaccgacgacccggtctacttacttacngtcgaccggagccgtaacccacggtctacccgggtgcgaccccgtagggccaggtccgggttacccttcggtactcgggtaccgggg

SEQ ID NO: 206565 - DNA, 581 bp, Homo sapiens
  misc_feature: GYAE6OF01CBR7K.17.25.C03.1.454.CMB.1.raw
  modified_base (508)..(508): a, c, t, g, unknown or other
  misc_feature (508)..(508): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagccgtggggcctcagtgaaggtctcctgcaaggcttcgtggattcacgtttacctcctatagtatcaacgtgggtgcgccaggccgctggacaacgactgacgtggatgggatcgggaccgaaaccctaagacggtggtacgtacacgtagttcgtacttaccacccctagtcccgtacgggactagaccttacatcgaacctacgaactcctacaataaacacacgtactaacagtacgggagttagacgggactccgtagacagttcacggaccgacgaccggtcttactattacgngtggacgtgacgtcccagtcgtcggtagcgtaccgtaggcgtcggacgttccgtttaggcgttcgggacgggg

SEQ ID NO: 206566 - DNA, 614 bp, Homo sapiens
  misc_feature: GYAE6OF01BHCKR.17.25.C03.1.454.CMB.1.raw
  modified_base (244)..(244): a, c, t, g, unknown or other
  misc_feature (244)..(244): n is a, c, g, or t
  modified_base (280)..(280): a, c, t, g, unknown or other
  misc_feature (280)..(280): n is a, c, g, or t
  modified_base (450)..(450): a, c, t, g, unknown or other
  misc_feature (450)..(450): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttcnggattcacgtttacctcctatagtatcaactgggtncgcaggccgctggacaacgacctgaggtggatgggatgggaccgaaaccctaacgacgtggtcgtcacgtagtgtccttacacccctatcccgtaccgggacagtaccttaccatcgaccacgaacctcctacaactaaacacacgcctaacagtggtagttgacggacnccgtagacctatcgtacgaaccgaccgacccgggtacccgttcttaacgtttactggtgaccggtaggtaccgtaccccgacgtacgttacccgggtgaccggtcccgtaacgggccgtacgggtcccggttaccgtttacgtacccgtttgggtacccggggg

SEQ ID NO: 206567 - DNA, 527 bp, Homo sapiens
  misc_feature: GYAE6OF01EKYHS.17.25.C03.1.454.CMB.1.raw
  modified_base (244)..(244): a, c, t, g, unknown or other
  misc_feature (244)..(244): n is a, c, g, or t
  modified_base (260)..(260): a, c, t, g, unknown or other
  misc_feature (260)..(260): n is a, c, g, or t
  modified_base (333)..(333): a, c, t, g, unknown or other
  misc_feature (333)..(333): n is a, c, g, or t
  modified_base (422)..(422): a, c, t, g, unknown or other
  misc_feature (422)..(422): n is a, c, g, or t
  modified_base (442)..(442): a, c, t, g, unknown or other
  misc_feature (442)..(442): n is a, c, g, or t
  modified_base (474)..(474): a, c, t, g, unknown or other
  misc_feature (474)..(474): n is a, c, g, or t
  modified_base (476)..(476): a, c, t, g, unknown or other
  misc_feature (476)..(476): n is a, c, g, or t
  modified_base (493)..(493): a, c, t, g, unknown or other
  misc_feature (493)..(493): n is a, c, g, or t
  modified_base (514)..(514): a, c, t, g, unknown or other
  misc_feature (514)..(514): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttcnggattcacgtttaccncctatagtatcaacgtgggtgcgccaggccgctggacaacggcctgagtggatgggatcgggacaaccctaanacgtggtgtcacagtcgtcttccaccctactccgtccgggacagaccttaccatcgaccacgaacctccctacactaaacacagcctanatggagttgagagcctgacntctgaccgacgacggcccgtcttacttactgngngtacgtattgtttcgtntcatcgtactaattgactagntctagtggtaacg

SEQ ID NO: 206568 - DNA, 827 bp, Homo sapiens
  misc_feature: GYAE6OF01ARLUL.17.25.C03.1.454.CMB.1.raw
  modified_base (242)..(242): a, c, t, g, unknown or other
  misc_feature (242)..(242): n is a, c, g, or t
tcagcgtagactagcacgaccggtgctcgatttagtagtgtagatttgggtttggggggactcgaacaaccacactacctggtcctctagagaaaaccctggtgagcacgacgctccctcaccatcggacgtcggacctgggaggatcctcttcgttggtggcagcagctacgaagtcgcccactcccaggtcgccagctggtcgcctacgtcgtgggctgaggtgaagagccgtgggcctnagtgagtctcctgcaggtctcgtggacttcgtaccgtttacctaccttaagttagtactacaacgtgggtacaccgtaccgacggcccgtaccgtacggaaccctaaccggtaccgttcggtacggtacggtacgttacggggtacgttacggggtaacccgtaaaacccgttaacgtccgttagggttacgtaaccgtacgtaggtttcggttaccttaccgaacccgttacgttacccggtaacccgggtaacttaaccggtttaaccctttacccgaacgttaccgtaacccgtaaccggtaaccccttcccgtaacccctaaacgttaaaacccaccggtaaccgtacccttaagtaacgggttaggtaacgtttacggacgtaccgtccttaacgtaaccgtacgttccgttaccgaacccgttacccgtacccggggttacctttaccggttaacgtttacccgggagtaccggaccgggtaacgtacccgtacccgaaccggttaacggtcccgggtaggccgtaccccgtaggacccgtacggtccggtttccttcggtaccgtttcgggacccggg

SEQ ID NO: 206569 - DNA, 737 bp, Homo sapiens
  misc_feature: GYAE6OF01CR8IK.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattctacgtttacctcctatagtatcaactgggtgcgccaggccgctggacaacgacctgagtggagtgggatcggggaccgaaccctaacaccgttgggtcgtcaccgaaggttcgttacctttaccaacccctactcccgttacccggggacctacggtacctttaccagttacgacccaaccgtaaacccttccccttacccaaacttaaaaacccaacctaacggtaacccttaaccgaagttacggggtaacgttttacgggaagggtaccgtaccccgttacgaacctaactttcccggtaagaccggtaacccgaacccgggtacccgtttaccgtttaactttaaccgttggttacggaccggtaacgtacccggttcccgaacggtaccggttcccgggtaacgggtcgtaccccggtacggacccggtacgggtaccccggtttccgttttaacggtccggtttccggggtacccgggggg

SEQ ID NO: 206570 - DNA, 550 bp, Homo sapiens
  misc_feature: GYAE6OF01B46H4.17.25.C03.1.454.CMB.1.raw
tcagcgtagactagcacgaccggtgctcgatttagtagtgtagatttgggtttgggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatggggaccaaccctaacacgtggtgtcacagtgtcttcacccatcccgtccgggacagacttaccatcgaccacgtaacctcctaccaataaacacaagcctaacatgggattggagacgcctagacatcagacgacacggtctcttattacgtgtgcgacgacgtcccgaacgacgtccgggtgacgcccgtaacggcgacggcggttcctttcggtcgttcgggtccgggg

SEQ ID NO: 206571 - DNA, 527 bp, Homo sapiens
  misc_feature: GYAE6OF01DN35V.17.25.C03.1.454.CMB.1.raw
  modified_base (430)..(430): a, c, t, g, unknown or other
  misc_feature (430)..(430): n is a, c, g, or t
  modified_base (465)..(465): a, c, t, g, unknown or other
  misc_feature (465)..(465): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtcgtcttcacccatccgtccgggacagacttaccatcgaccacgaacttcctccaataaacacagcctaacatgggattgaggacncctagacatctgacgacacgggtcttactattacngtcgcgagacgtcccagtactccggtgacgcctaggctaggcgtcctttgcgtttcgcgggg

SEQ ID NO: 206572 - DNA, 802 bp, Homo sapiens
  misc_feature: GYAE6OF01EZJ72.17.25.C03.1.454.CMB.1.raw
  modified_base (210)..(210): a, c, t, g, unknown or other
  misc_feature (210)..(210): n is a, c, g, or t
tcagcgtagactagcacgaccggtgctcgatttagtagtgtagatttgggtttgggggtacggtcaacgaaccacatcctgtcctcgtagagaaaaccctgtgagcacagcgtccctcaccatcggacctgggaccttggaggactcctcttcttgggtcggccaggcagactacgaagtcgcccactccgaggtcgcacgtcctggtcncctagtcgtcgggctggaggttgaagaacgccgtgggcctacgtagtcgaacggttcgtccgtagtacgtaacgggtcttcgtgggtactttacgtaccgttttacctaccgtaacttacggttactacgtaacgttggggtacgaccggtaccggaacggtcccgtacgtacgggacctaaccggtccgtagtacggttggacgtcgggtacgtcgggtaaccgtaaaccgtaagtcggtacggtcgtactaacgtacgttgtcctacgaaccctcgttccgtacggaactacgtaccttacgtaacgttcaacccgtaaccgtaacctcccgtaacaacgtaaacaccgtaaccggtcctaacgtaaccggtacgggtaacgttaacgggaacgttaccgtacccgttaaccggaacttaacgttaccgtaaggtaaccgtaacccgttaacgggtaaccctttaacgttaactttaccgtacgttaccggtccggtaacgggtacccgtaacccggtaacggtcggtaccggttagacggttaccaacgggtctacgggtcgttactttacggaccttcggtaccgggg

SEQ ID NO: 206573 - DNA, 697 bp, Homo sapiens
  misc_feature: GYAE6OF01C0B8Z.17.25.C03.1.454.CMB.1.raw
  modified_base (289)..(289): a, c, t, g, unknown or other
  misc_feature (289)..(289): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtgcagcagctacaagtgcccactcccaggtgcagctggtgcagtcgtggggctggaggtgaagaagccgtggggcctcgagtgaaggtctccgtgcaaggcttcgtggattctacgtttacctctattagtactcaacgtgggtcncgccgacggccgcgtcgggaacacgaccgtggaggtggagtgggagtcggggaccgaaccctaagacgtggtctcaacgtagttcgtccttaccacccgtacgttcccgtaccggggactacggtaacctttaccgattacgaacccaaccgtaaccctcccctaacaaacgttaaaccaaccgtacgtacccttaaacgaggttacgggtaagtttacgggaacggtaccgtcccgttaagacctagttccgtacggaaccgtacgaccgggtccgttacttacgttacgtcgacggtaccgacgtaccgtcccgaacggtacgttcccgggtaacggtaccggacccgttacgggcctaacgggttcccggttaccttttacgggcccgtttcgggtacccggggg

SEQ ID NO: 206574 - DNA, 678 bp, Homo sapiens
  misc_feature: GYAE6OF01CN3P8.17.25.C03.1.454.CMB.1.raw
  modified_base (278)..(278): a, c, t, g, unknown or other
  misc_feature (278)..(278): n is a, c, g, or t
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatcctccctgtctgcctctggtgggggtcagagtcaccatcacttgccggacaagtcacggacgttaaaacctattttaaatggtatcagcaagaaacctaggaaaacnccccaagacctctgatctctggtgcactccactcgtgcgaagtcggctcccatcggaggttcagtggcaggtgatcgtaggacagtatttcaacttcctacacctactccaccctactcgtacgacccaaaccgttggaaacggttatttggtacgtaaccttaaagttcccgtttaaaccgtttaacgttacgttaacccgaaacgtaacggttaaccgtttaacccgtacccgttttaccccccgttcgtacccttttaccgggtttttccggaccccgggttaaacggggtaaacccgttaaagggttacgtaaacggtaaacgtaacccgtaaaaacgtccggttagggtacggtacccgttaggacccctaaccgtaacttcgttcgtttacccg

SEQ ID NO: 206575 - DNA, 636 bp, Homo sapiens
  misc_feature: GYAE6OF01APZGA.17.25.C03.1.454.CMB.1.raw
  modified_base (280)..(280): a, c, t, g, unknown or other
  misc_feature (280)..(280): n is a, c, g, or t
  modified_base (334)..(334): a, c, t, g, unknown or other
  misc_feature (334)..(334): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacaacgacctgagtggatgggatcgggacgaaccctaacncgtggtgtacacagtgtccttcaccccactcccgtaccggggacacgtaccttaccatcgaacccacgaacctcctaccaactaaaccacacgtaccctaacagttcgggaagttcggaaggtacgcccgttaggaacctattccgtaggaacccgaaccgtaccgggtcccgttacttaactttaccgtggttcggacggtaacggaccgttaccccgaacggtccgtcccgggtagaccggacccgttaacgggccaacgggtcccggttaccttttacggacctttcgggacccggggg

SEQ ID NO: 206576 - DNA, 533 bp, Homo sapiens
  misc_feature: GYAE6OF01AQRBE.17.25.C03.1.454.CMB.1.raw
  modified_base (330)..(330): a, c, t, g, unknown or other
  misc_feature (330)..(330): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcaaccctaanacgtggtgtcactagtgtcttcacccatcctccgggacagtacttaccatcgaccacgaactcctaccaataaacacagcctacatggagttgaggacgcctgactatcgtgacgacacggtccgtactacttactgtgcgagacgtccccagacgttccggagacgccctaggcacggcggtacctttgcgttcggtcgggg

SEQ ID NO: 206577 - DNA, 661 bp, Homo sapiens
  misc_feature: GYAE6OF01DECS2.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggagtgggatgggacaacctaacacgtggtcgtcacgtagtcgtcttccaccctactcccgtccgggactacgaccttaccatcgaccaacgtaacctccctaaccaataaaaccacacgtaaccctaacgagttacgggtaaggtttcggaaacgggacgtcccgttaggaacctacgttcgtaacggaacccggtaacccggaacccggggttcccgttaacgtttaacgtttaaccgttgggtaccggaccggtaacggacccgttacccgaacggtcggtacccgggtaggaccgtcccggtaacggcgtacggtccggttacctttacggccgttcgggtaccggggg

SEQ ID NO: 206578 - DNA, 562 bp, Homo sapiens
  misc_feature: GYAE6OF01AKYOH.17.25.C03.1.454.CMB.1.raw
  modified_base (514)..(514): a, c, t, g, unknown or other
  misc_feature (514)..(514): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatactcttcttggtggcagcagctacaagtgcccactcccaggtgcagctggtgcagtctggggctgaggtgaagaagcctgggcctcagtgaaggtctcctgcaaggcttctggattcacgtttacctcctatagtatcaactgggtgcgccaggccgctggacaacgacctgagtggatggggatgggaccgaaaccctaacacgtggtcgtcactaggtcgtccttaccacccctatcccgtccggggacaggtaccttaccatcgaacccacgaacctcctaccaataaaccacagcctacatggagttgaggagcctagacatctagacacgacggtccctattattactggtgcgagacgtcccacggtcgtccgggngacgcccgtacggcgacggccgtcctttcggtacgttcggtacggggg

SEQ ID NO: 206579 - DNA, 633 bp, Homo sapiens
  misc_feature: GYAE6OF01A55WJ.17.25.C03.1.454.CMB.1.raw
  modified_base (300)..(300): a, c, t, g, unknown or other
  misc_feature (300)..(300): n is a, c, g, or t
  modified_base (313)..(313): a, c, t, g, unknown or other
  misc_feature (313)..(313): n is a, c, g, or t
  modified_base (403)..(403): a, c, t, g, unknown or other
  misc_feature (403)..(403): n is a, c, g, or t
  modified_base (417)..(417): a, c, t, g, unknown or other
  misc_feature (417)..(417): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggactcctcttcttggtggcagcagctacaagtcgcccactcccaggtgcagcgtggtgcagtcgtgggctggaggtgaagagcgtggggcctcgagtagaacggtctccgtgcgaaggtcttcgtggacttccgtaccgttttacctccttattagtactcaacgtgggtnccgcacggccgtntacggacaacgacctggagttggcgtgggagtcgggaccgtaaaccctaacgacggtggtcgtaccagtacgtcgtccttaccgaccccngttcccgaccgganactacttacagtcgaaccgaccgacctacctaccactaaacacacgactactagtacggtacgtagtagacgtacgtacgtacgacgtacgtacgtacgaccgaccggtaccgtacttacgttacgtagtacgtcgacggaccgtaccgaccgtaccgtacgtacggaccgaccgtacgcgtacgtcgtaccgttacgtcgttaaacgggtccggg

SEQ ID NO: 206580 - DNA, 520 bp, Homo sapiens
  misc_feature: GYAE6OF01A2GAX.17.25.C03.1.454.CMB.1.raw
  modified_base (349)..(349): a, c, t, g, unknown or other
  misc_feature (349)..(349): n is a, c, g, or t
  modified_base (451)..(451): a, c, t, g, unknown or other
  misc_feature (451)..(451): n is a, c, g, or t
  modified_base (470)..(470): a, c, t, g, unknown or other
  misc_feature (470)..(470): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcaaccctacactggtgtcacagtgtcttnacccatcctccgggacagacttaccatgaccacgaactcctccataacacagcctacatgagttgagagcctgacatctgaccgacacggccgtctattacngtgcgagacgttcccagtntcccggtagcgccctacggcaggcggtaccctttgacttccgtacggggg

SEQ ID NO: 206581 - DNA, 592 bp, Homo sapiens
  misc_feature: GYAE6OF01CJDTN.17.25.C03.1.454.CMB.1.raw
  modified_base (497)..(497): a, c, t, g, unknown or other
  misc_feature (497)..(497): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagccgtggggcctcagtgaaggtctcctgcaaggcttctggattcacgtttacctcctatagtatcaactgggtgcgccaggccgctggacaacgacctgagtggatgggatgggaccgaaccctaacgacgtggtacgtcacgtagttcgtccttccacccctatcccgtaccggggacacgaccttaccatacgaccacgaacctcctaccaataaaccacacgaccctaacagtagggagttggacggacgtcctagacagtctaggaaccgacgacgggtaccgttntacttacgtgtgcgtagccgtacccacgtacgtccggtagaccggcccgttacggccgtacggccggttaccctttggccgttcggtaccggggg

SEQ ID NO: 206582 - DNA, 677 bp, Homo sapiens
  misc_feature: GYAE6OF01D4DS7.17.25.C03.1.454.CMB.1.raw
  modified_base (250)..(250): a, c, t, g, unknown or other
  misc_feature (250)..(250): n is a, c, g, or t
  modified_base (268)..(268): a, c, t, g, unknown or other
  misc_feature (268)..(268): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggactcctcttcttggtggcagcagctacaagtcgcccactcccaggtgcagctggtgcagtcgtggggctggaggtgaagacgcgtggggcctgagtgaaggtctcgtgcaaggtcttcgnggtacttcacgtttaccncctatagtactacgaacgtgggtcgccgccgacgggcccgtacgtacgggaacctaacggtacctaggtaacggtgggaagttcggggagtcgggaacccgtaaacctaaccgtacgtgggtacgtacgaacgtaggtcgtcttaccacctacgtccgtacgggacacgtaccttacgagtaccgaacctacgtaacctccgtaccaaataaccgcaacgacctacgtaagtacggggtagttaggaaccggacgtacctaaggtaccacgtacgtccggaaaccgcccggaccgggttccccttagttacttaccggtgtcgacggtacgacccgtaccacggtaacgtccgggtgaacccgccgtacggacgacggtcccgttattccggtccgttcgggaccgggg

SEQ ID NO: 206583 - DNA, 782 bp, Homo sapiens
  misc_feature: GYAE6OF01BPOC1.17.25.C03.1.454.CMB.1.raw
  modified_base (257)..(257): a, c, t, g, unknown or other
  misc_feature (257)..(257): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccagtgcagctggtgcagtctggggctgaggtgaagagcctggggcctcagtgaaggtctcctgcaggcttctggattcacgtttaccncctatagtatcaactgggtcgcgtccaggccgcgtgggaccaacggaccctggacggttgggagtggggagtcggggacctaaacccgtaacacgttcggtacgtacacgtaaggtcgttccttaccgaccccgtacttcccggtaccgggaccgtacggtaacctttaacccgattaccgaacccgtaacccgtaacccgttacccccttaaccaaaacttaaaacccccgacgtaaacccggtccccttaaaccgtaaacggtttggggtaaacgtttacggggaacgggtaacggtccccttaacggaaaccgtaccgttacgtaacgggaacccggtaacccgtaccggggtaccccgtttaatttaaccgtttaccggtagggtaccgacggtaccggtaccggttacccccggaacggtaccggttcccggggtacgacggtaccccggtaaccggcccgtacggggttacccggtttaccgttttaccgggaccgtttccggggtaaaccccgggggg

SEQ ID NO: 206584 - DNA, 538 bp, Homo sapiens
  misc_feature: GYAE6OF01BGNP4.17.25.C03.1.454.CMB.1.raw
  modified_base (242)..(242): a, c, t, g, unknown or other
  misc_feature (242)..(242): n is a, c, g, or t
  modified_base (278)..(278): a, c, t, g, unknown or other
  misc_feature (278)..(278): n is a, c, g, or t
  modified_base (425)..(425): a, c, t, g, unknown or other
  misc_feature (425)..(425): n is a, c, g, or t
  modified_base (452)..(452): a, c, t, g, unknown or other
  misc_feature (452)..(452): n is a, c, g, or t
  modified_base (473)..(473): a, c, t, g, unknown or other
  misc_feature (473)..(473): n is a, c, g, or t
  modified_base (499)..(499): a, c, t, g, unknown or other
  misc_feature (499)..(499): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaggcttcnggattcacgtttacctcctatagtatcaactgggtncgccaggccgctggacaacgacctggagtggagtgggatggggaccaaccctacacgtggtcgtcacgagtcgtcttcaccctatcccgtccgggacacgtacttaccatcgaccacgtaacctcctaccaataaacacacgcctanagtggagttgaggagcctgacagtcgngacgatacggccttctattcngtcgcgagacgtcccacggctccggngcgccgtacggcgtaggccgtccttgcgttcggtcgggg

SEQ ID NO: 206585 - DNA, 566 bp, Homo sapiens
  misc_feature: GYAE6OF01C7X3J.17.25.C03.1.454.CMB.1.raw
  modified_base (355)..(355): a, c, t, g, unknown or other
  misc_feature (355)..(355): n is a, c, g, or t
  modified_base (388)..(388): a, c, t, g, unknown or other
  misc_feature (388)..(388): n is a, c, g, or t
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggacttaaaacctatttaaattggtatcagcaagaaaacctggaaaacgccccagaccctcctgactctctggtcgcatcccactctgacgaagtcggcgtaccatcgagttcagtgcagtggatcgnggacagtattcaatctcaccatcacctactctnacctaaccgtgaaggtacttgtacgacctaattcctaacttacgttacgtacctaacgaagtacgtttaacaccgtttcccctcgtccttacgttttcggaccgtacgggtaacctaaaggttacgagtaactacgaaaacgtacgtcgtaggctacgactacctactcgtgttaccc

SEQ ID NO: 206586 - DNA, 629 bp, Homo sapiens
  misc_feature: GYAE6OF01ASO9D.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagcctggggcctcagtgaaggtctcctgcaaggcttctggtattctacgtttacctcctatagtatcaacgtgggtgcgccaggccgcgtggaccaacgacctgagtggagtgggagtcgggacgaacccgtaacgacgtggtcgtcactagttcgtccttaccaccccgtactcccgtccggacacgtacttaccatacgaccacgtaacctcctaccaataaaccacacgacctacgagtaggtagttaggacggtacgtccctagacctagtcgtacggaaccgtacgaccgggtccttacgttactttcgtcggtcgaccgtagaccgtaccccaaggtaccgtccggtacggaccgtacccggtaccggaccgtacgggtcccggttaccgtttcgtcccgtttcggtaccggggg

SEQ ID NO: 206587 - DNA, 703 bp, Homo sapiens
  misc_feature: GYAE6OF01D9M42.17.25.C03.1.454.CMB.1.raw
  modified_base (279)..(279): a, c, t, g, unknown or other
  misc_feature (279)..(279): n is a, c, g, or t
  modified_base (453)..(453): a, c, t, g, unknown or other
  misc_feature (453)..(453): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagagcctggggcctcagtgaaggtctcctgcaaggcttctggattcacgtttacctcctatgtatcaactgggtncgccaggccgctggaccaacgacctgacgtgggatgggaactggggaccgaaacccctagactgggtgtaccacgtagtcgttcttccaccccacgttcccgaccggggacacggtaaccttacccatacgaacccacgaacctccctaccgaactaaaccactacgaccctanagttaggagttcgaaggctacccgtagtacccaattccgtacggaaccgtacccggtacccgggcccgtttaaccttaacggtttacctgggttacgaccggaacgggtaccgttacccccggaacggttaccggttacccggggttacggaccggttacccccggtaaaccggggtcccggtaaccgggttaccccgggtttaccctttttaccgggtaacccggttttcccgggaacccggggggggg

SEQ ID NO: 206588 - DNA, 639 bp, Homo sapiens
  misc_feature: GYAE6OF01EKHIY.17.25.C03.1.454.CMB.1.raw
  modified_base (244)..(244): a, c, t, g, unknown or other
  misc_feature (244)..(244): n is a, c, g, or t
  modified_base (496)..(496): a, c, t, g, unknown or other
  misc_feature (496)..(496): n is a, c, g, or t
  modified_base (543)..(543): a, c, t, g, unknown or other
  misc_feature (543)..(543): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttctggtggcagcagctacaagtgcccactcccaggtgcagctggtgcagtctggggctgaggtgaagaagccgtggggcctcagtgaaggtctcctgcaaggtcttnggattctacgttacctcctatagtatcaacgtgggtgccgcgacggccgtcgtaggaaccaaccgaccgtggaacggtgggtaggtggggaatcgggggaccgtaaacccctaaacgacgttgggtacgtacacgagttcggttccttaccaccccgtatcccgtccgggacagtaccttaccagttcgaccacgtaacctcccgtacctaataaacccacacgtacctacacgtaggagttacgaggtacnccgtagaccatcgacgaacgaccgacgggtcccttagtacgtttacnggtcgacggaacgtaccgtacccgacggtacgtccgggtagaccgtccgtacgggactacgggccgttaccgtttcggtccgttcgggtaccgggg

SEQ ID NO: 206589 - DNA, 601 bp, Homo sapiens
  misc_feature: GYAE6OF01D3ZH9.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagccgtggggcctcagtgaaggtctcctgcaaggcttctggattcacgttttacctcctatagtatcaacgtgggtcgcgccaggcccgctggaccaacgacctggacgtgggatggggatcggggaccgtaaccctaacgactggtctcacgtagtgtccttcacccctatcccgtaccgggactacgtaccttaccgagtacgaacccaacgtaacctccctaccaactaaaccacacgacctacagtaggagtttaggagtacgcctagactatcgacggaaccgacgaccggtccgttacgttacttacgtgtcgcgagtaccgtcccgacgacgtccggtagccgaccgtacggcgtacggccgtccgtttcgtacgttcggtaccgggg

SEQ ID NO: 206590 - DNA, 703 bp, Homo sapiens
  misc_feature: GYAE6OF01EJBQM.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctggaggtgaagagccgtggggcctcgagtgaaggtctccgtgcgaggtcttcgtggtacttctaccgtttacctccttaatagtactcgtaacgtgggtcgccgtccgacgggcccgtcgtacgggaaccaaccggtaccgtaggaggtggagtggggacgtcgggaccgtaaaccctaacgacggtcggtcgtacacgtaggttcgttaccttacccgaccctacgttccccgtaccggggaactacggtaccttaaccgacgtaccgaaccctaaccgtaaccctaccccgtaaccaaacttaaacccacgtaaccgtaccctaagaacgttacgggtaacgttacggaacggtacgaccctagaacctacgtacgtaacggaccgtaccgtaccggtccgttacttacttacgtgtcgacgtacgtaccgtacccgacgtcgttccgggacgtccgaccgtacggacgtacggtccggttacttcggtacgttcgggtaccgggg

SEQ ID NO: 206591 - DNA, 620 bp, Homo sapiens
  misc_feature: GYAE6OF01EOGBD.17.25.C03.1.454.CMB.1.raw
  modified_base (285)..(285): a, c, t, g, unknown or other
  misc_feature (285)..(285): n is a, c, g, or t
tcagcgtagactagcacgaccggtgctcgatttagtagtgtagatttgggtttgggagtcagtctcagtcaggacacagcatggacatgagggtccccgctcagctccgtggggctcctgctactctggctccgagctgccagatgtgacatccagatcgacccagtcctccactccctcctgtctgcctcgtggtggggtcagacgtccaccatcacttcgccggaacagtcacggtacttaaaacctatttaaagtggtatcagacaagaaacctaggaaacncccaagacctctagtacttctcgtggtcactactccactcgtgacgaagtcgcctaccagtcgtaggttcaggtggctaggtggtacgtccggtagggaactagtactttacaacttcctacacctactacccaacctactcgtacgacctaacgtaggtagtattgacgtactaacttactactactacgtacaacgtagtaacttaccgtccgttccccgtgtaccgttacgtttaccggaccggtaacgggtaaccgtaaaggttacgtaacgtacgtaaccgaaacggtacgttcggtacgtcgtacgacctactacttccgttcgttacc

SEQ ID NO: 206592 - DNA, 654 bp, Homo sapiens
  misc_feature: GYAE6OF01DLM9X.17.25.C03.1.454.CMB.1.raw
  modified_base (308)..(308): a, c, t, g, unknown or other
  misc_feature (308)..(308): n is a, c, g, or t
  modified_base (378)..(378): a, c, t, g, unknown or other
  misc_feature (378)..(378): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggtagcagctacaagtgcccactcccaggtgcagctggtgcagtctggggctgaggtgaagaagcctggggcctcagtgaaggtctcctgcaaggcttcgtggtattcacgttttaccctccttaatagtaatcaaacgttggggtacgccgccagggccccgngtacgggaaccaaaccggcctggaggttgggaagttggggatggggaccgaaacccctaacacgtgggtntccactagttcgtcttaccacccagtccctaccgggaacagtaccttaccatcggaacccacgtaacctccctaccaactaaacaccagtacctaacagtcggagttaggaggacgtcctagtacactcgtgaaccgacgaccggtccgttactacgtttacctggtcggaccgaagtaccgtaccccgaggtaacgttcccgggtagacggtacccgtaccgggctacgggtacccggttactttcggtaacgtttccgggcgggggtaccccgg

SEQ ID NO: 206593 - DNA, 511 bp, Homo sapiens
  misc_feature: GYAE6OF01CKMKD.17.25.C03.1.454.CMB.1.raw
  modified_base (281)..(281): a, c, t, g, unknown or other
  misc_feature (281)..(281): n is a, c, g, or t
  modified_base (330)..(330): a, c, t, g, unknown or other
  misc_feature (330)..(330): n is a, c, g, or t
  modified_base (390)..(390): a, c, t, g, unknown or other
  misc_feature (390)..(390): n is a, c, g, or t
  modified_base (406)..(406): a, c, t, g, unknown or other
  misc_feature (406)..(406): n is a, c, g, or t
  modified_base (419)..(419): a, c, t, g, unknown or other
  misc_feature (419)..(419): n is a, c, g, or t
  modified_base (426)..(426): a, c, t, g, unknown or other
  misc_feature (426)..(426): n is a, c, g, or t
  modified_base (459)..(459): a, c, t, g, unknown or other
  misc_feature (459)..(459): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctgggggcctcagtgaaggtctcctgcaaggcttctggattcacgtttacctcctatagtatcaactgggtncgccaggccgctggacacgacctgagtggatgggatgggcgaaccctanactggtgtcacagtgtcttcacctatcctcgggacagacttaccatgaccacgaactccncataaacacagcctanatggagttgaggncctgacntctgacgacacggccgtactattactgtgcganacgtcccagactcggtgcgcctacggctacggcgtctttcgcgttcgtcggg

SEQ ID NO: 206594 - DNA, 606 bp, Homo sapiens
  misc_feature: GYAE6OF01A9IF9.17.25.C03.1.454.CMB.1.raw
  modified_base (460)..(460): a, c, t, g, unknown or other
  misc_feature (460)..(460): n is a, c, g, or t
  modified_base (475)..(475): a, c, t, g, unknown or other
  misc_feature (475)..(475): n is a, c, g, or t
  modified_base (483)..(483): a, c, t, g, unknown or other
  misc_feature (483)..(483): n is a, c, g, or t
  modified_base (550)..(550): a, c, t, g, unknown or other
  misc_feature (550)..(550): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagccgtggggcctcagtgaaggtctccgtgcgaggcttcgtggtacttcgtaccgtttacctcctaatagtatactaacgtgggtgccgccgacggccgcgtacggaaccaaccgtcctggagtggagtgggagtacgggaccgaaccctaacgacgtggtgtacacgagttcgtcttccaccctatcccgtaccggtacacgtaccttacagtacgacctacgacctcctaccaataaccacacgacctanagtggagttgagacncctagacngtcagaccgacgacggtcctattacgttacgtcgtacgcgtacgaccgtaccgacgtacgtcccggngaccgtccgtacggcgtacggtcggttaccgtttcgtaccgttcgggtacccgggg

SEQ ID NO: 206595 - DNA, 711 bp, Homo sapiens
  misc_feature: GYAE6OF01CAWMM.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatctcttcttggtgcagcagctacaagtgcccactcccaggtgcagctggtgcagtcgtgggctggaggtgaagaagccgtggggcctcgagtgaagtctcgtgcaaggcttctggattctacgtttacctctatagtatcaacgtgggtcgcgccgaggccgcgtacggaccgaaacgccgttaggacggtggtacgtggggacgttcggggaacccgaaaaccccgttaaacgtacgttagggtcgtaccgaacgtaggtttcgtcctttaccgacccctaacgttccccggtaccgggaacctaacggtaaccttaaccgagtaccgaacccgtaaccgaacccttccctaaccaaacttaaaccaaccgtacgtaccctaacgagttggaagttacggaacggcgtccaggaactacgttcgaccgtaacgaccggtaccggtacccgtacttaacgttcgtagtcgacggtaagacccgtaccgtaacggtccgtccgggtaacggtccgtacccgtacgggacctacgggtacccggttcgttttaccggtaccggtttccggggtacccggggg

SEQ ID NO: 206596 - DNA, 534 bp, Homo sapiens
  misc_feature: GYAE6OF01ALU4B.17.25.C03.1.454.CMB.1.raw
  modified_base (280)..(280): a, c, t, g, unknown or other
  misc_feature (280)..(280): n is a, c, g, or t
  modified_base (418)..(418): a, c, t, g, unknown or other
  misc_feature (418)..(418): n is a, c, g, or t
  modified_base (429)..(429): a, c, t, g, unknown or other
  misc_feature (429)..(429): n is a, c, g, or t
  modified_base (490)..(490): a, c, t, g, unknown or other
  misc_feature (490)..(490): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacaacgacctgagtggatgggatgggcgaaccctaacacgtggtgtcacagtgtcttccacccatcctccggggacacgacttaccatcgaccacgaactcctaccaactaacacagcctacanggagttgaggngcctgacatctgacgacacggccgtactattactgtgcgagtacgtcccacgcgttccggngacgtcccgtacggcacggtccggtcctttgcgttcggtcgggg

SEQ ID NO: 206597 - DNA, 568 bp, Homo sapiens
  misc_feature: GYAE6OF01CQ18M.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagccgtggggcctcagtgaaggtctcctgcaaggcttcgtggattctacgtttacctcctatagtatcaacgtggtgcgccaggccgctggacacgcctgagtggagtgggatgggaccaacccgtacacgtggtctcacagtgtcttcaccctagtccgtaccgggacagtaccttacatcgaccacgtactcctaccaactaacacacgacctacagtaggagttggagtagcctagactatctcgacgaccgacggtccgtactacttacgtgtacgacgtagaccgtacccgacggtacgtcccggtaggaccgcccgtacggacgtacggccggtccgtttcgcgttcggtaccgggg

SEQ ID NO: 206598 - DNA, 633 bp, Homo sapiens
  misc_feature: GYAE6OF01CS6R9.17.25.C03.1.454.CMB.1.raw
  modified_base (274)..(274): a, c, t, g, unknown or other
  misc_feature (274)..(274): n is a, c, g, or t
  modified_base (298)..(298): a, c, t, g, unknown or other
  misc_feature (298)..(298): n is a, c, g, or t
  modified_base (352)..(352): a, c, t, g, unknown or other
  misc_feature (352)..(352): n is a, c, g, or t
  modified_base (408)..(408): a, c, t, g, unknown or other
  misc_feature (408)..(408): n is a, c, g, or t
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatcctccctgtctgcctctggtgggggtcagagtcaccatcacttgccggacagtcacggacttaaaactatttaaattggtatcagcaagaaacctggaaaacnccccagacctcctgatctctggtncactccactctgacgaagtcggccgtccagtcgagttcaggtgcagtggatcgnggacagtatttcaatctacaccactccacctactctcgacctaaccgtggaaggtntttggtacgtactaaacttccgttaacttaccgttacgtaacctaaacgtaagttaacgtttaacccgtaccgtttcccccgtacgtacctttaaccggttttacgggacccgtaaacggggtaaccctaaaaggtttacggaacgtaaacgtaacccgtaaaacggtaacgttcgggttacggacccttacgtaccctaacctaacgttccgttcggtttaccc

SEQ ID NO: 206599 - DNA, 704 bp, Homo sapiens
  misc_feature: GYAE6OF01CHE30.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagaagcctggggcctcagtgaaggtctcctgcaaggcttcgtggattcacgtttacctcctatagtatcaacgtgggtgccgccaggccgcgtggacaacgcctgagtggagtgggatggggaccaaaccctaacgacgttggtgtccaacgtaggtcgttacctttaccaaccctacgttccccgtacccgggggaccaacggtacctttaacccaagttacgaaccccaacggtaacccttcccttacccaaattaaaacccaactaacgccctaaactagtcgggtaagtttcggaaggacgtacccttaggaaccacgttccgtacggaacgaacccgaccgggtcccgttacgttaactttaaccgtcggttacggccggtaacggtacggttaccccccgagtaaccggtcccgggtaggaacccgtcccggttaaccgggcctaaccgggtcccgggttcccttttacggtcccgtttcgggtacccgggggg

SEQ ID NO: 206600 - DNA, 733 bp, Homo sapiens
  misc_feature: GYAE6OF01DK3DP.17.25.C03.1.454.CMB.1.raw
  modified_base (285)..(285): a, c, t, g, unknown or other
  misc_feature (285)..(285): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagagccgtggggcctcagtgaaggtctcctgcaaggcttcgtggtattctacgtttacctcctatagtatcaacgtgggtnccgccaggccgcgtcggaaccaacgaccgtggaggtggagtgggagtcgggaccaaacccgtaacgacgttgggtacgtacgaacgtaggttcgttccttaccaaccccgtacgttccccgtaccggggaacctaacggtaaccctttaacccgaattaccggaaccctaaccgtaaaccttcccctaaccctaaacttaaaacccacccgtaaacgtaccctaacgtaacggttagggtaacgtttagggaacgggtacgtcccgtaggtaactacgttcgtacggaaccgtaccgaccggtccgttacttaacgttacgtggtacgaccggtaacgtacccgtacccgaacggtacggttacccgggtacggaccgtaccccggtacgggacccgtacgggtcccgggttaccttttcgggtacccgtttcgggtaacccgggggg

SEQ ID NO: 206601 - DNA, 561 bp, Homo sapiens
  misc_feature: GYAE6OF01EYM9M.17.25.C03.1.454.CMB.1.raw
  modified_base (281)..(281): a, c, t, g, unknown or other
  misc_feature (281)..(281): n is a, c, g, or t
  modified_base (333)..(333): a, c, t, g, unknown or other
  misc_feature (333)..(333): n is a, c, g, or t
  modified_base (358)..(358): a, c, t, g, unknown or other
  misc_feature (358)..(358): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagaagcctggggcctcagtgaaggtctcctgcaaggcttctggattcacgtttacctcctatagtatcaactgggtncgccaggccgctggacaacggacctggagtggatgggatggggcaaccctanactggtgtcacagtgtcttcacccntcccgtcgggacagacttacatcgaccacgaacctcctaccataaacacacgcctacatggagttggaggacgcctaggactatcgtagaccgaccgacgggtcccttactagttactggtcgacggtagaccgtaccccaggtactccgggtcgacgcccgtacggctacgggcggtacctttcgacgttccggtacggggg

SEQ ID NO: 206602 - DNA, 726 bp, Homo sapiens
  misc_feature: GYAE6OF01BYJH0.17.25.C03.1.454.CMB.1.raw
  modified_base (224)..(224): a, c, t, g, unknown or other
  misc_feature (224)..(224): n is a, c, g, or t
  modified_base (511)..(511): a, c, t, g, unknown or other
  misc_feature (511)..(511): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactttcccaggtgcagctggtgcagtcgtggggctggaggtgaagaagccgtggggcctnagtgaaggtctccgtgcaaggcttcgtggattcacgtttacctctatagtatcaacgtgggtcgccgtccgaggcccgcgtaggaaccaacgaccgtggaggtggagtgggagtcgggacgtaaaccctaacgtacgtggtacgtacaacgtggttcgttccttacccaaccccgtacgttccccggttaccggggaacctacggtaacctttacccgaagttaccgaaccccaacggtaacccttcccgtaaccaaacgttaaaacccacgaaccgtaccctaaanacggttaggggtaacgtttagggacgtacgtaccgtagactacgttcgtagaaccgtaccgaacggtcccgttaatttacgttacgtcggttacgaccgtacggtacccgtaccccgaaggtccgttacccgggtagtaccccggtacccggtaaccgggaccgtacggggttacccggttacccgttttggtacccgtttcggggacccggggg

SEQ ID NO: 206603 - DNA, 648 bp, Homo sapiens
  misc_feature: GYAE6OF01BPPTD.17.25.C03.1.454.CMB.1.raw
  modified_base (243)..(243): a, c, t, g, unknown or other
  misc_feature (243)..(243): n is a, c, g, or t
  modified_base (289)..(289): a, c, t, g, unknown or other
  misc_feature (289)..(289): n is a, c, g, or t
tcagcgtagactagcacgaccggtgctcgatttagtagtgtagatttgggtttggggactcaacaaccacatctgtcctctagagaaaaccctgtgagcacatctcctcaccatggactggacctggaggatcctcttcttggtggcagcagctacaagtgcccactcccaggtgcagctggtgcagtctggggctgaggtgaagagcctggggcctgagtgaaggtctcctgcaaggcttcnggattcacgtttacctctatagtatcaactgggtgcgccaggccgntggacacgacctggagtggatgggatgggaccgaaaccctaacgacgtgggtcgtacacgtagtcgttacttcccgaccctacttcccggtacccggggaacacggtaccttaccgagtcgaacccaacgaaccctcctacccaataaaccacacgacctacatcgggtagttggaacggacgtaccgtagaactagtcgtacgaaccgtaccgacgggtaccgttacttaacgttacgtaggtacgccggaaggtaccgtacccgtaacggtacggttccgggtacgccggtacccgtaaccgggcgtaaccggtcccgggttaccctttacggtaccggtttccgggtaccgggggg

SEQ ID NO: 206604 - DNA, 552 bp, Homo sapiens
  misc_feature: GYAE6OF01DXKIT.17.25.C03.1.454.CMB.1.raw
  modified_base (261)..(261): a, c, t, g, unknown or other
  misc_feature (261)..(261): n is a, c, g, or t
  modified_base (281)..(281): a, c, t, g, unknown or other
  misc_feature (281)..(281): n is a, c, g, or t
  modified_base (291)..(291): a, c, t, g, unknown or other
  misc_feature (291)..(291): n is a, c, g, or t
  modified_base (401)..(401): a, c, t, g, unknown or other
  misc_feature (401)..(401): n is a, c, g, or t
  modified_base (409)..(409): a, c, t, g, unknown or other
  misc_feature (409)..(409): n is a, c, g, or t
  modified_base (431)..(431): a, c, t, g, unknown or other
  misc_feature (431)..(431): n is a, c, g, or t
  modified_base (463)..(463): a, c, t, g, unknown or other
  misc_feature (463)..(463): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagaagcctggggcctcagtgaaggtctcctgcaaggcttctggattcacgtttaccncctatagtatcaactgggtncgcaggccgntggacaacgacctgagtggatgggatgggactaaccctaagctggtctcacgtagtcgtcttcacccatcctcgagacagacttacatcaccacgactccacaataaacncagcctanagtggatgaggtacgctagacncgtctagaccgacgacgtccttatacttacgngtcgacgagtaccgtcccgacggtagtcccgggtgaaccgtcccgtacgggcaacggtcccgggttcctttaggacccgtttccggggg

SEQ ID NO: 206605 - DNA, 697 bp, Homo sapiens
  misc_feature: GYAE6OF01CYHW0.17.25.C03.1.454.CMB.1.raw
  modified_base (219)..(219): a, c, t, g, unknown or other
  misc_feature (219)..(219): n is a, c, g, or t
  modified_base (346)..(346): a, c, t, g, unknown or other
  misc_feature (346)..(346): n is a, c, g, or t
  modified_base (370)..(370): a, c, t, g, unknown or other
  misc_feature (370)..(370): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctnagtgaggtctcctgcaaggcttctggattcacgtttcctcctatagtatcaactgggtgcgccaggccgcgtcggaacaacgaccgtgacgtggagtggggatggggaccaacctaacgacgtggtntcactagtcgtaccttccaccctntcccgtaccggggacacgaacctttaccgactacgaaccctaaccgtaaccctcccttaccgaaacttaaaacccgacctaaccggtacccttaaaccgagttacggggtaacgggtttagggaaacgggtaccgtacccgttacggaaccctacggtttaccttaccgggaaaccgacccggtaacccgggtacccgtttacgtttaaacgtttaaccgtggtaaccggtcggtaacggtaccgtaccccgacggtacgtcccgggttagaccggtcccgtacgggacgcggttaccgtcttttacggccgtttgggtcccggggg

SEQ ID NO: 206606 - DNA, 618 bp, Homo sapiens
  misc_feature: GYAE6OF01C0NDK.17.25.C03.1.454.CMB.1.raw
  modified_base (222)..(222): a, c, t, g, unknown or other
  misc_feature (222)..(222): n is a, c, g, or t
  modified_base (278)..(278): a, c, t, g, unknown or other
  misc_feature (278)..(278): n is a, c, g, or t
  modified_base (507)..(507): a, c, t, g, unknown or other
  misc_feature (507)..(507): n is a, c, g, or t
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatccctcctgtctgcctcgtggtggggtcagagtccaccatcacttcgccganagtcacggtacgttaaacttattaattggtatacagacaacgaaactaggaaaacncccaacgaccttactgactcgtctggtcgcactccactctgacgtaaggtcgtacccgtaccagtcggtagttcgagtggcaggtgtacgtcgtaggtactagtatttcaatctacaaccgtataccgacctacttcacgacctaaaccgttggaaggttcttgtacgacttaaacttcgtaacttacgtcttacgaactaagttaaccgttacctaccggtttacccncggtacttacgtttcggaaccgtacgggtaaactaaggttcgaaacgaacgtaacctaaaggtccttagggtaccgcgtacgaacccgtactacggttccttcgttacccg

SEQ ID NO: 206607 - DNA, 641 bp, Homo sapiens
  misc_feature: GYAE6OF01C2A44.17.25.C03.1.454.CMB.1.raw
  modified_base (285)..(285): a, c, t, g, unknown or other
  misc_feature (285)..(285): n is a, c, g, or t
  modified_base (452)..(452): a, c, t, g, unknown or other
  misc_feature (452)..(452): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagccgtggggcctcgagtgaaggtctcctgcaaggtcttctggtattctaccgtttacctctatagtatcaacgtgggtncgccaggccgctggacacgactgagtggatgggatcgggacctaaccgtaacgacgtggtcgtcacgtagttcgtccttccgaccctagtcccgtaccgggacacgtaccttaaccagtcgaaccctacgtaacctccctaaccaagtaaaccacgtacgtcctaanagtgggtagttacggaagtcgtacctaggacacgttcgtacggaaccgaacgtccgggtacctcttaacgtttcgtaggtcgaccggtaacgaccgttacccgaggtaccgtccggggtagtaaccggtccccgttaagggccctagggtcccgttacgtttacgggccgtttccggggtaacccgggg

SEQ ID NO: 206608 - DNA, 741 bp, Homo sapiens
  misc_feature: GYAE6OF01C27K4.17.25.C03.1.454.CMB.1.raw
  modified_base (527)..(527): a, c, t, g, unknown or other
  misc_feature (527)..(527): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccaactcccaggtgcagctggtgcagtcgtggggctggaggtgaagaagccgtggggcctcgagtgaacggtctccgtgacaaggtcttcgtggattctaccgtttacctcctatagtactacaacgtgggtcgcgccgacggccgcgtacggaaccaaccgtaccgtggaaggtgggagtggggaacgtacggggacccgtaaccctaaacgaccgttgggtacgtccgaacgtaggttacgtcctttaccaacccgtacgtcccgtaccggggaacctacggtaccctttaacacgttaccgaccctaaccgtaacccttcccgtaaccaaacttaaaacccgactaacgtccttaaaccgngtacggtaggttacggaggtaccgtaccgtacggtaaccacgttccgtaacggaacccggtaaccgtacccgggtcccttacgtttaacgttaaccgtggttacggaccggtaacgaccgtcccgaacggtacgtcccgggtaggacccggaccgttaccggaccgtaccgggtacccggtccgttttaacggcccggtttcgggacccggggg

SEQ ID NO: 206609 - DNA, 731 bp, Homo sapiens
  misc_feature: GYAE6OF01CN4PR.17.25.C03.1.454.CMB.1.raw
  modified_base (221)..(221): a, c, t, g, unknown or other
  misc_feature (221)..(221): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagaagccgtggggcctnagtgaaggtctcctgcaaggcttcgtggtattctacgtttacctcctatagtatcaactggtagcgccgaggccgcgtggaccaacggacctggaggttggagtggggagtacggggacccgaaaccctaacgtacgtgggtgttaccaacgtaggttcgttcccttacaaccccgtacgtccgtacccggggactacggaacctttaccagtacgaccctaacgtaactcccgtaccaactaaaccacacgacctaacagtacgggtagttagaaggacaccgttacgaactaacgttcgtaacggaaccgtaccgtaacccgggttcccgttaacttaacgtttaaccgtcgggttaacggaccggtaaacggtaccggttacccccgtaaacgggtaccggttacccggggttacgtaaacccgggtacccgtaacccggggtaccgtacgggtaacccgggtttcccgttttaccgggtaaccgttttcgggggtaccccgggggg

SEQ ID NO: 206610 - DNA, 820 bp, Homo sapiens
  misc_feature: GYAE6OF01C8E63.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagccgtggggcctcagtgaacggtctcctgcaaggcttctggattcacgtttacctcctatagtatcaacgtgggtcgcgccgaggccgcgtcggaacaaccgaccgtgaggtggagtgggagtcgggaccgaaacccctaacgcgtgggtcgtcaacgtacggttcgttccttacccgaacccctacgttaccccggtacccgggggaacctaacgggtaaacccttttaacccgaacgttaccggaaacccccgtaacccggtaaaacccctttcccccttaaaccctaaacttaaaaaaccccgaacccgtaaccgtaaccccgttaaaccgtaacggtttacgggggtaacggttttacgggaaacggggtaccgtacccccggttacggtaaaccctaacgttacccgtaacggaaacccggtaacccgtaccccgggggttaccccgttacgtttaacgtttaccggttggttacgggaccggtaaacgtaccggttacccccgaacggtaccggttacccggggtaggtacccggtaccccgttaccggggaccgtacgggtcccgggttacccgttttacgggacccgtttcgggtacccgggggg

SEQ ID NO: 206611 - DNA, 628 bp, Homo sapiens
  misc_feature: GYAE6OF01EIBJO.17.25.C03.1.454.CMB.1.raw
  modified_base (244)..(244): a, c, t, g, unknown or other
  misc_feature (244)..(244): n is a, c, g, or t
  modified_base (332)..(332): a, c, t, g, unknown or other
  misc_feature (332)..(332): n is a, c, g, or t
  modified_base (343)..(343): a, c, t, g, unknown or other
  misc_feature (343)..(343): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttcnggattcacgtttacctcctatagtatcaactgggtgcgccaggccgctggacaacgacctgagtggagtgggatgggacaaccctaanactggtgtcanagtgtcttcacccatcctcgggacacgacttaaccatacgaccacgaactcctaccaataaacacacgacctaacagtggagttaggaggacgcccttagaccgtatcgtacggaccgaaccgaccgggtcccgtacttaacgttaccgtgttacggaccgtaaggaccgtacccccgtaacggtaacgttaccccgggttaggaacccgggtaccctaaccggggcccgtaaacgggtccgggtaccccgtttttacggtaacccgtttccgggtaccgggggg

SEQ ID NO: 206612 - DNA, 539 bp, Homo sapiens
  misc_feature: GYAE6OF01BIK76.17.25.C03.1.454.CMB.1.raw
tcagcgtagactagcacgaccggtgctcgatttagtagtgtagatttgggtttggggactcaacaaccacatctgtcctctagagaaaaccctgtgagcacagctccccaccatggactggacctggaggatcctcttcttggtggcagcagctacaagtgcccactcccaggtgcagctggtgcagtctggggctgaggtgaagagccgtggggcctcagtgaaggtctcctgcaaggcttctggattcacgtttacctcctatagtatcaacgtgggtgcgccaggccgctggacaacgacctgagtggatgggatgggcgaaccctacacgtggtgtcacagtgtcttccacccatccctccgggacagaccttaccatcgaccacgtaactcctaccaataacacagcctacatggagttggaggacgcctgacatctagaccgacgaccggtccgtacttattactgtcgcgagtacgtcccgagtcgtccggtgacgccgtacggcacggtcgtcttgacttcggcggggccg

SEQ ID NO: 206613 - DNA, 782 bp, Homo sapiens
  misc_feature: GYAE6OF01DH6KO.17.25.C03.1.454.CMB.1.raw
  modified_base (102)..(102): a, c, t, g, unknown or other
  misc_feature (102)..(102): n is a, c, g, or t
  modified_base (263)..(263): a, c, t, g, unknown or other
  misc_feature (263)..(263): n is a, c, g, or t
tcagcgtagactagcacgaccggtgctcgatttagtagtgtagatttgggtttgggggagtcagtctcagtcaggacacagcatggacatggagggtccccnctcagctcctggggctcctgctactctggctcgagctgccagatgtagacatcagatcgacccagtctccactccctccgtgtctcgcctcgtgggtggggtcagtagtcaccagtcacgttgaccgactacgtcaacggtacttaaactattaagtgtancagacaagaaacgtaggaaaccgcccagtacctcgtagacttccgtcgtggtcacctactccctacgtcgtcgggaacgtacgggttccgggtcccctaaccgtagtaccgggttacggttaccgaggggtcggtacgtagggttacgggacttaccggggtaggtaactaacgtttacgttttaacgaaaccgtttccttaacccaacctaccttaccccgtaacctaacccgtttccggtaaaccgtccccgtaaaacggtcgggtaaacggttacgtttacggtaacccgtaacttaaaccgtttacccgtttaaacctaacggttacaacgtaaaccggttacggttaaaccgttaccccgtttaaccccggtttccccgttaaccgggttaccgtttaaccggtttaccgggaaccgggtaaccggtaaaccggtaaggttaacgaaacggtaaccgtaacgaacgtcggtacggtcgtaccttacgaccttacctacgttcgttcccgttacc

SEQ ID NO: 206614 - DNA, 604 bp, Homo sapiens
  misc_feature: GYAE6OF01DTG39.17.25.C03.1.454.CMB.1.raw
  modified_base (349)..(349): a, c, t, g, unknown or other
  misc_feature (349)..(349): n is a, c, g, or t
  modified_base (448)..(448): a, c, t, g, unknown or other
  misc_feature (448)..(448): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagcctggggcctcagtgaaggtctcctgcgaaggcttctggattcacgtttacctcctatagtatcaacgtgggtcgcgccaggcccgcgtaggaacaaccgaccgtggacgtggagtgggagtcgggacgaacccctaancgtggtgtcacgagttcgtcttccacctactcccgtccggacacgtaccttaccagtacgacccacgtaactccctaccactaaacacacgaccctaanagttaggtagttcggaggtacgcctagactactcgtagaaccgacgaccgggtccgttacttattacgtgtagaccgaggaccgtcccacggtacgtaccgggtgaccgaccgtcggacgacggtccggtaccttttcggccgtttcggtacgggg

SEQ ID NO: 206615 - DNA, 707 bp, Homo sapiens
  misc_feature: GYAE6OF01A36JE.17.25.C03.1.454.CMB.1.raw
  modified_base (290)..(290): a, c, t, g, unknown or other
  misc_feature (290)..(290): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagccgtggggcctcagtgaaggtctcctgcaaggcttctggattcacgtttacctcctatagtatcaacgtggtgcgccaggccncgtggacaacgacctggagtggatagggagtgggaccgtaacctaacacgtggtacgtacgacaggttcgtccttcaaccccgtagttccccgtaccggggactacgtacctttaaccattacgaaccctaaccggtaacccttccccgtaacctaacgtaaaacccaccaacggtacccttaaacgagtacggggtaagtttacgggaaacggaccgtccttacggaacgtacgttaccgtacggaaccggaaccgtacccggggtacccgttacgttaacgtttaccgtagggttaccgacggtaacggtacccgttaccccggaacggtaaccgttcccgggtaggacccggtacccgtacggcgtaacgggtcccggttaccgtttccggtaacgtttccgggtacccggggg

SEQ ID NO: 206616 - DNA, 564 bp, Homo sapiens
  misc_feature: GYAE6OF01DF1IV.17.25.C03.1.454.CMB.1.raw
  modified_base (282)..(282): a, c, t, g, unknown or other
  misc_feature (282)..(282): n is a, c, g, or t
  modified_base (329)..(329): a, c, t, g, unknown or other
  misc_feature (329)..(329): n is a, c, g, or t
  modified_base (337)..(337): a, c, t, g, unknown or other
  misc_feature (337)..(337): n is a, c, g, or t
  modified_base (341)..(341): a, c, t, g, unknown or other
  misc_feature (341)..(341): n is a, c, g, or t
  modified_base (423)..(423): a, c, t, g, unknown or other
  misc_feature (423)..(423): n is a, c, g, or t
tcagcgtagactagcacgaccggtgctcgatttagtagtgtagatttgggtttgggggactcaaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacaacgctgagtgatgggatgggacaacccaanacgtggtntcanagtgtcttcaccctatcccgtccgggacagaccttacatacgacccaacgaacctccctaccaactaaacacacgacctaanagtgggagttcggaggtacgcccttaggaccattcgtagaccgacgaccggtccttactattacgtgtcgcgtagaccgtccacggtactcgggtagcgccgtacggctacggtccggtcctttacggcgttcggacgggg

SEQ ID NO: 206617 - DNA, 871 bp, Homo sapiens
  misc_feature: GYAE6OF01DTO5N.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctggtgcagtcgtggggctggaggtgaagagccgtggggcctcgaggtgaggtcctccgtgcaaggtcttcgtaggtactttccgaaccgttttaccctaccttaagttaaggttactaccgaaacggttggggtacgccggaccgacgggtcccgacgtacggggaaccaaccggtaccgttggagggttcgggaagtcggggtaacgtcggggaacccgtaaaccccgttaacgaccgttgggtacgtaccgtaacgtacggttcgttaccttacccgtaacccctagttccccggtaccgggaacctaacggtaacccctttaaccgacgttaccggtaacccaacccggtaaccccttacccgtacccaaaacgttaaaacccgaccgtaaccgtaccccgtaacgtacggttaacgggtaacggtttacgggaaacgggtaccgacccgtttaaggaaacccgttacgttacccggtaccggaaaccggtaccccggtaacccgggtttccccgttaaaccgtttaactttaccgggttacgtacgggtaccgtaaccgggtacccgtaaccccgtaacgggtaccggtaccgggtacggacccgggttacccggacccggtaaccggtaccgggttacccggttaccccgtttttagggaccccgtttcgggggtaaccccggggg

SEQ ID NO: 206618 - DNA, 606 bp, Homo sapiens
  misc_feature: GYAE6OF01BENA8.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagaagcctggggcctcagtgaaggtctcctgcaaggcttctggattcacgtttacctcctatagtatcaactgggtgcgccaggccgctggacaacgcctgagtggatgggatcggggaccgaaaccctaacacgttggtcgtcaactagtgttccttaccaccctactcccgtaccggggacacgtaccttaccatcgaccacgaacctcctaccaataaaccacacgacctaacagtgggagttaggacggtagcctagacatctacgacgacgaccggtccgttacttacttacgtgtcgacggacgtaccgtaccccgacggtacgttccgggtagaccggtacccgtacgggccgacgggtccggttacccttttcggaccttccgggtaccggggg

SEQ ID NO: 206619 - DNA, 693 bp, Homo sapiens
  misc_feature: GYAE6OF01DNKKC.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttgggtggcagcagctacaagtgcccactcccaggtgcagctggtgcagtcgtggggctggaggtgaagaagccgtggggcctcgagtgaaggtctcctgcaaggcttctggattctacgtttacctcctatagtatacaacgtgggtcgcgcccgaggcccgcgtacggaaccaaccggaccgtaggaggtggagtggggagtcggggaccgtaaacccgtaacgacgtggtcgtacacgtagttcgttccttccaacccgtacgtcccgtacccggggactaacggtaccttaaccgatacgaaccctaaccgtaaccctcctacccgaataaaccacaacgtaccctaacaggttggagttaggacgggtacgccgttagacgtactcgtacgaccggaaccgaccgggtcccgttacgttaatttaccgtacggtacgaccggtacggaccgttaccccgacggtaccggttcccgggaggtaccggacccgtaccgggaccgtacggtcccggttaccttttacggtaccgtttccgggtacccggggg

SEQ ID NO: 206620 - DNA, 662 bp, Homo sapiens
  misc_feature: GYAE6OF01B11X8.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctggtgcagtcgtggggctggaggtgaagaacgccgtgggggcctcgaggtgaaggtcctccgtgcaaggcttcgtggattctacgtttacctcctatagtatcaacgtgggtgcgccaggccgctcggacaacgacctgaggtggagtgggagtgggaccgaacccgtaacacgtggtcgtcacgtagtgtccttcacccctatcccgtccgggactacgtactaccgagtacgaccaacgtaacctccctacctaactaaaccaccaacgtcctaacgagtacgggacggttaggacggacgacccgtggaactacgtccgtacgaaccggtaaccgtaccgggtcccgttacttaccgtttacggtggtacgtaccggaacggtaccgtaccccgaacggtacggtcccgggttacggccggtacccgtaccgggacgtcgggtaccggttaccgtttacggaccgtttcgggaccgggg

SEQ ID NO: 206621 - DNA, 721 bp, Homo sapiens
  misc_feature: GYAE6OF01DIJDX.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctgaggtgaagagccgtggggcctcgagtgaaggtcctcctgcaaggcttcgtggtattctacgtttacctcctatagtatcaacgtgggtcgccgccgaggcccgcgtacggaaccaaccggtacctggaggtgggaagtggggagtcggggaccgtaaaccccgttaacgacgttggtacgtaccgacgtagttcgtaccttaccaccctacgtcccgtacgggactacggtaccttaccgagtaccgaacccgtaaccgtaacccttaccctaacctaaactaaacccgaaccctaacgtacccttaaacgtacggtacgggtaaggttacggaacgggtaccgtaccgttacgaactacgttaccgtacggaacccggtacccggtacccgggttcccgttacttaacgtttacgttcgggtacgtacgggtacgtacccggtacccgaacggtaccggtcccggtaggacccgtacccgtacgggctacggtccgttcctttacggcgttcgggtaccgggg

SEQ ID NO: 206622 - DNA, 639 bp, Homo sapiens
  misc_feature: GYAE6OF01EZN52.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagccgtggggcctcagtgaaggtctcctgcaaggcttctggattcacgtttacctcctatacgtatcaacgtgggtgcgccacggccgctggaccaacggacctggaggtggagtgggagtcggggaccgtaaacccgtaacgacgttggtcgtacgacgagttcgtccttcgaccctacgtcccgtaccgggactacgaccttaccagtacgaccacgaacctccctaccaataaaccacacgaccctaagacgtagggtacgttaggacggtacgccgtcgactatccgtacgaaccgaccgtacggtcccgtacttacttacggtgttcggacggacgtaccggtaccccacggtaccgtccgggtacggccggacccgtacggaccgtacgggcccggttacccgtttcggtaccgttccgggtacgggg

SEQ ID NO: 206623 - DNA, 667 bp, Homo sapiens
  misc_feature: GYAE6OF01EU5YI.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctgggctgaggtgaagagccgtggggcctcgagtgaaggtctccgtgcaaggtcttcgtggattcacgtttacctcctatagtatcgaacgtggtgccgccgaggccgcgtaggacaacgccgtggacgtggagtgggagtcgggacctaaacccgtacgacgtggtgtaccacgtagtcgttactaccgaccctactccggtaccggaacacgtaccttacgactacgaccacgtaaccctcctaaccaactaaacgacctaacgtacctacgtaagtgggtaagttcggaacgagtccctagtaactactcgtacgaaccgtacgaccgttccgttacttaagtttaccgtggtacgaccggtaacgtaccgtaccccgtaacggtcgttaccgggtacggaccggtaaccccgttacgggaccgtaaccgggttccgggttacccttttacgggtcccgttccgggtacccggggg

SEQ ID NO: 206624 - DNA, 1199 bp, Homo sapiens
  misc_feature: GYAE6OF01BIB5T.17.25.C03.1.454.CMB.1.raw
tcagcgtagactagcacgaccggtgctcgatttagtagtgtagatttgggtttgggggtacggtcaacaaccaaacaactctgttccctcctagaagaaaaccctcgtggagcacagctcctacaccactggacgtggaccgtcggagggacgttccctctttcgttgggtggcagcagctacaagtgcccactcccaggtcgcgtaggcgtggtagccgtagggtccgtgggggcgttgggaagggtacggaaacggtaacgggtccccgttcggggggtcccgttacggtacggttcggtaaacgggttcctacccggttcggtaccgtaacggggtccggtttcctacgggttacttaccgttaacccggttttaaccctttaccgttaaacgtttaacggttaaacgtttaccgggtaaaccggtcggggggttaccggcccgggtaccccgtacgggggacccggtaccggtttacggggtaaccggtaaaccggggtacccggttaggggtaacgggggtaacggggtaaggtttacggggggtaaccggttacgggggtaaccccggttaaaaccccgtaaaaccggtacccggttaacgggtaaccggttacccgaaccgtaacgggtttacggttaacccgttttaccccggaaaccccggtacgttacccccgggttaaccccggggtaaaccctaaaccggttaacccgtttaaacccccggtaacgggtaaaccccggtaaaaccccgtaaacccgggtaaaaccccctttaaccccggttaaacccgttaaaactaaaaccccgtaaaccgggtaaccggtaaccccttaaacggaaaccgggtttccggggttaaacggtttacggggtaacccgggtaaacggttccccggttaacgggtaaaccccggttaacgggtttaccccggttaaaccgggttaaccccggttaaccccgggttaacccgggtttacccgggtttaaccgtttaaccggttaacggggtttaccgttaacgggtaaacccggtaaacgggttaaaccccgtaccccgggttaaaccggttccccggttttaaccccgggttttaccgggaaaccccggttccccgggtttaaacccgggtaccccgttaccggggttaccccgggttaccccgtttttacgggtaaccccgggtttaa

SEQ ID NO: 206625 - DNA, 629 bp, Homo sapiens
  misc_feature: GYAE6OF01C0876.17.25.C03.1.454.CMB.1.raw
  modified_base (514)..(514): a, c, t, g, unknown or other
  misc_feature (514)..(514): n is a, c, g, or t
tcagcgtagactagcacgaccggtgctcgatttagtagtgtagatttgggtttgggagtcagtctcagtcaggacacagcatggacatgagggtccccgctcagctcctggggctcctgctactctggctccaagctgccagatgtgacatccagatgacccagtctccatcctccctgtctgcctctggtggggtcagagtcaccatcacttgccggacaagtcacggacttaaactatttaaattggtatcagcagaaaacctggaaaacgccccagacctcctagactcgtactggtcgcactcccacttctgtaccgtaagtccgggaccgttacccgaattcggaaggtttcaaggttggactaggttcggattccgtgggaaccaggtacttttacgaaattccactaaccatccaacctactctagaccctaaccgtggaacggtatttgagtactaactcttaactactgttaccaagtaacgtacgttaccaaccggtttccccncgtacttaccgttttagggaccgtaacggggtaaccctaaaggttacgaacgtactacgtaaaaccgtacggtacgttaggacgttacggaactacctacgtccttggtttaccc

SEQ ID NO: 206626 - DNA, 602 bp, Homo sapiens
  misc_feature: GYAE6OF01C8TZZ.17.25.C03.1.454.CMB.1.raw
  modified_base (282)..(282): a, c, t, g, unknown or other
  misc_feature (282)..(282): n is a, c, g, or t
  modified_base (338)..(338): a, c, t, g, unknown or other
  misc_feature (338)..(338): n is a, c, g, or t
  modified_base (346)..(346): a, c, t, g, unknown or other
  misc_feature (346)..(346): n is a, c, g, or t
  modified_base (351)..(351): a, c, t, g, unknown or other
  misc_feature (351)..(351): n is a, c, g, or t
  modified_base (363)..(363): a, c, t, g, unknown or other
  misc_feature (363)..(363): n is a, c, g, or t
  modified_base (425)..(425): a, c, t, g, unknown or other
  misc_feature (425)..(425): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagaagcctggggcctcagtgaaggtctcctgcaaggcttctggattcacgtttacctcctatagtatcaacgtgggtncgccgaggccgcgtcggaacaacgcctgaggtggatgggatgggacgaaccctaanacgtggtntcacngtgtcttcaccntccgtcggacagaccttacatcgaccaacgtaacctccctacaactaaacacacgacctaanatgggtagttgaggactccgtagacattcgtagaccgaacgccgggtccttactatttaccgtgtacgaccggtaagaccgttaccccaaggtaccgttccggggtagacccggtacccgtaccgggccgtacgggtcccgggttccttttacgggaccgttttcgggaccgggggg

SEQ ID NO: 206627 - DNA, 610 bp, Homo sapiens
  misc_feature: GYAE6OF01CYUSJ.17.25.C03.1.454.CMB.1.raw
  modified_base (332)..(332): a, c, t, g, unknown or other
  misc_feature (332)..(332): n is a, c, g, or t
  modified_base (339)..(339): a, c, t, g, unknown or other
  misc_feature (339)..(339): n is a, c, g, or t
  modified_base (343)..(343): a, c, t, g, unknown or other
  misc_feature (343)..(343): n is a, c, g, or t
  modified_base (359)..(359): a, c, t, g, unknown or other
  misc_feature (359)..(359): n is a, c, g, or t
  modified_base (424)..(424): a, c, t, g, unknown or other
  misc_feature (424)..(424): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagaagccgtggggcctcagtgaaggtctcctgcaaggcttctggattcacgtttacctcctatagtatcaacgtgggtgcgccaggccgctggacaacgcctgagtggatgggatgggcaaccctaancgtggtntcanagtcgtcttcaccctntcccgtccgggacacgacttaccatcgaaccacgaacctcctaccaataaaccacataccctaanagtgggagttggaggacgccctgactagtcgacgaaccgacgaccgggtccttacgttatttacgtggtcgacggtaacggtaccgttaccccgaggtacgttcccggggtagaccggtacccgttaccgggccgtaacgggtcccggttacccgttttcggacccgtttccgggtaccggggggg

SEQ ID NO: 206628 - DNA, 793 bp, Homo sapiens
  misc_feature: GYAE6OF01EJ0VM.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctggtgcagtcgtgggctggaggtagaagagccgtggggcctcgagtgaaggtcctccgtgcaaggtcttcgtggtacttccgtaccgtttacctccttaatagtactcgtaacgtgggtcgccgccgacggcccgtgtacggaaccaaccgtaccgtggacggtggagtgggagtcgggacctaaaccccgtaacgacgttggtacgtaccgaacgtaggttccgttacccttacccgaaccccgtacgttccccggtaccgggaaacctaacgtaacccgtttaaccgacgtacccggaaacccgtaaccgtaaacccttcccctaaaccctaaacgttaaaacccgaaccgtaaccgtaaccccgttaaacgtaacggttacggggttaaggttacggaacggttaccgacccgttagaacctcgttacgtaccggaaccgtaacccggtaccggttacccttactttaacgttaccgtggtaccggacggtaaccgtacccggtaaccccgtacggtaccggttaccgggacgtaacccggtaccccggtaacggcccggtaccggttcccggttacccgttttcggtacccggttcgggtacccggggg

SEQ ID NO: 206629 - DNA, 785 bp, Homo sapiens
  misc_feature: GYAE6OF01E35DQ.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagccgtggggcctcagtgaaggtcctcctgcaaggtcttcgtggattcacgtttacctcctatagtatcaacgtgggtcgccgccgaggccgcgtacggaaccaaccggacctggaggtagggtagtggggacgtcggggaacccgtaaaccccgtaaacgacgttcgggttacgtaccgaacgtaggttcgttaccgttacccaaccccgtacgtccccggtaccggggaaacctacggtaacccttaacccgacgttaccgaaccctaaccgtaacccttaccccgtaaccctaaacgtaaaaccctacccgaaccgtaccccttaacgtaaggttacggggtaaggtttacgggaacgggtaccgtacccggtagtaacctacgtaccgtacggaaccggaacccgtacccggggtacccttacctttaacgtttaccgtcggtacggaccggtaaccgtaccggtacccccgaacgggtacccggtaccgggtacggaccggtccccggtaaccgggccgtaaccgggtcccgggttacccgtttcggtacccggttccgggtacccgggggg

SEQ ID NO: 206630 - DNA, 772 bp, Homo sapiens
  misc_feature: GYAE6OF01CICY6.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagagccgtggggcctcagtgaggtctccgtgcaaggtcttcgtggtattcgtaccgtttacctcctatagtactacgaacgtgggtacgccgccgaggcccgcgtacggaaccaacgaccgtaggaggtagggagtagggacgtacggggacccgtaaacccgtaacgaccgttgggtactacaacgtacggttcgttaccttaccgaaccccgtacgttcccggtaccgggaactacggttaaaccttaccgaacgtaccgtaacccaaccgtaacccttaccctaaccctaaaacttaaacccaccgaaccgtacccttaaacgaaggttacgggtaacgtttcgggaaccggtacgtacccgtaggaacctacggtttccgaaggaacccggtaccgtacccgggtccgtttaacttaacgtttacgtgggtaccggacggtaaccggtaccggttccccgaagggtccggtttaccgggaacggtccggtacccggttaccgggaccgtaccgggttcccggttacccgttttggtaaccccgggttggggtaaccccggggg

SEQ ID NO: 206631 - DNA, 664 bp, Homo sapiens
  misc_feature: GYAE6OF01DS6N6.17.25.C03.1.454.CMB.1.raw
  modified_base (513)..(513): a, c, t, g, unknown or other
  misc_feature (513)..(513): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagaagccgtggggcctcgagtgaggtctcctgcaggcttctggattctaccgtttacctcctatagtactacaacgtgggtgcgccaggccgctggaaccaacgaccgtggagtggagtggggatcgggaccgtaaacccctaacgtacgttgggtcgttacgaacgtagttcgttccgttaccaaccccgtatccccgttaccggggaaccacggtacccttaaccagtacgaaccctaacgtaacccttccctaacctaactaaaaccacctaacgtacccttaatacgtggtaagttagacggacnccgtagactactcgacgtaacgacgtaccggtccgttacttacgttacgtgtgacggtagaccgtaccctacggtacgtccggttaggaccgacccggttacggaccgtacggttcccggtacccgttttcgtccggttcggtccgggggg

SEQ ID NO: 206632 - DNA, 696 bp, Homo sapiens
  misc_feature: GYAE6OF01D2M7M.17.25.C03.1.454.CMB.1.raw
tcagcgtagactagcacgaccggtgctcgatttagtagtgtagatttgggtttggggactcaacaaccacatctgtcctctagagaaaaccctgtgagcacagctccctcaccatggactggacctggaggatcctcttcttggtggcagcagctacaagtcgcccactcccaggtgcagctggtgcagtcgtgggctggaggtagaagagccgtggggcctcgagtgaaggtctcctgacgaaggcttcgtggtacttctacgtttacctctatagtatcgaacgtggtacgccgccgacggccgctaggaaccaacggacctggacgtgggtagtgggagtcgggaccgtaaccctaacgacgttcggtacgtacaacgtagttcgttaccttacccaccccgtaacttcccggtaccgggaactacgtaaccctttaaccgaagttaccgaacccgtaaccgtaaaccgtcccctaaccaaacttaaaccaacaaccgtaccttaacgaagtcgggtaagttcggaacggtacgtcccgtagaacgtactacggtacgaacccggaccgtaccggtaccgttacgttacgttaacgtggtacgaccgaacgtaccgtacccgaacgtacggtcccggtagaccggacccgtacggccgtacggccgttaccgtttcggccttccgggtacggg

SEQ ID NO: 206633 - DNA, 698 bp, Homo sapiens
  misc_feature: GYAE6OF01ECHH1.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctggtgcagtcgtgggctggaggtgaagagccgtggggcctcagtgaaggtctccgtgcaggtcttcgtggacttctacgtttacctcctaatagtatcaacgtgggtcgcgccgaggccgcgtcggacaacgccgtggacggtggagtgggagtgggaccgtaaaccctaacgcgtgggtcgtacgaacgtcggttcgttccttccaccctacgtcccgtaccgggactacggtaaccttacccgtaacgtacgaaccctaacccgtaaccttacccctaactaactaaaacccacgtaaccgtacctaacgtagttggaacgtttggaacggtacgcctagactacgtcgtacggaacgtaccgaccgggtaccgttacgttacgttacgtcggtacggccggaacggtaaccggtaccccgtaacggtaccggtcccgggtacggaccggtacccggtacgggaccgtaccgggtaccgggttcccttttagggtcccgttcggggtacccggggg

SEQ ID NO: 206634 - DNA, 681 bp, Homo sapiens
  misc_feature: GYAE6OF01DJ1MZ.17.25.C03.1.454.CMB.1.raw
  modified_base (274)..(274): a, c, t, g, unknown or other
  misc_feature (274)..(274): n is a, c, g, or t
  modified_base (295)..(295): a, c, t, g, unknown or other
  misc_feature (295)..(295): n is a, c, g, or t
  modified_base (336)..(336): a, c, t, g, unknown or other
  misc_feature (336)..(336): n is a, c, g, or t
tcagcgtagactagcacgaccggtgctcgatttagtagtgtagatttgggtttgggagtcagtctcagtcaggacacagcatggacatgagggtccccgctcagctccgtggggctcctgctactctggctccgagctgccagatgtgacatccagatcgacccagtcctccactccctcctgtcctcgtcctcgtgggtggggtcagacgtcaccatctacgttcgaccgacaacgtcaacggtaacttaaaaccttaagtttaaagtgtatnagacaagaaccgtacgaaacncccagtacctccagactcgtcgtaggtcacactcctacgtntaggacgtacgcgtccctacgaggttacgtcggttacagggtgcgtagtggacttcgggaggactagttacttaccaactccctacgtacctactaccccaacttccgtacgtacccgaaccttaacggtacggtacggttagttccggattaaccaacttttaccctaacgtttactacgtaacctaaacggtaccggttaatttccccggttaccccgttaccgtcgttacctttaccgggtttccggaacccggttaaacgggtactaaggttaccaaggtaacctaaagaaccgttacggtgtacgaccgtaccgaccttaacttgttccggtattccccg

SEQ ID NO: 206635 - DNA, 779 bp, Homo sapiens
  misc_feature: GYAE6OF01CEU2H.17.25.C03.1.454.CMB.1.raw
  modified_base (216)..(216): a, c, t, g, unknown or other
  misc_feature (216)..(216): n is a, c, g, or t
  modified_base (278)..(278): a, c, t, g, unknown or other
  misc_feature (278)..(278): n is a, c, g, or t
  modified_base (288)..(288): a, c, t, g, unknown or other
  misc_feature (288)..(288): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctgggctgagtgaagagcctggggcctnagtgaaggtctcctgcaaggcttcgtggattcacgtttacctcctatagtatcaactgggtncgcaggccgngtggacaacgacctgagtggatgggatggggaccaaccctaacgacgtggtcgtacaacgtaggttcgtcctttaccgaacccctagttccccgttacccggggactaacggtaaccctttaacccgagttaccggaacccctaaccggtaaacccttccccgttaaccccaaattaaaaacccgaccgtaaaccggtccccttaaaacgtaacgttacggggtaaccggttttaggaaacggggtaaccggtccctttaacggggaaccctaacgttaccggttaaccggaacccggtaacccggtacccggggttacccgttaacctttaacgtttaaccgtgggttacggacggttaaccggtaccgtcccccgtaaacgggttacccgttaccgggtacgggtaacccgtaccccggtaacgggcccgtaacggggttccccggttacccggttttacgtaacccggtttcccgggtaaccgggggg

SEQ ID NO: 206636 - DNA, 721 bp, Homo sapiens
  misc_feature: GYAE6OF01D4A4V.17.25.C03.1.454.CMB.1.raw
  modified_base (100)..(100): a, c, t, g, unknown or other
  misc_feature (100)..(100): n is a, c, g, or t
  modified_base (298)..(298): a, c, t, g, unknown or other
  misc_feature (298)..(298): n is a, c, g, or t
  modified_base (707)..(707): a, c, t, g, unknown or other
  misc_feature (707)..(707): n is a, c, g, or t
tcagcgtagactagcacgaccggtgctcgatttagtagtgtagatttgggtttgggagtcagtctcagtcaggacacagcatggacatggagggtccccntcagctcctggggcctcctgctactctggctccgagctgccagatgtgacatccaagactcgacccagtcctccatccctcctgtctcgcctcgtggtggggtcagtacgtccacctatcacttggaccgaacagtcacggtaacttaaaacctatttaaagtggtatacagacgaaacgtaaaccgtaggaaaaccncccagtaacccttcagtactctacgtggtacacctactcccgagtccgaggtaccggtaaggttccggcccgttacccgaaggttcggtacggtttaccagggtacggagtagggtacgtatacgggacggtacaagttactttaccaacgttccctaacacgtattacccaaccgtacgtcacgactaaccgggtagtagtacgtttcgaacgtaactaacgtttccgaactttacggaacgttaccaaaggtacgttaaccggtttaccctacccggtttacccctaggtttaaccgttacgggtttaccggaaccgggttaaaccgggttaaacggtaaagttaccggaaacggtaacgtaaacctaaaccggtagtcgggttacgaaccttcgaacctaacgttnttaggtcccttaac

SEQ ID NO: 206637 - DNA, 542 bp, Homo sapiens
  misc_feature: GYAE6OF01BVHKJ.17.25.C03.1.454.CMB.1.raw
  modified_base (501)..(501): a, c, t, g, unknown or other
  misc_feature (501)..(501): n is a, c, g, or t
  modified_base (516)..(516): a, c, t, g, unknown or other
  misc_feature (516)..(516): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaaggcttctggattcacgtttacctcctatagtatcaactgggtgcgccaggccgctggacaacgacctgagtggatgggatgggcgaaccctaacactggtcgtcacgagtgtccttcacccatcccgtccgggacagacttaccatcgaccacgaacctcctccaataaacacacgcctacatgggagttggaggacgcctgacatcgtcgacgaccgaccgggtccgtacttacttactgtgcgagacgtcccagacgtccggngacgcccgtacggcncggcggtcctttcgcgttcggcgggg

SEQ ID NO: 206638 - DNA, 682 bp, Homo sapiens
  misc_feature: GYAE6OF01BH38J.17.25.C03.1.454.CMB.1.raw
tcagcgtagactagcacgaccggtgctcgatttagtagtgtagatttggttttggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctgaggtgaagagccgtggggcctcgagtgaaggtctccgtgcaaggcttcgtggtattctacgtttacctcctatagtatcaacgtgggtgcgccgaggccgcgtaggaccaacgccgtggacggtggagtgggagtcggggacctaaacccgtaacgtacgtggtcgtacacgtagtcgtccttccaccctacgttcccgtccgggacacgtaccttaccatacgaacccacgtaacctaccctaccaaacttaaaccaccgacgtaccctaacgacgtagggtaacgtttacggaacggtacgtcccgtagaacctacgtacgtacggaacccgtaaccgtaccgggtacccttacgttaacgttacgtacggtcgacggtacggtacccgtaccccgtacggtaccgttacccgggtaggacccggtacccgtaccggcgtacggtcccggttaccgtttacgtaccggttcggtaaccggggg

SEQ ID NO: 206639 - DNA, 727 bp, Homo sapiens
  misc_feature: GYAE6OF01DR8G1.17.25.C03.1.454.CMB.1.raw
  modified_base (186)..(186): a, c, t, g, unknown or other
  misc_feature (186)..(186): n is a, c, g, or t
  modified_base (221)..(221): a, c, t, g, unknown or other
  misc_feature (221)..(221): n is a, c, g, or t
  modified_base (286)..(286): a, c, t, g, unknown or other
  misc_feature (286)..(286): n is a, c, g, or t
  modified_base (364)..(364): a, c, t, g, unknown or other
  misc_feature (364)..(364): n is a, c, g, or t
  modified_base (598)..(598): a, c, t, g, unknown or other
  misc_feature (598)..(598): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcngtcgtggggctggaggtgaagaagcctggggcctnagtgaggtctcctgcaaggcttcgtggattcgtactttacctcctatagtatacaacgtgggtcncgccgaggcccgtgtcggaacaacgtaccgtgaggtggagtggggagtcgggaccgtaaaccctaacgacgttgggtntaccgtaactaggttacgttcctttacccaaaccccgtagtcccccggttacccggggaacctacggtacccctttaaccaagttacccggaaacccaaccggtaaccctcccgttaacccaaactaaaacacccctaacgtacccttaacacggttacgggtaagtttccggaaaggcggtacccttaggacctacgttccgtaacgaccggaaccgtaccgggtacccgttnttaacgtttacgtgtagccgaggtacccgttcccgaacggtacccggtttcggacggacccgtacccgtaccgggaccgtcggggaccccgtttaccgtttacggaaccgttttccgggacccgggggg

SEQ ID NO: 206640 - DNA, 570 bp, Homo sapiens
  misc_feature: GYAE6OF01BLN7T.17.25.C03.1.454.CMB.1.raw
  modified_base (280)..(280): a, c, t, g, unknown or other
  misc_feature (280)..(280): n is a, c, g, or t
  modified_base (423)..(423): a, c, t, g, unknown or other
  misc_feature (423)..(423): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacacgacctgagtggagtgggatgggaccgaaaccctaacgacgtgggtcgtacacgagtcgttcttccacccatcccgtccgggacagtaccttaccatccgaccacgtactccctaccaataaaccncacgcctaacagtgggtagttgaggacgcctgacatctacggacgacgcggtccttctacgttctgtgccgtacgacgtacccgagtcgtccggtagccgcccgtacggcctacggtccggtcctttggaccgttcgggtaccgggg

SEQ ID NO: 206641 - DNA, 847 bp, Homo sapiens
  misc_feature: GYAE6OF01ALM0B.17.25.C03.1.454.CMB.1.raw
  modified_base (292)..(292): a, c, t, g, unknown or other
  misc_feature (292)..(292): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagccgtggggcctcagtgaaggtctcctgcaaggcttctggattccacgtttacctctatagtatcaactgggtcgcgccaggccgngtcggacaccgaccgtggagtggagtgggacgtcgggaccgaaaccctaacgacgttcggtgtaccgacgtaggttcggttccttaccgtaaccccgtacttcccggtaccccggggtaacaccggttaaccgttaacccgtaagttacccggtaaccccgaaccggttaacccttacccctaaccgtaaacgtaaaaacccgacccgtaaaccggtaccccttaaaccggtaacttcgggggtaaacggtttacggaacgggtaaccggtaccccgttaaggaacccttaacgtccgttaacggaacccggttaacccggaaccccggggttacccgttaacccgttttaacgtttaaccggttacggtaccggtaacccgggaacggttaacccgggttaccccccgtaaacggttacccgggtttaccccggggttaacgggccccggttaaccccgggttaaaccccggggacccggtaaccgggttaccccggggtttaccccgttttacggggtttaaccccccggtttcggggtaaccccgggggggg

SEQ ID NO: 206642 - DNA, 604 bp, Homo sapiens
  misc_feature: GYAE6OF01A01JD.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctgggctgaggtgaagagccgtggggcctcagtgaaggtctcctgcaaggcttctggattcacgtttacctcctatagtatcaacgtgggtgcgccgaggccgcgtggacaacgacctggaggtggagtgggagtcgggaccgaaccctaacgacgtggtcgtcacgtagtcgtccttccacccactccgtaccgggacacgtaccttaccatcgaccacgtaacctccctacaactaaacacacgcctacagtaggtagttaggagtacgcctgacatcgtacgaaccgacgtaccgggtccttacttacgttacgtacgtcgcgtaacgtaccgtcccgaacggtacgtcccgggtgaccgtcccgtacggccgtacggcccggttaccgtttcggtccgttccgggtccgggg

SEQ ID NO: 206643 - DNA, 655 bp, Homo sapiens
  misc_feature: GYAE6OF01DBD02.17.25.C03.1.454.CMB.1.raw
  modified_base (281)..(281): a, c, t, g, unknown or other
  misc_feature (281)..(281): n is a, c, g, or t
  modified_base (438)..(438): a, c, t, g, unknown or other
  misc_feature (438)..(438): n is a, c, g, or t
  modified_base (450)..(450): a, c, t, g, unknown or other
  misc_feature (450)..(450): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagccgtggggcctcgagtgaaggtctcctgcaaggcttctggattcacgtttacctctatagtatcaactgggtncgccaggccgctggaacaacgacctggagtggagtgggatcggggaccaacccctaacacgtggtacgtcacgtagttcgtccttccaacccgtactcccgtaccggggactacgtaccttaccatcgacccaacgaacctccctaccaataaaccncacgaccctaanagtggagttcggaggactcctagacctagtctaggaaccgtacgacccgggtccttacttaagtttaccgtggtacggaccgtaagtacccggtaccccaacgggtacgtaccccggggttagaacccggttaccccggttacgggcccgtaacggggtcccgggttacccttttacgggacccgttttccggggacccgggggg

SEQ ID NO: 206644 - DNA, 681 bp, Homo sapiens
  misc_feature: GYAE6OF01B45BS.17.25.C03.1.454.CMB.1.raw
  modified_base (288)..(288): a, c, t, g, unknown or other
  misc_feature (288)..(288): n is a, c, g, or t
tcagcgtagactagcacgaccggtgctcgatttagtagtgtagatttgggtttggggactcaacaaccacatctgtcctctagagaaaaccctgtgagcacagctccccaccatggactggacctggaggatcctcttcttggtggcagcagctacaagtgccccactcccaggtgcagctggtgcagtctggggctgaggtgaagagcctggggcctcagtgaaggtctcctgcaaggcttctggtacttctacgtttacctcctatagtatactaacgtggggtcnccgccgaggcccgcgtggaaccaacgaccgtaggaggtgggagtggggagtcggggaccgtaaccctaacgacgtggtcgtaccgacgtagtcgttcttaccaccctacgtcccgtaccgggactacgtacctttaccacgtcgaacccacgtaacctccctaaccaactaaaccactacgtaccctaacacgttacggtaagttacggaacggacgtccgtagactactccgtacgaaccgaaccgtaccggtacccgttacgttaacgttacgttcggtacgacggaacggtaccgtaccccgtaaggtaccgtccgggtacgacggtcccgttaacggcgaacggtcccggttaccgtttacggaccgtttccgggcggggtaacccggg

SEQ ID NO: 206645 - DNA, 647 bp, Homo sapiens
  misc_feature: GYAE6OF01D3Z4H.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcaacgtggtgcagtcgtgggctgaggtgaagacgcgtgggcctcgagtgaaggtctccgtgcagtcttcgtggattccacgtttacctccgtatagtatcaacgtgggtgccgccagggcccgtcgtaggaaccaacggacctggaggtcggagtgggatacgggaccgaaaccctacgacgtggtactacacgacgttgtacttccgaccctagtcccgtaccggacacgtaccttaccatacgaaccacgaacctcctaccaataaccacgactcctaacagtcggtagttgacggtacgctacgactacgtcgtacggaaccgaccgacggttcccgtacgttacgttacgtcggttacggacgtacggtaccgccccgaacggtacgtcccggtagtaccggcccgttaaccggcgtaaccggtccggttacccgtttacggacccggtttggtccgggggtaacccg

SEQ ID NO: 206646 - DNA, 552 bp, Homo sapiens
  misc_feature: GYAE6OF01BQKWG.17.25.C03.1.454.CMB.1.raw
  modified_base (290)..(290): a, c, t, g, unknown or other
  misc_feature (290)..(290): n is a, c, g, or t
  modified_base (336)..(336): a, c, t, g, unknown or other
  misc_feature (336)..(336): n is a, c, g, or t
  modified_base (342)..(342): a, c, t, g, unknown or other
  misc_feature (342)..(342): n is a, c, g, or t
  modified_base (430)..(430): a, c, t, g, unknown or other
  misc_feature (430)..(430): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctgggctgaggtgaagaagcctggggcctcagtgaaggtctcctgcaaggcttctggattcacgtttacctcctatagtatcaactgggtgcgccaggccgntggacaacgacctgagtggatgggatgggcgaaccctaagactggngtcacngtgtcttcacccatcctccgggacagaccttaccatcgaccacgaactccctacaactaaacacacgcctaacatcgagttgaggacncctgacatctagacgacaccggtccgtacttacttactgtgcgagacgtcccgacgcgttccggtggacgcccgacggacacgggcccggtacccgttttgacccgtttcggtacccggggg

SEQ ID NO: 206647 - DNA, 581 bp, Homo sapiens
  misc_feature: GYAE6OF01DRINI.17.25.C03.1.454.CMB.1.raw
  modified_base (281)..(281): a, c, t, g, unknown or other
  misc_feature (281)..(281): n is a, c, g, or t
  modified_base (433)..(433): a, c, t, g, unknown or other
  misc_feature (433)..(433): n is a, c, g, or t
  modified_base (492)..(492): a, c, t, g, unknown or other
  misc_feature (492)..(492): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagaagcctggggcctcagtgaaggtctcctgcaaggcttctggattcacgtttacctcctatagtatcaactgggtncgccgaggccgcgtggacaacgacctggagtggagtgggatcgggacgaaccctaacacgtggtgtcacgagttcgtccttcacccagtcccgtcgggacaggaccttaccatacgaccacgtacctcctaccaataaaccacacgcctaanagtggattaggaaggacgcctagacatcgtgaaccgacgaccggtccttactacttacngtgacgacgacgtcccacgtacgtccggtagacgtcccgtacggccgtaacggtccggtaccgttttcggcgtttccgggtaccggggg

SEQ ID NO: 206648 - DNA, 740 bp, Homo sapiens
  misc_feature: GYAE6OF01C8B2T.17.25.C03.1.454.CMB.1.raw
  modified_base (291)..(291): a, c, t, g, unknown or other
  misc_feature (291)..(291): n is a, c, g, or t
  modified_base (297)..(297): a, c, t, g, unknown or other
  misc_feature (297)..(297): n is a, c, g, or t
  modified_base (349)..(349): a, c, t, g, unknown or other
  misc_feature (349)..(349): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagaagccgtggggcccttcgaggtgaaaggtcctacctgcaaggctttctaggattcacgtttacctctatagtactcaacgtggtncgaccnggcgctggacacgctgaggtgagtggagtgggacctaaccgtacacgtggtntacacgtagtcgttccttaccaaccctacgttccccgtaccggggaaccaggttaacccttaccgtacgtacgtaacccctaacggtaacccttcccggttaaccaaagttaaaaccccacgtaaccggtacccttaaacgacggttagggtaacggtttacggaaagggtaccgtaccccgttgtaaacccttgttaaccggtcgaaccggtaaaccggtccgggttaacccgttacttaactttacggttacggtaccggtacggaacgggtccgttaccccggtaacggtacggttaaccccggggtacggtaccggtaccccggtaaccgggactaccgggttcccggttaccgtttttccggaccgttttccggggtaaccggggg

SEQ ID NO: 206649 - DNA, 559 bp, Homo sapiens
  misc_feature: GYAE6OF01D6QBQ.17.25.C03.1.454.CMB.1.raw
  modified_base (291)..(291): a, c, t, g, unknown or other
  misc_feature (291)..(291): n is a, c, g, or t
  modified_base (436)..(436): a, c, t, g, unknown or other
  misc_feature (436)..(436): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgntcggacaacgacctgagtggagtgggatgggaccgaaccctaacgacgtggtcgtcacgtagtcgtccttccaacccctatcccgtaccgggacagtaccttaccatacgaccacgaacctcctaccaataaacacacgacctanacgtggagttgaggacgctgacatctagacgacgacggtcctcttattctgtcgacgacgacgtacccacgtacgtccggtgacgccgtacggcgtacggcgtcctttcgcgttcggtcgggg

SEQ ID NO: 206650 - DNA, 602 bp, Homo sapiens
  misc_feature: GYAE6OF01AOAS1.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgcaggccgctggacacgacctgagtggatgggatgggcgaaccctaacacgtggtcgtcacagtgtccttcacccatccgtccggggacacgtaccttaccatcgaccacgaacctcctaccaataaaccacacgcctaacatgggagttggaggacgcctgactatcgtagaaccgaccgaccgggtcccgttacgttaactttaccgtgttacggccggaacgtaccggtaccccgtaacggtacgttcccgggtaggaccggccccgtacggggcctacgggtcccggttcccgtttcggtccgttccggtccggggg

SEQ ID NO: 206651 - DNA, 816 bp, Homo sapiens
  misc_feature: GYAE6OF01CD7YN.17.25.C03.1.454.CMB.1.raw
  modified_base (243)..(243): a, c, t, g, unknown or other
  misc_feature (243)..(243): n is a, c, g, or t
  modified_base (283)..(283): a, c, t, g, unknown or other
  misc_feature (283)..(283): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagaagccgtggggcctgagtgaagtctcctgcaggcttntggattctacgtttacctcctatagtatcaacgtgggtcnccgccgacggccgcgtggaaccaacgtaccgtggacggtggagtggggagtcggggacctaaacccgtaacgacgtggtcgtacacgtagttcgtaccttaccgaccctacgtccccgtaccggggaactacggtaaccttaacccgagttaccgaacccgtaaccggtaacccttcccctaacctaaacgtaaaaccctaacccgtaaccgtaccctaaacgacggttacgggtaacggtttaggaacgggtaaccgtcccgtaaggaaccctaacgttaccgtacgggtaaacccggtaacccggtaacccgggttacccgtttaaccgtttaaacggtttaccggttacgggtaccggtaccgggtaaaccggttacccggttacccccggtaaccgggttaaccggttccccggggtacggtacccggtaaccccgggttaaccggggacccggtaacccgggtaccccgggttttaacccggttttaccgggttaccccgggttttcccgggggtaaccccggggggg

SEQ ID NO: 206652 - DNA, 724 bp, Homo sapiens
  misc_feature: GYAE6OF01DRO41.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagccgtggggcctcgagtgaaggtctccgtgcaaggcttcgtggattcgtacgtttacctcctatagtatcaacgtgggtcgcgccacgggccgcgtaggaccaacgtcctaggacgtggagtggggatcggggaccgaaacccgtaacgtacgtggtcgtaccacgtaggttcgtccttaccaaccccgtacgtccccgtaccggggactaacggtaaccttaccgataccggtaacccaaccgtaacctcccgtaacccaaactaaaaccgacctaacggacccttaacgaagttacgggtaacggttaggaaacggtaccgtaccgttagaacctacgttaccgtaccggtaaccggtaacgtacccggggtaccgttacgtttaacttacgttcgggacgtacggtaacggtaccgttacccacgggtaccgttccgggtaggaccggtacccgttaacgggccgtacggtcccggttaccgttttacggccggtttccgggtaccgggggg

SEQ ID NO: 206653 - DNA, 760 bp, Homo sapiens
  misc_feature: GYAE6OF01APIT6.17.25.C03.1.454.CMB.1.raw
tcagcgtagactagcacgaccggtgctcgatttagtagtgtagatttggttttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagctggggcctcagtgaaggtctcctgcaggcttctggattcacgtttacctcctatagtatcaacgtgggtcgcgcctaggcccgcgtggaccaacgcctgacgtggagtgggatggggaccgaaaccctaacgacgttgggtcgttacaacgtaggttcgttcctttaccgaacccctacgtacccgtaccccgggggaactaacggtaaccctttaacccaagtaccgaaccccgtaaccgtaacccttcccctaacctaacttaaaacccaaccgtaaccgtacccttaaacaggttacgggaaggttttcggaaacgggaccgtacccgttaggaaccctacgttaccgttaacgggaacccgtaccgaacccggggttacccccgttacgtttaaaccgtttacccgtggttaacccggtacggtaaccggtaccgttaaccccccgaacggtacggttccccggggtaagtacccggtaccccggtaaccgggtctaacgggtcccgggttacccttttacgggacccgttttccggtacccgggggg

SEQ ID NO: 206654 - DNA, 671 bp, Homo sapiens
  misc_feature: GYAE6OF01DF77D.17.25.C03.1.454.CMB.1.raw
tcagcgtagactagcacgaccggtgctcgatttagtagtgtagatttgggtttgggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctgaggtgaagaagcctggggcctcgagtgaaggtctccgtgcaaggcttcgtggtacttctacgtttacctcctatagtatcaactggtgcgccgaggccgctggacaacgacctgacgtggagtgggagtgggaccgaacccgtaacgactggtgtcgaacgtaggtcgttccttccacccctagtcccgtaccgggacagtaccgtaaccctagtccgaccaaccgtaacccgtcccctaacccaactaaaaccgaccgtacgtaccctaacgtacgtagggacgtttcggaacggacgtccctacgactactcgtacgaaccgtaccgacccgggtaccgttaccgttaagtttaccgttggtacggccgtaacggtaccgtacccctaacggtaccgttaccgggtcgtacccgtacccgtacgggccgtacggtccggttcccgttttacgacccgtttcggtacccggggg

SEQ ID NO: 206655 - DNA, 727 bp, Homo sapiens
  misc_feature: GYAE6OF01CKF50.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagccgtggggcctcgagtgaaggtctcctgcaaggcttcgtggattcacgtttacctcctatagtatcaacgtgggtgcgccgaggccgcgtcggaaccacgacctggaggtggagtgggagtcgggaccgaaacccgtaacgacgtggtcgtcacgtagttcgtccttccaccctactcccgtaccgggactacgtaccttaccatcgaaccacgtaacctccctaccaataaaccacacgaccctaacgagtacggtagttggaacggacgtcccgtaggaacctacgtacgtacggaacccggaccgtaacccggggtcccgtttacttaacgtttaacgtcgggtaccggaccggtaaacggtacccggttaccccccgaaacgggttacccgttaccccggggtacggtaacccgggttacccccggttaaaccggggtcccgtaaaccggggttccccggggtttacccctttttaccgggacccggtttttcccggggtaccccgggggggg

SEQ ID NO: 206656 - DNA, 559 bp, Homo sapiens
  misc_feature: GYAE6OF01A7PR0.17.25.C03.1.454.CMB.1.raw
  modified_base (328)..(328): a, c, t, g, unknown or other
  misc_feature (328)..(328): n is a, c, g, or t
  modified_base (336)..(336): a, c, t, g, unknown or other
  misc_feature (336)..(336): n is a, c, g, or t
  modified_base (356)..(356): a, c, t, g, unknown or other
  misc_feature (356)..(356): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacacgacctgagtggatgggatgggcaaccctanacgtggtntcacgagtcgtcttcacccntccgtcgggacagacttaccatcgaccacgacctcctaccaataacacacgcctacatggagttgaggacgcctagacatctagaccgacaccggtccgttctagttactgtacgcgacgtacgtccccaacggtcgtcccgggtggaccgcccgtacgggccgacggcccgggtacctttcggaccgtttcggtaccggggg

SEQ ID NO: 206657 - DNA, 672 bp, Homo sapiens
  misc_feature: GYAE6OF01D3PWB.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagaagccgtggggcctcgagtgaaggtctcctgcaaggtcttcgtggatttctaccgtttacctcctatagtatctaacgtgggtcgcgccagggcccgcgtaggaaccaacgacctggaggtggagtgggagtgggaccaaaccctaacgacgtggtcgtccagtagttcgtaccttccacccctacgttcccgtaccgggaacctacggtaaccttaaccgagttaccgaacccgtaaccgtaaccttcccctaacccaaacttaaaacccaaccgtaacgtacccctaacgtaagttacgggtaacgtttacggaaggacgtaccgtaagacctatacgtacgaaccgaccggtaccggtccgttacttaagttaccgtgtacgacgtacgaccgtcccgaacgtcgtccgggagtaccgccgacggccgacggtaccggttccttcgtaccgttcgggacgggg

SEQ ID NO: 206658 - DNA, 605 bp, Homo sapiens
  misc_feature: GYAE6OF01B99TW.17.25.C03.1.454.CMB.1.raw
  modified_base (435)..(435): a, c, t, g, unknown or other
  misc_feature (435)..(435): n is a, c, g, or t
  modified_base (505)..(505): a, c, t, g, unknown or other
  misc_feature (505)..(505): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctggagtggagtggggatggggaccgaaaccctaacgacgtcggtgtccacgagtgttcttcacccctatccgtaccgggacagtaccttaccatcgacccagaacctcctacgaataaaccacagccctaanatgggtattggacggtacgccctagacatcgtacgacgtaaccaccggggtccttacttaagttaaccgngttacggacgtaagacgtacccccaaggtagttccccgggtaggaccgcccgtaacgggcaacgggcgggttaccctttggaccctttgggaccgggggg

SEQ ID NO: 206659 - DNA, 619 bp, Homo sapiens
  misc_feature: GYAE6OF01E0BBL.17.25.C03.1.454.CMB.1.raw
tcagcgtagactagcacgaccggtgctcgatttagtagtgtagatttgggtttgggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatggggaccgaaaccctaacgacgtggtgtcactaggtgttccttccacccactcccgtaccggggacacggtaccttaccatcgacccacgaacctccctaccaactaaaccacacgccctaacagtcgggagttggaggacgcctagacagtctaggaaccgaccgaccgggtcccgttacttaacgttaccgtggtcgacggacggtaccgtaccccgaacggtacgttcccgggtaggaccgtcccgtacgggctacgggcccggttacccttttcggaaccgtttccgggtacggggg

SEQ ID NO: 206660 - DNA, 672 bp, Homo sapiens
  misc_feature: GYAE6OF01B9XR7.17.25.C03.1.454.CMB.1.raw
  modified_base (174)..(174): a, c, t, g, unknown or other
  misc_feature (174)..(174): n is a, c, g, or t
  modified_base (183)..(183): a, c, t, g, unknown or other
  misc_feature (183)..(183): n is a, c, g, or t
  modified_base (226)..(226): a, c, t, g, unknown or other
  misc_feature (226)..(226): n is a, c, g, or t
  modified_base (236)..(236): a, c, t, g, unknown or other
  misc_feature (236)..(236): n is a, c, g, or t
  modified_base (252)..(252): a, c, t, g, unknown or other
  misc_feature (252)..(252): n is a, c, g, or t
  modified_base (272)..(272): a, c, t, g, unknown or other
  misc_feature (272)..(272): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactccaggtncagctggtncagtcgtgggctgaggtgaagagccgtgggctcgagtgagtcncgtgcagctntgattcacgtttaccnctatagtatcaacgtgggtncgcgaggccgacgtggaaccaacgacctgagtggagtgggagtcgggacctaaccgtagacgtggtgtaccagtacgttcgtccttaccacccgtacgtcccggtaccgggactaacggtaccttaccgagtaccggaacccaccgtaaccctaccctaaccgtaaactaaacccgactaaccgaccgttaacgtaggtaccgggtaaggttacggaacggtacgtaccctagaactacgtaccgtacggaaccgtacccgtaccgggttaccttacgttaacgtttacgtggtaccggacggtaccggtaccgtcccgaacgtcggtccggtacgacggtaccccgtaacggccgtaaccggtccggtttaccttacggtccggtccgggtaccggggg

SEQ ID NO: 206661 - DNA, 652 bp, Homo sapiens
  misc_feature: GYAE6OF01AP3AD.17.25.C03.1.454.CMB.1.raw
  modified_base (180)..(180): a, c, t, g, unknown or other
  misc_feature (180)..(180): n is a, c, g, or t
  modified_base (190)..(190): a, c, t, g, unknown or other
  misc_feature (190)..(190): n is a, c, g, or t
  modified_base (231)..(231): a, c, t, g, unknown or other
  misc_feature (231)..(231): n is a, c, g, or t
  modified_base (238)..(238): a, c, t, g, unknown or other
  misc_feature (238)..(238): n is a, c, g, or t
  modified_base (516)..(516): a, c, t, g, unknown or other
  misc_feature (516)..(516): n is a, c, g, or t
  modified_base (543)..(543): a, c, t, g, unknown or other
  misc_feature (543)..(543): n is a, c, g, or t
  modified_base (597)..(597): a, c, t, g, unknown or other
  misc_feature (597)..(597): n is a, c, g, or t
tcagcgtagactagcacgaccggtgctcgatttagtagtgtagatttgggtttggggtacgtcaacaaccacatctgtcctctagagaaaaccctgtgagcacagctcctcaccatggactggacctggaggatcctcttcttggtggcagcagctacaatgcccactcccagtgcagcnggtgcagtcngggctgaggtgaagagctggggcctcagtgaggtctcctgnaggtctntgtatctacgtttcctcgttatacgttatctaacgtgggtcgtcgccgtacggccgtacgtcggacaaccgccgtaggacggtgagttcgggagttcggggacccgtaaccgtaaacctcgtacgggttcgtacaccggtaagtcggttacttccgaacccttactccggttccggaacgacggttactaacccgtatcggaaccaccgttaacctcctacctaacgaaacctaccgcgtacccagtagtcggtagttcgaacggactccgtgtaacngtactgaaccgaaccggcgtacccgtnttaacgtctttaggcggttcgagtacgtccccgaacgacgttccggacggtacnccgggttccgaacgtcggtaccggtccgttttacgtaggttccgggtacccgggg

SEQ ID NO: 206662 - DNA, 512 bp, Homo sapiens
  misc_feature: GYAE6OF01DUH01.17.25.C03.1.454.CMB.1.raw
  modified_base (259)..(259): a, c, t, g, unknown or other
  misc_feature (259)..(259): n is a, c, g, or t
  modified_base (403)..(403): a, c, t, g, unknown or other
  misc_feature (403)..(403): n is a, c, g, or t
  modified_base (417)..(417): a, c, t, g, unknown or other
  misc_feature (417)..(417): n is a, c, g, or t
  modified_base (448)..(448): a, c, t, g, unknown or other
  misc_feature (448)..(448): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaaggcttctggattcacgtttaccncctatagtatcaactggtgcgccaggccgctggacaacgacctgagtggatgggatgggcgaacctaacactggtgtcacagtgtcttcacccatcctccgggacagcttacatgacacgaactctccataaacacagcctaanactggattgaggancctgacatctgacacgacgccgtctattacngtgcgagacgtcccagtactccggtgcgacctacggctaggcggtcctttggccgttgtcgggg

SEQ ID NO: 206663 - DNA, 562 bp, Homo sapiens
  misc_feature: GYAE6OF01EPB9X.17.25.C03.1.454.CMB.1.raw
  modified_base (282)..(282): a, c, t, g, unknown or other
  misc_feature (282)..(282): n is a, c, g, or t
  modified_base (293)..(293): a, c, t, g, unknown or other
  misc_feature (293)..(293): n is a, c, g, or t
  modified_base (333)..(333): a, c, t, g, unknown or other
  misc_feature (333)..(333): n is a, c, g, or t
  modified_base (459)..(459): a, c, t, g, unknown or other
  misc_feature (459)..(459): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcgagtgaaggtctcctgcaaggtcttctggattcacgtttacctcctatagtatcaactgggtncgccaggccgntggacaacgcctgagtggagtgggagtgggcaaccctaanactggtgcacagtcgtcttccaccctactccgtccgggacacgtacttaccagtacgacccaacgaaccttccctaccaataaaccacacgacctaacagtggagttgaggacgcctagacatcgngacgacgaccgggtccttactacttactgcgcgagtacgtacccagtcgtccggtagacgtcccgtacggcgacggtccgtactttcgtacgttcggtcgggg

SEQ ID NO: 206664 - DNA, 885 bp, Homo sapiens
  misc_feature: GYAE6OF01DR7AH.17.25.C03.1.454.CMB.1.raw
  modified_base (250)..(250): a, c, t, g, unknown or other
  misc_feature (250)..(250): n is a, c, g, or t
  modified_base (296)..(296): a, c, t, g, unknown or other
  misc_feature (296)..(296): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccgaggtgcagcgtggtgcagtcgtggggctggaggtgaagacgccgtggggcctgagtgaaggtctcgtgacaggtcttntggtactttccacgttttacctacgttatagtatacaagtgggtcncgccgacggccgtcgtaggaaccgtaaccgaccgttaggacggttaggaacggtgggaagttcggggaaccctaaaaccccgttaagaacgttgggtacgtacgaaccgtagggtttctaccctttaccgaccccgtaccgttccccggtacggggaaacctacggtaaccccttttaaccaacgttaccggaacccgtaaccggtaacccctacccgtaacccgttaaaacctaaaacccgtaacccgtaaccgtaacccgttaaacgtaaggttaacggggttaacggtttacgggaaacgggtacggttaccccgtacggtaaccgtacgtacccggtttaggaaaccccggttaacccggaccccggggttacccgtttaacgtttaacccgttaaccggttttacgggaaccggttaccggaacccggttacccggttaccccccgggtaaaaacgggttacccggttacccggggtaaccggtcccgggtaaacccccggttaccgggtaacccgtaacccgggttcccgggttttaccccggttttaacggtacccgggtttcccggggtaaccccgggggg

SEQ ID NO: 206665 - DNA, 865 bp, Homo sapiens
  misc_feature: GYAE6OF01DV4TS.17.25.C03.1.454.CMB.1.raw
  modified_base (195)..(195): a, c, t, g, unknown or other
  misc_feature (195)..(195): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcgttggtggcagcagctacaagtcgcccactcccaggtgcagcgtggtgcaggtcgngggctggaggtagaaagacgccggtggggcctagaggttacggaacggttcctccgtggacgaacgggtccttaccgtaggttactttacctaacccggttttaccctaccttaagtacggttataccgtaacggttcggggtacgcccggaccggtacgggtcccgtaggtacggaacccgtaaacccggtaccggtaggtacgggtagggtaacggttcggggtaacggttacccggggaaacccgttaaaaccccgttaaaccggtaaccggttcggggttaacgttaaccgtaacggttacggtttccggtttacccttaccccgaaccccgttaccggttccccggtaacccgggtaaccaaccgtttaacccttaacccgacgttaccgaaaccccgtaaccggtaaccctttacccgtaaacctaaacctaaacccaaccgtaaccgtaacctaccggtaagtacggggttaagtaacgggaacggtactaccggacgtaacgtcgaccggtacggaacccgaccggaccggttaccttactttaagtaccgtcggtacggaccgtaccgtacccgacccgaacgttaccggtcggacgtccggtacccgtaacgtccggtccggtcccggttacgttccggtaccggttcgggacccggggg

SEQ ID NO: 206666 - DNA, 682 bp, Homo sapiens
  misc_feature: GYAE6OF01A0ZW5.17.25.C03.1.454.CMB.1.raw
  modified_base (240)..(240): a, c, t, g, unknown or other
  misc_feature (240)..(240): n is a, c, g, or t
  modified_base (252)..(252): a, c, t, g, unknown or other
  misc_feature (252)..(252): n is a, c, g, or t
  modified_base (291)..(291): a, c, t, g, unknown or other
  misc_feature (291)..(291): n is a, c, g, or t
tcagcgtagactagcacgaccggtgctcgatttagtagtgtagatttgggtttggggactcaacaaccacatctgtcctctagagaaaaccctgtgagcacagctccctcaccatggactggacctggaggatcctcttcttggtggcagcagctacaagtgcccactcccaggtgcagctggtgcagtcgtggggctggaggtagaagaagccgtggggcctcgaggtgaaggtctccngcaaggcttcgnggtattctacgtttacctcctatagtatcaacgtgggtnccgccgagggcccgcgtacggacaaccgacctggaggtggagtggggagtcgggaccgaaacccgtaacgacgtgggtagtccacgtacgtcgtccttaccaccctagtcccgtccggactacgtacctaccgatacgaccaacgtacctacctaccaataaaccacacgacctaacagtggtaacgttggacgtacgtccgtagacctacgtcgtacgaaccgaccggtacgggtacccgttacgttaacttaccgttggtaccggacggaagtacccggttaccccgaacggttaccggttacccgggcggtaaaccgggtacccgacgggacccgtaccgggtcccggttaacccgttttcgggtaacccgttcgggtacccgggggg

SEQ ID NO: 206667 - DNA, 596 bp, Homo sapiens
  misc_feature: GYAE6OF01CUGJ9.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaggtctcctgcaaggcttcgtggattctaccgtttacctcctatagtatcaacgtgggtcgcgccaggccgcgtcggaccaaccgacctggaggtggagtggggagtgggaccaaccctaacgcgtggtcgtcacgtagtcgtccttaccaccctacgcccgtccggactacgacttacactcgaccaaccgtaacctcctacaactaacacacgaccctacgagtcggagttgacggagccgtagactatcgagaccgacgaccggtcgttacttacgttacgtcgtcggacgtagcccgtacccgacggtacgttccgggtagaccgccggtacgcgtacgtccggtaccgtttcgccgttcggtacgggg

SEQ ID NO: 206668 - DNA, 608 bp, Homo sapiens
  misc_feature: GYAE6OF01CTH8C.17.25.C03.1.454.CMB.1.raw
  modified_base (478)..(478): a, c, t, g, unknown or other
  misc_feature (478)..(478): n is a, c, g, or t
tcagcgtagactagcacgaccggtgctcgatttagtagtgtagatttgggtttggggactcaacaaccacatctgtcctctagagaaaaccctgtgagcacagctccctcaccatggactggacctggaggatcctcttcttggtggcagcagctacaagtcgcccactcccaggtgcagctggtgcagtcgtggggctggaggtgaagaagccgtggggcctcaggtgaaggtctcctgcaaggtcttcgtggattccacgtttacctctatagtatcaacgtgggtcgcgccgaggccgcgtggaacaacgacctgaggtggagtgggagtcggggaccaaaccgtaacgacgtggtgtacagtagtcgtacttaccgaccctatcccgtacgggaactacgtaaccttacgatacgaaccaacgtactacccgtacaactaaacactacgacctacagtacgggtagtgacgacncctgactatcgtacgaacgaccgtacgtaccgtacttacttaccgtaggtccgacggtacgtaccgtaccccgagtaccgtccggtagacgtcccgtacggcgtacggtcgtactttcgcgtggtcgggg

SEQ ID NO: 206669 - DNA, 693 bp, Homo sapiens
  misc_feature: GYAE6OF01AD555.17.25.C03.1.454.CMB.1.raw
  modified_base (284)..(284): a, c, t, g, unknown or other
  misc_feature (284)..(284): n is a, c, g, or t
  modified_base (295)..(295): a, c, t, g, unknown or other
  misc_feature (295)..(295): n is a, c, g, or t
tcagcgtagactagcacgaccggtgctcgatttagtagtgtagatttgggtttggggtacgtcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagccgtggggcctcaggtgaaggtctcctgcaaggctctggattcacgtttacctcctatagtatcaacgtgggtncgccaggccgntggacaacgacctgagtggatgggaagtgggaccgtaaaccctaacgacgtggtcgtcacgtagttcgtcttcgaaccctatcccgtccgggactacgtacctttacagtcgaacctacgtaacctccccttacaaattaaaccacacgtaccctaactagtagggtaacgtttacggaagggacctcccgttaggaacctacgttacccgtggaacccgtaacccgacggggttaccccgttacttaacgtttaaccgtggtacgggacccgtagggtaaacccgttccccgaggtaacccgttcccggggaaggtacccggccccgtttaaaccgggccgaacgggttccccgggttaaccctttttgggacccccgttttagggtcccggggggg

SEQ ID NO: 206670 - DNA, 835 bp, Homo sapiens
  misc_feature: GYAE6OF01DFKOJ.17.25.C03.1.454.CMB.1.raw
  modified_base (288)..(288): a, c, t, g, unknown or other
  misc_feature (288)..(288): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagaagccgtggggcctcagtgaggtctcctgcaaggcttcgtggattcctacgtttacctcctaatagtatctaacgtgggtcncgccaggccgtcgtaggaccaacgacctggagtggatggggatggggccgaaaccctaaacgacgttggtacggttaccaaacgtaggttacgttcccgtttaccaaacccccgtaacgtttcccccggttaacccggggggaccttaaacgggtaacccctttttaaaaccccgaaacgttttcccggaaaaccccgtaaccgggttaaaaccccttcccccgttaacccgtaaaactaaaaacccgttaccaaccgggtaaccctaaacgtacgttacggggaaggtttcggaaacgggtgtaccccgtaggaacctacgttccgaacggaaccgtaacccggtacccgggttaccggtaccttttaaactacgttgggtacggtaacccggtaacgtacccgggtttaccccgaaacggtccggttacccgggggttaacggtaacccggtaaccccggttaccggggaacccgttaccggggggtaaccccgtttcccggtttttacggaaaccccggttttcggggttaaccccgggggggg

SEQ ID NO: 206671 - DNA, 643 bp, Homo sapiens
  misc_feature: GYAE6OF01BXK4U.17.25.C03.1.454.CMB.1.raw
  modified_base (306)..(306): a, c, t, g, unknown or other
  misc_feature (306)..(306): n is a, c, g, or t
  modified_base (371)..(371): a, c, t, g, unknown or other
  misc_feature (371)..(371): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagaagccgtggggcctcgagtgaaggtctccgtgacgaaggtcttctggtacttcaccgtttacctcctatagtatcaacgtgggtcgcggcccagggcccncgtggaccaaccgacctggaagtgggagtgggagtcggggaccaaaccctacacgtggtcgcganagtgtctccacccagtcccgcggacacgtacttaccactcgaaccgaccgtaacctaccctaccaactaaaccgtacacgtacctacgatcgggtaagttcggaggtacgtaccgtagaactacgtacgtacgaaccgtaccggaaccggtcccgttacttacgttacgtcgtggtaaccgtacggtaccgtccccgaacgtcgttaccggtacggaccgtacccgacgggccgtacggccggttaccgtttcgtacgttccgggtacgggg

SEQ ID NO: 206672 - DNA, 733 bp, Homo sapiens
  misc_feature: GYAE6OF01AKCSI.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagaagccgtggggcctcgagtgaaggtctcctgcaaggcttcgtggattcaccgtttacctcctatagtatcaacgtgggtgccgccgaggcccgcgtcggaccaacgcctggaggtggagttggggagtcggggaccaaaccccgtaacgaccgttgggtacgtccaacgtacggttcgtccttaccaacccctacgtcccggtacccgggggaacaccggtacctttaaccgacttaccggaacccctaaccgtaacccttaccccgtacccaaacttaaaacccgaaccgtaaccggtaccctaacgtacgtacggggtaaggtttacgggaacgggtacggtccctagggaacctacgttaccgtacgggaacccgtaccggtaccggggtacccgttacttaacgtttaccgtacggtcggaccgacggtacccgtcccgaacggtaccgttccgggtaggtaccggacccgtacgggccgtaccgggtccggttccgtttacggccggtttcgggtaccgggg

SEQ ID NO: 206673 - DNA, 570 bp, Homo sapiens
  misc_feature: GYAE6OF01D3QFR.17.25.C03.1.454.CMB.1.raw
  modified_base (292)..(292): a, c, t, g, unknown or other
  misc_feature (292)..(292): n is a, c, g, or t
  modified_base (341)..(341): a, c, t, g, unknown or other
  misc_feature (341)..(341): n is a, c, g, or t
  modified_base (361)..(361): a, c, t, g, unknown or other
  misc_feature (361)..(361): n is a, c, g, or t
  modified_base (420)..(420): a, c, t, g, unknown or other
  misc_feature (420)..(420): n is a, c, g, or t
  modified_base (469)..(469): a, c, t, g, unknown or other
  misc_feature (469)..(469): n is a, c, g, or t
tcagcgtagactagcacgaccggtgctcgatttagtagtgtagatttgggtttggggactcaacaaccacatctgtcctctagagaaaaccccgtgagcacagctcctcaccatggactggacctggaggatcctcttcttggtggcagcagctacaagtgcccactcccaggtgcagctggtgcagtctggggctgaggtgaagaagccgtggggcctcagtgaaggtctcctgcaaggcttctggattcacgtttacctcctatagtatcaactgggtgcgccaggccgntggacaacgcctgagtggagtgggatcgggacaaccctaacacgtggtntcacgagtgtcttcaccctntcccgtccggacacgacttacatcaaccacgaacctcctaccaactaaacacagcctanagtaggtagttagacgagcctagactatcgagaccgaccgacggccttnttaacttcgtgtcgcgacgtacgtacccgagtacgtccggtagacggtcccgtacggccgacggtcccgttccgtttagaccgttcggcggggtacccggg

SEQ ID NO: 206674 - DNA, 704 bp, Homo sapiens
  misc_feature: GYAE6OF01CSHDK.17.25.C03.1.454.CMB.1.raw
  modified_base (481)..(481): a, c, t, g, unknown or other
  misc_feature (481)..(481): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagagccgtggggcctcagtgaaggtctcctgacaggcttcgtggattctacgtttacctcctatagtatcaacgtgggtcgccgccagggccgcgtcggaaccaacgaccgtggacggtggtagtggggagtcggggacctaacccgtaacgacgtggtagtaccgagtacgttggtccttccgaaccctacgtcccggtacccgggactacggtacccttaacgactacggacctaaccgaacctcctaccaactaaacccacacgtaccctaancgtagggtacgttaggaacggacgccgtagaactacgtcgtacggaaccggaccgtaccggggtccttaccgttaacttccggttagtcggaccgtaacgggtacccggtacccgtaccggtacggttcccgggttagggtaaccccgacccggttaccgggaccggtaccgggtacccggtttaccgttttaccggtccggttttcccgggtaccggggggg

SEQ ID NO: 206675 - DNA, 723 bp, Homo sapiens
  misc_feature: GYAE6OF01BTGCZ.17.25.C03.1.454.CMB.1.raw
  modified_base (245)..(245): a, c, t, g, unknown or other
  misc_feature (245)..(245): n is a, c, g, or t
  modified_base (530)..(530): a, c, t, g, unknown or other
  misc_feature (530)..(530): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagaagccgtggggcctcgagtgaaggtctcctgcaggcttntggtacttcacgtttacctcctatagtactcaacgtgggtcgccgccgacggcccgcgtacggaaccaaccggtacctggaacggttggagttaggggagttcgggtaaccgtaaccccgtaaacgacgttaggtgtaccacgtacgttcgtcctttaccgaccctactcccggtaccgggaacctacgtaccttaaccgactccgaacccaccgtaacccttcctaccaaacgtaaaccaccacgtaccctaagacgtggtaagttcgaacggtacacccgtanaaccgtactacggacgtaacccgacggtacccgggtccgttaccgtttaacgttaccgtggtacggaccgttaacggtacccgtacccccggtaacggtccgttacccggggagtaaccccgtcccggttaaccgggccctaccggggtcccgtttaccgtttacggtacccggttttcccgggaccgggggg

SEQ ID NO: 206676 - DNA, 796 bp, Homo sapiens
  misc_feature: GYAE6OF01CX6RM.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggactggaggtgaagaagccgtggggcctcgagtagaaggtcctccgtgacgaaggtcttcgtggatttcctaccgttttacctcctaattagtatccaacgtggtcgccgccgacgggcccgcgtacggaaccaaccggtaccgtggacggtagggaggtcggggagtccggggaacctaaacccgtaacgacgtggtcgtactacgagttcgtccttacaccccgtactcccgtaccgggactacggtacccttacacgtaccgacccaaccgtaaccctaccctacctaaactaaaccgaaccgtaaccgtacccttaaaccgtaggtaacgggttaggttaacggtaacgggtaccgttacccggtacggtaacctacgttaccgtaaccgggtaacccggaacccggtaacccccgggtccctttaaccggtttaaaccgtttaaccggttggtaaccgggacccggttaaacggaccccggttacccgaacggttacccggttacggggaccgttaccgggaccccggttaccgggacgtacccgggtacggtttacccgttttacggttaacccggtttcggggtaaccccgggggg

SEQ ID NO: 206677 - DNA, 652 bp, Homo sapiens
  misc_feature: GYAE6OF01CL11P.17.25.C03.1.454.CMB.1.raw
  modified_base (222)..(222): a, c, t, g, unknown or other
  misc_feature (222)..(222): n is a, c, g, or t
  modified_base (286)..(286): a, c, t, g, unknown or other
  misc_feature (286)..(286): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctggtgcagtcgtggggctggaggtgaagagccgtggggcctnagtgaaggtctccgtgcaaggcttcgtggattcacgtttacctcctatagtatcaacgtgggtncgccaggccgctggacaacgaccgtgaggtggatgggatcggggaccaacccgtaagacgtggtcgtacacgtagttcgtccttccaacccgtctccgtaccgggactacgtacttacatcgaaccacgtactccaccaataaacacacgtacctacgagtacgggtagttggaaggccgtacctagtaactacgttcgtaacggaacccgacgtaaccccgggtcctttacgttaactttaccggttggaccggtacggtaacgtaccgtaccccgaacggttacggttcccgggtaacgccggtacccgtaaccgggcgtaccgggtccggtttcctttacgggtaccgtcgggtacccggggg

SEQ ID NO: 206678 - DNA, 648 bp, Homo sapiens
  misc_feature: GYAE6OF01DL7PR.17.25.C03.1.454.CMB.1.raw
  modified_base (246)..(246): a, c, t, g, unknown or other
  misc_feature (246)..(246): n is a, c, g, or t
  modified_base (453)..(453): a, c, t, g, unknown or other
  misc_feature (453)..(453): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggactcctcttcttggtggcagcagctacaagtgcccactcccaggtgcagctggtgcagtcgtggggctgaggtgaagagcctggggcctcagtgaaggtctcctgcaaggcttcgnggattcacgtttacctctaatagtatcaacgtgggtgcgccgaggccgcgtggacaacgcctgagtggatgggatgggaccgtaaacctaacgacgttggtgtacacgagttcgtccttacacccctatcccgtaccgggaactacgtaacttacccaagtccgaaccaacgaacctcctaccaaactaaaccacaacgtacctaanaacgtgggtacgttacgaggtacgccttaacgactactacgtacggaaccggtaccgaaccgggtacccgttacttaacgtttaccgtcggttacgacggtaacggtaccgtacccgaacggtaccgtcgggtacgacggtccccgtacggccgtacgggtacccggttccgtttcgtaccgttcgggtcggggg

SEQ ID NO: 206679 - DNA, 574 bp, Homo sapiens
  misc_feature: GYAE6OF01A8KFM.17.25.C03.1.454.CMB.1.raw
  modified_base (432)..(432): a, c, t, g, unknown or other
  misc_feature (432)..(432): n is a, c, g, or t
  modified_base (440)..(440): a, c, t, g, unknown or other
  misc_feature (440)..(440): n is a, c, g, or t
  modified_base (446)..(446): a, c, t, g, unknown or other
  misc_feature (446)..(446): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaaggcttctggattcacgtttacctcctatagtatcaactgggtgcgccaggcccgctggacaacgcctgagtggatgggatgggcaaccctacgactggtgtcacagtcgtccttcaccctatcccgtcgggacagaccttacgatcgaccacgtaactccctcaataaccacagccctacgatggagttgaggtcncctagacngttcgngaaccgacgaccggtcctacttactcgtgtcgacgaggtaccgtacccgacgtacgttcccgggagaccgtacccgtacggacgtacgggtacccgttacgtttcggtccgtttccggggtaccgggg

SEQ ID NO: 206680 - DNA, 566 bp, Homo sapiens
  misc_feature: GYAE6OF01AYXE5.17.25.C03.1.454.CMB.1.raw
  modified_base (335)..(335): a, c, t, g, unknown or other
  misc_feature (335)..(335): n is a, c, g, or t
  modified_base (343)..(343): a, c, t, g, unknown or other
  misc_feature (343)..(343): n is a, c, g, or t
  modified_base (347)..(347): a, c, t, g, unknown or other
  misc_feature (347)..(347): n is a, c, g, or t
  modified_base (423)..(423): a, c, t, g, unknown or other
  misc_feature (423)..(423): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcacggtcttctggattcacgtttacctcctatagtatcaacgtgggtgccgccgaggccgctggacaacgacctgagtggatgggatgggacaaaccctanacgtggtntcanagtgtcttcacccatcccgtaccgggacacgaccttaccatcgaccacgaacctcctacaataaacacacgcctanatgggagttggagacgctgacatctagacgaccgaccgggtccttacttagttacgtgtcgacgacgtaccgtcccaggtacgtccgggagaccgcccgtacgcgtacggccggttaccgtttcgtcgttcgggtaccggggg

SEQ ID NO: 206681 - DNA, 581 bp, Homo sapiens
  misc_feature: GYAE6OF01COKLX.17.25.C03.1.454.CMB.1.raw
  modified_base (450)..(450): a, c, t, g, unknown or other
  misc_feature (450)..(450): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagaagcctggggcctcgagtgaaggtctcctgcaaggcttcgtggattctacgttttacctacctatacgtatcaacgtgggtcgcgccacggccgctaggaacaacgaccgtggacgtaggagtgggatcggggaccaaacctaacgagtggtgtcacgtagttcgtccgttccaccctagtcccgtacgggacacgtaccttacgatcgaccacgaacctccactaataaaccacacgacctanagtggagttgaggctcctgactctcgacgacgtacgaccgcttactagttctgtcacgagaccgtccgacgtacgtcccggtagccgacggtacggctacgggtaccgttgtttcgcgtttcgggacgggg

SEQ ID NO: 206682 - DNA, 548 bp, Homo sapiens
  misc_feature: GYAE6OF01D6JH5.17.25.C03.1.454.CMB.1.raw
  modified_base (280)..(280): a, c, t, g, unknown or other
  misc_feature (280)..(280): n is a, c, g, or t
  modified_base (414)..(414): a, c, t, g, unknown or other
  misc_feature (414)..(414): n is a, c, g, or t
  modified_base (428)..(428): a, c, t, g, unknown or other
  misc_feature (428)..(428): n is a, c, g, or t
  modified_base (496)..(496): a, c, t, g, unknown or other
  misc_feature (496)..(496): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgctggacaacggacctggagtggagtgggatgggcaaccctaacactggtgtcacagtgtcttcacccatccctcgggacagacttaccatcgaccacgaactccaccaataaacacagacctanatggattgaggtancctgactatctagacgagtaccggcgttctattacgtgtcgcgagacgtccccacgtacgtccggganacggccctacgggccgtaggcccggtccttttcgccgttggtacccgggggg

SEQ ID NO: 206683 - DNA, 615 bp, Homo sapiens
  misc_feature: GYAE6OF01CIBOB.17.25.C03.1.454.CMB.1.raw
  modified_base (281)..(281): a, c, t, g, unknown or other
  misc_feature (281)..(281): n is a, c, g, or t
  modified_base (304)..(304): a, c, t, g, unknown or other
  misc_feature (304)..(304): n is a, c, g, or t
  modified_base (314)..(314): a, c, t, g, unknown or other
  misc_feature (314)..(314): n is a, c, g, or t
  modified_base (350)..(350): a, c, t, g, unknown or other
  misc_feature (350)..(350): n is a, c, g, or t
  modified_base (411)..(411): a, c, t, g, unknown or other
  misc_feature (411)..(411): n is a, c, g, or t
  modified_base (603)..(603): a, c, t, g, unknown or other
  misc_feature (603)..(603): n is a, c, g, or t
tcagcgtagactagcacgaccggtgctcgatttagtagtgtagatttggggtttgggggggagtcagtctcagtcaggacacagcatggacatgagggtccccgctcagctcctggggctcctgctactctggctccgagctgccagatgtgacatccagatgacccagtctccatcctccctgtctgcctctggtgggggtcagagtcaccatcacttgccggacaagtcacggacttaaaacctatttaaattggtatcagcaagaaacctggaaaacnccccagacctctgatctctggtncatccactcngcgaagtcgcctccatcgaggttcaggtgcaggtgntcgtggactagtattcaatctacacctatccacctactctacgacctaaccgtgaacggtntttgtcgtactaactccttaacttacgtacgtaaccaaacgtagttaaccgttaccctaccgtttaccccccgtagttaccgtttaaccgttttcggggaaccccggtaaggggtaaacccttaaaagggttacggaacgtaaccgtacgtaaaacggtacgttgggtacgtccgtacgaccacctacgttnttccgtttaccg

SEQ ID NO: 206684 - DNA, 628 bp, Homo sapiens
  misc_feature: GYAE6OF01CF4QB.17.25.C03.1.454.CMB.1.raw
  modified_base (246)..(246): a, c, t, g, unknown or other
  misc_feature (246)..(246): n is a, c, g, or t
  modified_base (483)..(483): a, c, t, g, unknown or other
  misc_feature (483)..(483): n is a, c, g, or t
  modified_base (498)..(498): a, c, t, g, unknown or other
  misc_feature (498)..(498): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagagccgtggggcctcgagtgaaggtctcctgcaggtcttcnggtattcacgtttacctcctatagtatcaacgtgggtgcgccaggccgctggacacgacctggagtggagtgggagtcgggaccgtaaccctaacgtacgtggtcgtactacgtagttcgtacttaccacccgtatcccgtaccgggactacgtaccttaccgagtcgaaccctaacgtaacccttcctacctaactaaaccgacacgtacctaacagtaggtacgtaggacgtacnccgtagactctacgngacgacgacgggtccttacgttaagttccgtgtacggccgtagtccgtacccgacggtccgtccggggtacgcggtacccgtaccgggacctacgggtccctacggtttcgccggtttccggtaccgggg

SEQ ID NO: 206685 - DNA, 619 bp, Homo sapiens
  misc_feature: GYAE6OF01ASICD.17.25.C03.1.454.CMB.1.raw
  modified_base (298)..(298): a, c, t, g, unknown or other
  misc_feature (298)..(298): n is a, c, g, or t
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatccctcctgtctgcctctggtgggggtcagagtcaccatcacttgccggacaagtcacggtacgttaaaacctatttaaatgtatcagcagaacctggaaacgcccagacctcctgatctcgtggtcnctatcccactcgtgacgagtcggccgtcccagtcgagttcagtgctaggtggatcgtggactagtactttacaatctaccaacctactccacctactccgtcgacctaaccgtggacgtagttcgtcgaactattacctacctacgtacgtaacctaacgtacggttaaccgttaccgtaccgtttacccccgtcgttacccgttaccgtttacgggacccggtaacggggtaaccttaaaggttacgaacgtaaccgttaaaccgaaaccgtacgttcggtacgtaccgtacgacctaacctacgttccgttcgttaccc

SEQ ID NO: 206686 - DNA, 617 bp, Homo sapiens
  misc_feature: GYAE6OF01CGWLV.17.25.C03.1.454.CMB.1.raw
  modified_base (443)..(443): a, c, t, g, unknown or other
  misc_feature (443)..(443): n is a, c, g, or t
tcagcgtagactagcacgaccggtgctcgatttagtagtgtagatttgggtttgggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagccgtggggcctcagtgaaggtctcctgcaaggcttctggattcacgtttacctcctatagtatcaactgggtgcgcaggccgctgacaacgacctggagtggatgggagtgggacgaaccctaagacgtggtgtcacagttctcttccacccatcccgtcggacagtacttaccagtcgaccacgaacttcccacaataaacacacgacctagagtagggacgttgaagggacnccgttaagacctacgtcgtacgaaccgaaccgaccggggtccttacgttaacttacgtgggtacgaccggtagtacccgtacccccgaaggttacgtcccggggtagacgtaccccgtacgggacctacgggaccccggtttaccgttttcgaccgtttcgggtacccgggggg

SEQ ID NO: 206687 - DNA, 834 bp, Homo sapiens
  misc_feature: GYAE6OF01DQ49I.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctggaggtgaagagccgtggggcctcgagtgaacggtcctccgtgacgtaaggtcctttcgtaggtactttccgtaaccgttttaccctaccttaagttacgttacttaccgaacgttggggtcgccggaccgacgggcccgtacgttacggaaccaacgtaccgtaggtaggtaggtaggttacgggacggttcggggaaccctaaaaccccgtaagaccggttgggtaccgtacgtaacgtacggtttcgtacccttacccgtaaccccgtacgttacccggtaccggggaactaaccggtaaccctttaacccgaacgttaccggaaccctaaccgtaacccctaccgtaaccaaacttaaaacccacctaaccggtacccttaacgtaacggtagggttaacgttacgggaacgtacccgtaccgtacggtaacttacgttcgaaccggtaacgtaaccgtacccgggttaccttacgtttaacgttacgtacggtacggtaaccgtaacggtacccggtaacccgtaccgggtaccgttaccggggtaaccggtcccggaacccgggttacccggacggtaaccgggttcccggtttaccgtttaaccggtccgggttttcccgggacccggggg

SEQ ID NO: 206688 - DNA, 833 bp, Homo sapiens
  misc_feature: GYAE6OF01DUXKF.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctgaggtgaagaacgcgtggggcctcgagtgaggtctcgtgcaaggtcttcgtggtacttcgtacgttttacctaccttagtaagtataccaacgttggggtcgccggaccgacgggcccgtcgtacggaaccaacggaccgtaggacggtagggacgtagggagtcgggggaaccctaaaccccgtaaacgaccgttgggtacgtaccgaaccgtacgtttacgggttaccctttcccgaaacccccgttaaacgttcccccggtaacccgggggtaaaccctaaccgggttaaccctttaacccgaaacgtacccggtaaaccccaaacggtaaccccttaccccgtaaccctaaacgttaaaacccaacccctaacggtacccttaaacgtacggtttacggggaacggttttagggaacggggttacgtaccccggtacgaaacgtaccgtttacggacgaaccccgggtaaccgtacccggggttacccgttaacgtttacgttaacgttcggtccggaacggacggtacccgacccggtaacggtacggttacccgggtacggaccggtacccgtaccggacggtaccggtcccggtttaccgtttaccggacccgtttcggggtaccggggg

SEQ ID NO: 206689 - DNA, 692 bp, Homo sapiens
  misc_feature: GYAE6OF01DPKYV.17.25.C03.1.454.CMB.1.raw
  modified_base (291)..(291): a, c, t, g, unknown or other
  misc_feature (291)..(291): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaaggcttctggattctacgtttacctcctatagtatcaactgggtgcgccgaggccncgtacgggaacaaccggacctggagtcggagtggggacgtcgggacctaaaccctaacgtacgtggtacgtcaacgtacgttcgtccttacacccctagtcccgtaccgggactacgtaaccttcgaacgacgacccgtactaccctacctaacgaaactaaccacgacctacgtaatggttacggtagttacgggacgtaccgtcgtaacgacctagttaccgacggaacccgtaccggtaccccgggttacttacgtttacgttaagcggtacggaaccggtaaccggtacccgtacccggaacggttccggttaccgggacgttaacccggcccgggtaaccgccggtaccgggttaccccgtttacgggttacttacccgggtcggggtacccgggg

SEQ ID NO: 206690 - DNA, 745 bp, Homo sapiens
  misc_feature: GYAE6OF01AK4GD.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagccgtggggcctcgagtgaaggtctcctgcaggcttcgtggattctaccgtttacctccttatagtatacaacgtgggtcgccgccgaggccgcgtaggaaccaacgaccgtggaggtggagtggggagtcggggaccgtaaaccctaacgacgtggtcgtaccacgtaggttcgtccttacccacccctacgttccccggtaccggggaacctaacggtaaccctttaacccgacgttaccgaaccctaaccggtaaccttacccctaaccaaaccttaaaaccaacccgtaacgtaccccttaaacgaggttacgggtaacggtttggaacgggacgtcccgtagaacctacgttacgacggaacccgaccggtaccggggtccctttaacgttacgttaccggttggtaccggacggtacgtacccggtaccccgaacggtccggttacccgggaggacccggtacccggtacgggaccgcggggttaccccggttaccgttttcgggtacccggtttcggggtacccggggg

SEQ ID NO: 206691 - DNA, 660 bp, Homo sapiens
  misc_feature: GYAE6OF01C3WNB.17.25.C03.1.454.CMB.1.raw
  modified_base (281)..(281): a, c, t, g, unknown or other
  misc_feature (281)..(281): n is a, c, g, or t
  modified_base (468)..(468): a, c, t, g, unknown or other
  misc_feature (468)..(468): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagagcctggggcctcagtgaaggtctcctgcaggcttctggattcacgtttacctcctatagtatcaacgtgggtcncgccgaggccgctggaacacgcctgaggtggagtgggatcggggaccgaaccctaacacgttgggctacacgtaggttcgtcctttaccaacccctactcccgtacccggggactaacggtaacctttaccgagtacggaacccaacgtaaccttccctacaaactaaaccacgtacgtacctaaancggtaggtacgttaggacgggtactccgtacggactagtcgtaacggaccggacctaaccgggtccctacttaactttaccgtggtcgacggtaacgtccggtacccgacggtcgttacccggggtagaaccggaccccgttacggcgtacgggtaccggttcctttacgggcctttcggggtaccgggggg

SEQ ID NO: 206692 - DNA, 773 bp, Homo sapiens
  misc_feature: GYAE6OF01B64XZ.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagccgtggggcctcgagtgaacggtctcctgcaaggcttcgtggtattctacgtttacctcctagtagtactcaacgtgggtcgcgaccgaggcccgcgtacggaaccaacggtaccgtggaggtcggaagttcggggagtacggggaaccgtaaaccccgtaacgtacgtgggttacgtacgaacgtacggttccgttacctttacccaaccccgtacgttccccgtaccggggaactaccggtaacttaacccgacgtaccgaccgtaaccgaacccttcctaacctaaacgtaaaccacgaaccggtaccctaaacgtaggtacgggtaacgttagggaacgggtactacccgttacgaacgtacgtttacccgacggaacccgtaaccggacccgggttacccgttacgttaacttaccgtcggtacggaaaccggtacgtacccggttaccccgtaacggtacccggttacccgggtggaacccggttaccccggtaacgggacccggtacgggtacccggttaccggttttacgtacccggtttccgggtaccgggggg

SEQ ID NO: 206693 - DNA, 692 bp, Homo sapiens
  misc_feature: GYAE6OF01AM8NQ.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagccgtggggcctcagtgaaggtctcctgcaaggcttctggattcacgtttacctcctatagtatcaactgggtgccgccaggccgcgtcggacaacggacctggagtggagtgggagtcgggaccgaaaccccgtaacgacgttgggtcgtcgaacgtagttcgtccttacccaccccgtacgttcccgtacccggggactaacggtaaccttacccgagttaccgaacccaccgtaaccctccctaccaaactaaaccaccaacgaccctaacgtagttacgggtacgttacgggaacggtacgcccgttaggaacctagttccgtacggaacccggaccgtacccgggtccgttaccttacgtttaccgtggtacggaccgacggtacccgtccccgaacggtaccgttccgggtacgacccggtcccgtaaccgggccgacggtcccggttacccgtttggtacccgttcgggtcccggggg

SEQ ID NO: 206694 - DNA, 610 bp, Homo sapiens
  misc_feature: GYAE6OF01AFO9Q.17.25.C03.1.454.CMB.1.raw
  modified_base (289)..(289): a, c, t, g, unknown or other
  misc_feature (289)..(289): n is a, c, g, or t
  modified_base (463)..(463): a, c, t, g, unknown or other
  misc_feature (463)..(463): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaggtctcctgcaaggcttctggattcacgtttacctcctatagtatcaactgggtgcgccaggccgntggacacgcctgagtgagtgggatcgggaccaaccctacacgtggtcgtccacgagttcgtccttaccaacccctgtcccgtaccggggaactacgtaaccttaccacgtcgaaccctacgaaccttccctaccaataaaccacacgcctactacgtggtacgttggacggtcnccgtagacctatccgtacgaaccgacgaccgggtcccgttacttaacgtttacgtggtacgaccggagtacccgtacccgacggtacgtccgggtagaccgacccgtacggcaccggtccggtcctttcggccgttcggtaccgggg

SEQ ID NO: 206695 - DNA, 742 bp, Homo sapiens
  misc_feature: GYAE6OF01DCVF9.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctggtgcagtcgtggggctggaggtgaagagccgtggggcctcagtagaaggtcctcctgacgaaggcttcgtggatttcgtacgttttaccctcctaattagtacttccaacgttggggtcgccggccgacggcccgacgtacggaacaaccggaccgtggacggtgggtagtggggtagtcgggaacccgtaaaccctaaacgcgttaggtacgtaccaacgtagttacgtaccttacccaaccctagtccccgtacccgggactacggtacccttaaccgagtaccgacccgtaaaccgtaaccctacccgtaacctaaactaaacccgaccttaccgaacccttaaacgacgttacggggtagtttacggaacgggactaccgttacgacctagtccgtaacggaaccgtaaccgtacccgggtccgttacttacgtttacgtggtacgtaacggtaccggtaccgttacccgaacgtaccggtaccggttacgaccgtacccggtacggacctacggtacccggtttacctttacggtcccggtttgggacccggggg

SEQ ID NO: 206696 - DNA, 757 bp, Homo sapiens
  misc_feature: GYAE6OF01DLQXP.17.25.C03.1.454.CMB.1.raw
  modified_base (289)..(289): a, c, t, g, unknown or other
  misc_feature (289)..(289): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttgggtggcagcagctacaagtgcccactcccaggtgcagctggtgcagtcgtggggctgaggtgaagaagccgtggggcctcagtgaaggtctcctgacaaggtcttcgtggattcacgtttacctcctaatagtatcaacgtgggtcncgccaggccgcgtacggacaacgacctgagtggagtggggagtcgggaccgaaaccctaacgacgtggtgtccacgtagttcgtccttccaaccccgtacgttccccgtaccggggactaacggtacccttaaccgacgtaccgaaccctaaccgtaaacccttccccgtaaccctaaactaaaaaccaaccgacggtaaccccttaaactacggttacgggtaggtttacgggaacgggtacgtacccgttacggacctacgttacgtaacggaacccggtaacccggtacccggggtaccccgttacttaacgttttaaccggtcggttacggaccggtaacgtacccggttaccccgtaacgggtaaccgttacccggggtacggacccggtaacccgttaccgggaccgtacgggtcccgggtttacccgttttaacggtccggttttccgggtacccgggggg

SEQ ID NO: 206697 - DNA, 790 bp, Homo sapiens
  misc_feature: GYAE6OF01DI2ZJ.17.25.C03.1.454.CMB.1.raw
tcagcgtagactagcacgaccggtgctcgatttagtagtgtagatttgggtttggggactcaacaaccacatctgtcctctagagaaaaccctgtgagcacagctccctcaccatggactggacctggaggatcctcttcttggtggcagcagctacaagtgcccactcccaggtgcagctggtgcagtcgtggggctgaggtgaagaagccgtggggcctcgagtgaaggtctccgtgcgaaggcttcgtggtattctacgtttacctcctatagtatcaacgtgggtcgccgccgacggcccgtcgtacggaaccaaccggaccgttaggacgggttgggaaacggttgggggaagttccgggggaacccgtaaacccccgttaaaacgaccggttgggttacgttacccgaacgtaggtttccggttccctttacccaaccccgttacgtccccggtacccggggaactaaccggtaacctttaacccaacggtaccgtaaacccaaccggttaaacccttaccctaacctaaaacttaaaacccaacgaaccgtaccctaaacgtaacgttacggggtaaaggtttacgggaacgggtacgtacccggttacgaacgtacttccggtaacgtaaccggaacccgtaccgggtcccggttaccttaagtttaccgtggtaccggacggtacgacccggttacccaaccgggtcgtacccgggtaggaccgtacccggtaacggccgtacgggacccgttccgtttcgtaccggtttccggacggggg

SEQ ID NO: 206698 - DNA, 917 bp, Homo sapiens
  misc_feature: GYAE6OF01EFTWX.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctctttcttggtggcagcagctacaagtcgcccactcccaggtgcagctggtgcagtcgtggggctggaggtagaagaacgccgtggggcctcgagtgaacggtctccgtgacgtaaggtctttcgtaggtactttaccgtaccgttttaccctaccgttaagttaacggttacttaccgtaaacggttgggggtcgtccggtaccccgaacggggtccccggtccgttacggggaaacccgtaaaacccggtaccccgttagggtaacgggttaggggtaacgggttacgggggtaacggttaccgggggaacccctaaaaccccggttaaaccgtacgggtttacgggttaccgtaccgtaaccggttagggtttccgttacccgtttaaccccgaacccccgttacgttacccccgggtaccggggtaaaccctaaccgttaaccctttaacccgaagttacccggaaaccccgtaacccggtaaccctttaccccctaaaccgtaaaacctaaaaacccgtaccctaaccgtaacccgttaacgtaacgggttacgggttaaacggttacgggaacgggtaccgtccgtaacgaacctaaccggtttcgaaccggaaccggacccggtacccgggttacccgttactttaacgtacggttacggtaccggacggtaaccgtcccggtaaccccacgggtccggttaccgggtagacccggtaccggtacggccgtacgggttccggtttaccgttcggttccggtcgggtaacccggggg

SEQ ID NO: 206699 - DNA, 816 bp, Homo sapiens
  misc_feature: GYAE6OF01AI93W.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctggtgcagtcgtggggctggaggtgaagagccgtggggcctcgagtgaaggtctccgtgcaggtcttcgtggtacttccgtaccgtttacctcctagtagttactctaacgttgggtcgccggtccgacggcccgacgtacggaccaaccgacctggagtggaacgtgggagtacgggacccgtaaacccgtaacgtacgttggtacgtaccgaacgtacggttcgtaccccgttacccaaccccgtaccgttaccccggtacccggggaactaaccgtaaccccgtttaacccgaacgtacccgtaaacccgaaccgtaaccccttaccccttaacccgaaacttaaaacccgaccgtaaaccgtaccccttaacgaacggttacggggtaacgttacggaacgggtaacgtccccgtaacggacctacgtacccggtacgaacccggtaacccggacccgggttacccggttacttaaccgtttaccggtaggttaccggaccggtaaccggtacccggttacccccgaagggttacccggtacccgggttcggaacccggttccccgtaaccggggacgtacccgggtacccggtttacccgttttggtaacccggtttcgggtaacccgggg

SEQ ID NO: 206700 - DNA, 617 bp, Homo sapiens
  misc_feature: GYAE6OF01BGC38.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagaagccgtggggcctcagtgaaggtctcctgcaaggcttacgtggattctacgtttacctactatagtatctaacgtgggtcgcgccgaggccgctaggaccaacgacctggaggtggagtgggagtcgggaccgaaccctacacgtggtacgtcacgtagtcgtccgttacaccctcgtccgtaccgggacacgacttacatcgaccacgtactacctcaactaacacacgtacctagtagtagtagttaggagtacgtccgtagactacgtacgtacgaaccgacggtaccggtacccttagttacttacgtgtcgacggtaacgtccgtacccgacgtaccgttccgggacggtcgtacccgtacggaccgtacggtccgtaccgttttcgccggttcgggtaccgggg

SEQ ID NO: 206701 - DNA, 735 bp, Homo sapiens
  misc_feature: GYAE6OF01D3ZBM.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctggaggtagaagagccgtggggcctcagtgagtcctccgtgacgaggtcttcgtggtacttctaccgtttacctcctatagtatacgtacgtgggtcgccgccgacgggcccgtcgtacggaaccgtaaaccggtaccgtaggtacgggtagggtaggtaggggtaaggtcggggaacccgtaaaccccgtaaacgaccgttagggtacgtacgtaacgtacggttcgttacccttaccacccctacgtcccggtaccgggacctaacgtaccttaacccagtaccgaaccctaaccgtaaccctaccccgtacctaaactaaaccaccgaaccgtacctaacgagttagggtacgttaggaacggtaccgtaccgtacgaactacgtccgtacggaacccgtaccgaccgggttccttaacttacgtttaccgtggtacgacgtacggtacccgttacccgaaggttccgtcccgggtagacccggtaccgtaccggcgtacggcccgtttacgtttcgtaccgttcgggtacccgggg

SEQ ID NO: 206702 - DNA, 698 bp, Homo sapiens
  misc_feature: GYAE6OF01DYSDN.17.25.C03.1.454.CMB.1.raw
  modified_base (175)..(175): a, c, t, g, unknown or other
  misc_feature (175)..(175): n is a, c, g, or t
  modified_base (243)..(243): a, c, t, g, unknown or other
  misc_feature (243)..(243): n is a, c, g, or t
  modified_base (281)..(281): a, c, t, g, unknown or other
  misc_feature (281)..(281): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtncagctggtgcagtcgtgggctggaggtgaagagccgtgggcctcgagtgaggtctcgtgcaggtcttnggattctacgtttacctctatagtactcaagtgggtcncgccgacggccgcgtaggaacaaccgacctggaggtggagtggggacgtcggggaaccgtaaaccccgtaacgaccgttgggtacgtacgacgtagttcggtaccttaccgacccgtacgtcccggtacgggacacggttaccttaaccgagttaccgaaccctaaccgtaaccttcccctaacctaacgtaaaaccaccgtaacgtaccctaacgtagtacgggtagtttacgggacggtaccgtccgtagtaacgtacgttacgtacggaaccgtaccggtaccgggtaccctttacgttaacgttaaccgtggtaccggacggtacgaccgtaacccgacggttacgttccgggacgtacgcccggtaacggcgtccggtaccggtttctttcggtacgttccgggtaccgggg

SEQ ID NO: 206703 - DNA, 643 bp, Homo sapiens
  misc_feature: GYAE6OF01CQK47.17.25.C03.1.454.CMB.1.raw
  modified_base (221)..(221): a, c, t, g, unknown or other
  misc_feature (221)..(221): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtacccactcccaggtgcagctggtgcagtcgtggggctggaggtgaagaagccgtgggcctnaggtgaaggtctctgcaggcttcgtggacttcgacgtttacctctatagtatcaactgggtacgccacggccgctggaccaacgcctaggagtggatggggagtcgggaccgaaacccctaacgacgtggtcgtaccacgtaggttcgtacctttacccaacccctacttaccccggtaccgggaacaacgtaccgttaaccagtacgaacccacgtaaccctcctaaccaaactaaaccacacgcctaacagttggacggttagaggtacgccgtagaactactcgtacgacgacgaccggtccttactattcgtgtacgcgagaccgtaccccgacgtacgtccgggtacgaggtccccggtacggcgtaccggtccggttccgtttacgtaccgtcgggtccgggggtcggtaccgggg

SEQ ID NO: 206704 - DNA, 669 bp, Homo sapiens
  misc_feature: GYAE6OF01CZSCT.17.25.C03.1.454.CMB.1.raw
  modified_base (303)..(303): a, c, t, g, unknown or other
  misc_feature (303)..(303): n is a, c, g, or t
  modified_base (436)..(436): a, c, t, g, unknown or other
  misc_feature (436)..(436): n is a, c, g, or t
tcagcgtagactagcacgaccggtgctcgatttagtagtgtagatttgggtttgggagtcagtctcagtcaggacacagcatggacatgagggtccccgctcagctcctgggctcctgctactctggctccgagctgccagatgtgacatccagatgacccagtctccatcctccctgtctgcctctggtggggtcagagtcaccatcacttgccggacaagtcacggacgttaaaacctatttaaattggtatcagcaacgaaacctaggaaaacgcccaagacctcctagactctctggcnctactccactctgacgaagtcgccgtcccagtcggtagttcaggtgactagtggatcgaggacagtactttacgaacttcgtacacctatacccaaccgtaccttcgtacggaccctaaccgtaggaaggttntttcgtacgtaaccttaacgtacctttaaccgttaacttcgtaaacctaacgtaacgttaacgtttaacccgtaacccggttttccccctacggttaccgtttaaccggttttccggggaacccgtaaacgggggtaccttaaaacgggttgaaacgtaacgtaaaccgtaaacggtaacgttcgggttaaccggcttaccgaccctaaccttacgttccgttccgttacccg

SEQ ID NO: 206705 - DNA, 653 bp, Homo sapiens
  misc_feature: GYAE6OF01EHLX1.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagcgtggtgcagtcgtggggctggaggtgaagaagccgtggggcctcgagtgaaggtctcctgcaggtcttcgtggtattctaccgtttacctcctaatagtatcgacgtgggtcgccgccgagggcccgcgtacggaacctaaccggaccgtggacggtggaggttaggggagtcggggacctaaaccccgtaagtcggtggtcgttaccacgtaggttcgtccttaccaccctacgtcccgtacgggacacgtacttaccgagtcgaaccacgtaacctcctaccaacaaacacacgactacgagtagggagttgacgtacgtccgtagactagtcgacggaacgaccgtaccggtaccgtcttaagttactggtcggacggtacgaccggtacccgacgtacggtaccggtacggtaccgaccggtaccgggacgtacggccggttaccgttccggtacgttcgggtaccgggg

SEQ ID NO: 206706 - DNA, 704 bp, Homo sapiens
  misc_feature: GYAE6OF01BSH8P.17.25.C03.1.454.CMB.1.raw
  modified_base (294)..(294): a, c, t, g, unknown or other
  misc_feature (294)..(294): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagccgtggggcctcagtgaaggtctcctgcaaggcttctggattcacgtttacctcctatagtatcaacgtgggtcgcgccgaggccgngtcggacaacgacctggagtggagtggggagtcggggacctaaaccctaacgacgtgggttcgtaccacgtacgtcgttccttaccaccctacgtcccgtccgggacacgtaccttaaccacgtacgaacccaccgtaacctccctaccaaacgtaaaccaccaacgtaccctaacgagttacgggtaaggttggaacgggacgtacccgtacggaacctacgttcgtacgaaccggaacccgtaacccgggtcccgtttaacgtttacgttaacgttacggtacggtaccggtaaggtacccgtaccccgtaacggtacccggttccgggtacggtaccggtcccgtaaccggaccgtaagggttccccggttacccgttttcggtaacccgtttcgggtacccggggg

SEQ ID NO: 206707 - DNA, 724 bp, Homo sapiens
  misc_feature: GYAE6OF01B8K8H.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagaagccgtggggcctcgagtgaaggtcctccgtgcgaaggtcttcgtggtattctacgtttacctcctatagtatcaacgtgggtgcgccgacggccgcgtcggaaccaaccgaccgtaggaggtggtagtggggagtcgggaccgaaacccgtaacacgtggtacgtcgaacgagttcgtccttccgaaccctacgttcccgtccgggacacgtaaccttaccactacgaccaacgtacctaccctaccgaaactaaaccacaacgtcctaacgagtacgggtaagtttacggacgggacgtaccctaggaacctacgttcgttacggaaccggtaacccgtacccggggtaccctttacgttaacgtttaaccgtgggtacgtaccggtaaggtacccggttaacccgaccggtaacggttccccgggtacggaaccgggtaccccgttacggggaccgtaaccgggttccgggtttacccgtttacgggtacccggttttccgggtacccgggggg

SEQ ID NO: 206708 - DNA, 646 bp, Homo sapiens
  misc_feature: GYAE6OF01BD41C.17.25.C03.1.454.CMB.1.raw
  modified_base (230)..(230): a, c, t, g, unknown or other
  misc_feature (230)..(230): n is a, c, g, or t
  modified_base (240)..(240): a, c, t, g, unknown or other
  misc_feature (240)..(240): n is a, c, g, or t
  modified_base (308)..(308): a, c, t, g, unknown or other
  misc_feature (308)..(308): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggacctcagtgaggtcnctgcaggctnggattcacgtttacctcctatagtatcaactgggtgccgcaggccgcgtggacaacgacctgagtggntgggatgggacgaaccctaacacgtgggtcgtcactaggtcgtcgttccaaccctacgtcccttaccggggaccaggtacctttaaccgagttacgaacccaacgggtaacctccctacccaaattaaaaccaacccgtaacgtaccctaagtacggtacgggtagttaacgggaggacgtacctaggaccttgtacgacggaacgacccggtaccggtccttaacttagtaccgtcgtcggaggtaccgtccgtaccgaacggtcgtcggtaacgtcccgggaccgtcggaccgtaccgggtccgtttaccgtggttcccgttcggggtacccgggg

SEQ ID NO: 206709 - DNA, 755 bp, Homo sapiens
  misc_feature: GYAE6OF01D8L4G.17.25.C03.1.454.CMB.1.raw
  modified_base (608)..(608): a, c, t, g, unknown or other
  misc_feature (608)..(608): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttcgtggcagcagctacaagtcgcccactcccaggtgcagctggtgcagtcgtgggctggaggtagaagacgccgtggggcctcgagtgaaggtctccgtgacgaaggtctttcgtggtactttaccgttaaccgttttacccttaccgttaattaacggttaacttaccgtaacggttcggggtcgcccggacccgacgggcccgtacgtacgggaaccaaaccggtaccgtagggtacggtggtacggtaggggtagtcggggaacccgaaaccccgttaacgacgttcgggtactaccgtacgtaggttcgttaccttacccgaaccccgtacgttaccccggtacggggaacctacgtaaccttaccacgtaccgaaccaaccgtaaccccttacctaaccgaactaaaccacaacgtacctaagacggtaggttaacggttaggaacggtcgacctagaacctntaccgtacgaccgtaccggaccggttactacttacgttaacgtcggtcgacgtacgtaccgtaccgacggtccggttcggacgtcccggaccgtacgggccgtaccgggtcccggttaccgttacggttccgtcggggtacccgggg

SEQ ID NO: 206710 - DNA, 571 bp, Homo sapiens
  misc_feature: GYAE6OF01A9R7E.17.25.C03.1.454.CMB.1.raw
  modified_base (219)..(219): a, c, t, g, unknown or other
  misc_feature (219)..(219): n is a, c, g, or t
  modified_base (280)..(280): a, c, t, g, unknown or other
  misc_feature (280)..(280): n is a, c, g, or t
  modified_base (291)..(291): a, c, t, g, unknown or other
  misc_feature (291)..(291): n is a, c, g, or t
  modified_base (411)..(411): a, c, t, g, unknown or other
  misc_feature (411)..(411): n is a, c, g, or t
  modified_base (463)..(463): a, c, t, g, unknown or other
  misc_feature (463)..(463): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctnagtgaaggtctcctgcaaggcttctggattcacgtttacctcctatagtatcaactgggtncgccaggccgntggacaacgacctgagtggatgggatgggcgaaccctacacgtggtgtcacgagtgtcttcaccctatccgtccgggacagacttaccatcgaccacgactcctccataacacagcctanatggagttgaggcgcctgacatctgaccgacaccgggtcgtactattaaccngtcgcgtaacgacgtccccaggtacgtcccggtaggacggtccccttaaccgggccgtaacgggtcccgggttacccttttcggaacccgttttccggtaccgggggg

SEQ ID NO: 206711 - DNA, 711 bp, Homo sapiens
  misc_feature: GYAE6OF01DHVH2.17.25.C03.1.454.CMB.1.raw
  modified_base (220)..(220): a, c, t, g, unknown or other
  misc_feature (220)..(220): n is a, c, g, or t
tcagcgtagactagcacgaccggtgctcgatttagtagtgtagatttgggtttgggagtcagtctcagtcaggacacagcatggacatgagggtccccgctcagctcctggggctcctgctactctggctccgagctagccagatgtgacatccagatcgaccagtctcatccctccctgtctgcctctggtggggtcagagtcaccatcacttgccganaagtcacggacttaaactattaatggtatcagcaacgaaaccgtaggaaaaccgccccaagtaccctcctagacttccgtacgtggtcgtaccacgttacccacgttccgtacggtacggtaacggtccgggtccccttaccccgtaggttccggtaagggtttcccgtaagggttcggaccgttagggttacgggtaaccgttccggtaaggggaacctagggttaactttctaaaccttccgtacccaacctacctaccctaacccgtaccttaccgtacgtaccctaaccgtaacgggtacggttacgtttacgtacgtaacctaaccgttacttaaccttacgtactacctaacgtagtacgttaccgtaccgttaccccgtcgtaccgttacgtttacggaccggtaacgggtaactaaaggttcgaacgtaactaacgaaacgtacgtacggtacggactcggaacctactactcgttcgttacc

SEQ ID NO: 206712 - DNA, 989 bp, Homo sapiens
  misc_feature: GYAE6OF01BYFG5.17.25.C03.1.454.CMB.1.raw
  modified_base (144)..(144): a, c, t, g, unknown or other
  misc_feature (144)..(144): n is a, c, g, or t
tcagcgtagactagcacgaccggtgctcgatttagtagtgtagatttgggttggggactcaacaaccacatctgtcctctagagaaaaccctgtgagcacagctcctcaccatggactggacctggaggatcctcttcgttggnggcagcagctacaagtcgcccactcccgaggtgcagcgtggtgcgagtcgtggggctggaggtagaagacggccgtcgggggccttacgaggttaggaaacggttcctaccgtaggacgtaagggtcctttgtacgggtaacttccgtaaaccgttttacccgtaccttaagtaacggttaacttaaccgtaaaccggtttgggggtaccgccggtaccccgaagggtccccgtaccgttagggaaccctaaacccggtacctagggtaacggttacgggaaggttacggggaacgttcggggggaaaccccttaaaacccccggttaaacgtaacccggttggggttaaccgtaacccgtaaccgtaaagggtttcccgttacccgttacccgtaacccccggtaacggtttccccggtaaacccgggggttaaaccaaccgggttaaacccctttaaacccgaaaggtttaccccggaacccccgtaaacgggttaaaccccttaacccggttaaccccaaaagttaaaacccgtaaaccccgtaacggttaaccccgttaaacccgtaaagggtttacggggtaaaccgttttaagggaaacccgggtacgttacccccggttaaggtaaacccgttacgttaccggttaacggaaacccggacccggtaacccgggttaaccccgttacgtttaaacgttacccggttggtaaccggtaacggtaccgtaaacccggtaccccgaagggtttaacccggtccggggtaaccggtacggtacccgttaccgggaaccgtcgggtacccgttaccgtttacgtcggttaccggggtaccgggg

SEQ ID NO: 206713 - DNA, 653 bp, Homo sapiens
  misc_feature: GYAE6OF01DSWVV.17.25.C03.1.454.CMB.1.raw
  modified_base (287)..(287): a, c, t, g, unknown or other
  misc_feature (287)..(287): n is a, c, g, or t
  modified_base (356)..(356): a, c, t, g, unknown or other
  misc_feature (356)..(356): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagagccgtggggcctcgagtgaaggtctcctgcaaggtcttcgtggattcaccgtttacctctatagtatcaacgtgggtcncgccaggccgcgtggaccaacggcctggacggtggagtcgggatcgggaccgaaaccctagacgtggtntaccgacgtagtcgtaccttcaacccgtagttcccggtaccgggacacgtaaccttaaccacgtacgaaccctacgtaacctccctaaccaaactaaaccacgaaccgtaccctaacgtagtacgggtaacgttaggaagtacgtccttaagacgtactcgtaacgaaccgaccgaccggtccgttacttaattaccgtgtacgaccggtaagtcccgtaacccgacgtcgtccgggtaagccgacccgtacggccgtacggtccggttaccgttttcggccgttcgggtaccgggg

SEQ ID NO: 206714 - DNA, 711 bp, Homo sapiens
  misc_feature: GYAE6OF01AJ2FH.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagaagccgtggggcctcgagtgaaggtctcctgcgagcttctggacttcacgtttacctctagtagtatcaacgtgggtgccgccgacggccgcgtaggaccaacgaccgtggaggtggagtgggagtcgggaccgtaaaccctacgacggtggtcgtacgagtacgttcgtccttaccacccgtacgttcccgtaccgggtactaccggtaaccttaaccgacgtaccgaaccccgtaacgtaacccttaccccgtacctaaacgtaaaccaacccgtacgtaaccctacgtaacgtagggtaacgttcgggaacggtacgtcctaacgactacgtccgtacgaacccggaccgtaccgggtaccttaccgttaacgttaccgttcggtaccggtacggtaccggtacccggtcccgaaccggtacgttacccggggtaggacccggtacccgacgggccgtaccgggtaccggttaccgtttcgtaccggttcgggtacccgggg

SEQ ID NO: 206715 - DNA, 779 bp, Homo sapiens
  misc_feature: GYAE6OF01COSR8.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagagccgtggggcctcgagtgaaggtctccgtgacgaggcttcgtggattctaccgtttacctcctatagtatactaacgtgggtcgcgtccgacggcccgcgtcggaacaccgacctggacggtggagtgggacgtcgggaccgtaaacccgtaacgtacgtggtacgtcgaacgtacgttcgttaccgttaccaaccccgtacgtacccggtacccgggaacctaacgttaacccttaccgtacgtaccgaacccgtaacccgtaacccttcccgtaaaccctaaactaaaaacccgaaccgtaaccgtaccctaaaccgtaacggttacgggtaacggtttacgggaacgggtaaccgtcccgttaacggaacctaacgttaccgttaaccggaaacccggacccggtacccgggtaccgttaccttaacgtttaccgtggtacggaccggtacgtaccccggtacccgtaacggtaccggttcccggggtacgaacccgggtacccggtaaccggcccggtacgggtcccggtttaccgtttcggtacccggttcggggtaccccggggg

SEQ ID NO: 206716 - DNA, 788 bp, Homo sapiens
  misc_feature: GYAE6OF01C5WPO.17.25.C03.1.454.CMB.1.raw
  modified_base (264)..(264): a, c, t, g, unknown or other
  misc_feature (264)..(264): n is a, c, g, or t
tcagcgtagactagcacgaccggtgctcgatttagtagtgtagatttgggtttgggactcaacaaccacatctgtcctctagagaaaaccctgtgagcacagctcctcaccatggactggacctggaggatcctctttcgttggtggcagcagctacaagtcgccccactcccaggtcgcagcgtggtgcgagtcgtggggctaggagggtgaaagaacggtcccgtgggggccctacgtaaggtaggtaacggttccttccgnggacgaacgggtcctttacgtgggtaactttccgtaaccgttttaccctaccgttaagttaacgttactaccgtaaacgttggggtacgccgaccgacggcccgtcgtacggaaccacggtacctggacggtggacgtgggagtacgggaccctaaacccgtaacgtacggtggtacgtacctaacggtacgttcgttaccttacccgaccccgtacgtcccgttaccggggaactacccggtaaccttaccgaagttaccgaacccgtaaccgtacctaccctaacctaaactaaaccctacgaacgtacctaacgtaaggtaccggtagttaacggacggtacgacgttacgaacgtaccgttacgaccggaaccgtaacccgtaccggttaccgttactaacgtttcgtagtcggaacgtaccgacgtacccgagttacccggtcggtaacggtacccgaccggtacgacgtacccggggtaccgtttacccgttacggttccccggtgggtaccccgggg

SEQ ID NO: 206717 - DNA, 709 bp, Homo sapiens
  misc_feature: GYAE6OF01CHQRK.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtgggctggaggtgaagagccgtggggcctcgagtgaaggtcctccgtgacaaggtcttcgtggtattcgtacgtttacctcttatagtatactaacggtgggtacgccgccgaggcccgtcgtacgaaccgaacgacctggagtggagtcgggagtcggggaccgtaaacccctaacgacgttgggtacgtacgaacgtaggttcgtcccttaccaaccccgtacgtcccgtaccgggaactacggtaaccttaccgatccgaaccctaacgtaacctaccctaccaactaaaccaccacgaccctaagtaacgtgggtaacggttgaacgggtactaccgttacgaactaaccgtcgtacgggtaaccgacccggaaccggtacccgttacttacgttaaccggcggttacggaaccgtacggtacccgtccccgaacggtaccgtcccgggtagaccggtcccgtaacgggctaccggggtcccgttaccgtttacgtcggttccgggtaccggggg

SEQ ID NO: 206718 - DNA, 552 bp, Homo sapiens
  misc_feature: GYAE6OF01AZG1D.17.25.C03.1.454.CMB.1.raw
  modified_base (280)..(280): a, c, t, g, unknown or other
  misc_feature (280)..(280): n is a, c, g, or t
  modified_base (291)..(291): a, c, t, g, unknown or other
  misc_feature (291)..(291): n is a, c, g, or t
  modified_base (331)..(331): a, c, t, g, unknown or other
  misc_feature (331)..(331): n is a, c, g, or t
  modified_base (469)..(469): a, c, t, g, unknown or other
  misc_feature (469)..(469): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtncgccaggccgntggacaacgacctgagtggatgggatgggacaaccctaanactggtgtcacagtgtccttcaccctatccctccgggacagaccttaccatcgaccacgaacctcctccaataaaccacagcctacatgggattggagacgcctagacatcgtgacgacgacggtccgtactattacngtgcgagtacgtcccgaacgtctccgggtgacggtcccgtacgggccacggccggtaccctttgaccgtttcggtaccggggg

SEQ ID NO: 206719 - DNA, 773 bp, Homo sapiens
  misc_feature: GYAE6OF01D95FS.17.25.C03.1.454.CMB.1.raw
  modified_base (279)..(279): a, c, t, g, unknown or other
  misc_feature (279)..(279): n is a, c, g, or t
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctcgtggtgggggtcagagtcaccatcacttcgccgacaagtcacggtacttaaaactattaattggtatcagacagaaaccgtaggaaaacnccccagacctctgactctcgtggtcgcatcccacttgtcggacgaaggtcggcctccaagtcggtaggttcagggttcggcgtaggtggtacgttcggtaggggaactaggttacttttcaaacttcctaccgaacctataccctaacccgtacttcctacgaccctaaaccgtagggtaacggttagtttacggtcgtaacctaactttaccgttaacctttacgtaccgttaacctaaaccggtaagttaacccgtttaccgttaccccggtttacccccgttaccggttacctttacccgggttttccgggaaccccgggtaaacggggggttaaacccgttaaaagggttttacggggaaaacccgtttaaaccggttaaacccgtaaaaacccgggtttaaccgggttacggggtttaccccgggaaccgttacccgggaacccccttaaacccgtttaaccgttcccgtttaccgggttttaaccccc

SEQ ID NO: 206720 - DNA, 540 bp, Homo sapiens
  misc_feature: GYAE6OF01DAEJK.17.25.C03.1.454.CMB.1.raw
  modified_base (220)..(220): a, c, t, g, unknown or other
  misc_feature (220)..(220): n is a, c, g, or t
  modified_base (336)..(336): a, c, t, g, unknown or other
  misc_feature (336)..(336): n is a, c, g, or t
  modified_base (445)..(445): a, c, t, g, unknown or other
  misc_feature (445)..(445): n is a, c, g, or t
  modified_base (497)..(497): a, c, t, g, unknown or other
  misc_feature (497)..(497): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagaagcctggggcctnagtgaaggtctcctgcaaggcttctggattcacgttttacctcctatagtatcaacgtgggtgcgccaggccgcgtggacaacgcctgagtggatgggatgggaccgaaccctaanactggtgtcacagtgtcttcacccatccgtccgggacagtacttacatcgaccacgaacctccctaccaataaacacacgcctaacatgggagttggaggagcctgacntctgacgacgacggtctctattactgtgcgagacgtcccagacgttccgggngcgccgtacggcacggccggtcctttggcgtttcggtacgggg

SEQ ID NO: 206721 - DNA, 581 bp, Homo sapiens
  misc_feature: GYAE6OF01A9AGS.17.25.C03.1.454.CMB.1.raw
  modified_base (244)..(244): a, c, t, g, unknown or other
  misc_feature (244)..(244): n is a, c, g, or t
  modified_base (280)..(280): a, c, t, g, unknown or other
  misc_feature (280)..(280): n is a, c, g, or t
  modified_base (413)..(413): a, c, t, g, unknown or other
  misc_feature (413)..(413): n is a, c, g, or t
  modified_base (418)..(418): a, c, t, g, unknown or other
  misc_feature (418)..(418): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttcnggattcacgtttacctcctatagtatcaactgggtncgccaggccgctggacaacgacctggagtggatgggatggggaccaaccctaacgacgtggtcgtcacgagtgtcttcacccatccgtccgggacacgacttaccatcgaccacgaactccctaccataaacncgacncctaacagtaggagttaggaggacgcctagacagtcgagaccgacaccgggtccttactattacctggtcgcgtagtaccgtaccccacggtacgtcccgggtagacgtccgtaccgggacctacgggcccggtaccgtttggaccgtttcgggtaccggggg

SEQ ID NO: 206722 - DNA, 682 bp, Homo sapiens
  misc_feature: GYAE6OF01BTKOV.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaggcttctggattcacgtttacctcctatagtatcaacgtgggtgcgccaggccgctggacaacgacctggagtggatgggatgggaccgtaaaccctaacacgtggtgtacacgtagttcgtccttccacccgtatcccgtccggggaactacgtaaccttaccatcgaaccctaacgtaacctcccctaacctaactaaaccaccgtacgaccctaacgagtacgggtaagtttacggaacgggtacgtcccgtagaacctacgttcgtaccgaaccggaaccgaccgggtacccgtttacttaacgttaccgtacggtacggaccggtaaggtacccgtaccccgaacggtaccgttcccgggaggtacccggtacccgtaccgggccggtaacgggtcccggtttacccgttttaggtaccccgtttcggggtaacccgggggg

SEQ ID NO: 206723 - DNA, 581 bp, Homo sapiens
  misc_feature: GYAE6OF01CP11F.17.25.C03.1.454.CMB.1.raw
  modified_base (471)..(471): a, c, t, g, unknown or other
  misc_feature (471)..(471): n is a, c, g, or t
  modified_base (532)..(532): a, c, t, g, unknown or other
  misc_feature (532)..(532): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgccccactcccaggtgcagctggtgcagtcgtggggctgaggtgaagaagccgtggggcctcgagtgaaggtctccgtgcaaggcttcgtggattcacgtttacctcctatagtatcgtaactgggtcgcgccgaggcccgcgtggacacgaccgtgagtggatgggatggggacgaacccgtaacgacgtggtgtcacgagtcgtccttcaccccgtatcccgtaccgggacacgacttaccagtcgaccacgaacctcctaccataaaccacagacctacgatggagttgaggcgcctagacagtacgngacgacgaccggccgttactacttacgtgtagcgaagcgtacccacgtacgtcccgggtanccggaccgtacgggcacggtccgtacctttcggcgttcgggtaccgggg

SEQ ID NO: 206724 - DNA, 586 bp, Homo sapiens
  misc_feature: GYAE6OF01C7EQC.17.25.C03.1.454.CMB.1.raw
  modified_base (291)..(291): a, c, t, g, unknown or other
  misc_feature (291)..(291): n is a, c, g, or t
  modified_base (416)..(416): a, c, t, g, unknown or other
  misc_feature (416)..(416): n is a, c, g, or t
  modified_base (426)..(426): a, c, t, g, unknown or other
  misc_feature (426)..(426): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagctggggcctcagtgaaggtctcctgcaaggcttctggattcacgtttacctcctatagtatcaacgtgggtgcgccaggccgntcggaacacgacctgacggtggatgggatgggaccgaaccctaacacgtggtcgtcacgagttcgtcttcgacccctatcctacgacggacagacttacatacgacacgactcctacaataaacncacgcctaanacgtggtagtggagacgcctgacatcgtagaacgaccgtaccggaccttactacgttacgtggtacggacgacgtacccgtacccgtacggtacgtccgggtgaaccgtcccggtacggcgtaaccgggccggttaccctttggtcccggtttaccgggg

SEQ ID NO: 206725 - DNA, 678 bp, Homo sapiens
  misc_feature: GYAE6OF01BYBUS.17.25.C03.1.454.CMB.1.raw
  modified_base (297)..(297): a, c, t, g, unknown or other
  misc_feature (297)..(297): n is a, c, g, or t
  modified_base (440)..(440): a, c, t, g, unknown or other
  misc_feature (440)..(440): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagaagcctggggcctcagtgaaggtctcctgcaaggcttcgtggattctacgtttacctcctatagtatcaacgtgggtcgcgccgaggccgntacggacaacgccgtgacggtggatggggatggggacctaaccctaacgacgtggtgtcaacgagtcgtccttacacccctactcccgtccgggaacacgtaccttaccgatcgaaccgaccgtaactccctacaactaaacncaacgtcctaacagtacgggagttagaacggtacgtccctaggaacctacgttcgaaccggaacccggaacgtacccgggtacccttccgttaaaccgtttacgtaggttccggaaggtacgtaacccggtaccccgaaccggtaccggttaccgggacggtaacccggccccgttacgggacggtaccggtccccgggttaccgtttaccggaccgttttcccggggtaccgggggg

SEQ ID NO: 206726 - DNA, 690 bp, Homo sapiens
  misc_feature: GYAE6OF01BIOM9.17.25.C03.1.454.CMB.1.raw
  modified_base (245)..(245): a, c, t, g, unknown or other
  misc_feature (245)..(245): n is a, c, g, or t
  modified_base (281)..(281): a, c, t, g, unknown or other
  misc_feature (281)..(281): n is a, c, g, or t
  modified_base (291)..(291): a, c, t, g, unknown or other
  misc_feature (291)..(291): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagaagccgtggggcctcagtgaggtctcctgcaaggcttcnggattcacgtttacctcctatagtatcaactgggtncgcaggccgntggacacgcctgagtggagtgggatcgggacctaaccctaagcgtggtcgtacactagtcgtcctccacccactcccgtccgggactacgtacttaccgagttacgacccgtaaccgtaaccttcccgtacctaacttaaaccgaccacggtacccttaacgagttacggggaagtttgggaacggtacgtcccgttaggacccttagtaccgttacgaaccggtacgtaacccgggtccgttacgttaacgtttacgtaggttccggaccggtaacggtaccggttacccccgaacgggtccgttacccggggttacgaacccggtccccggtaacgggacccgtaaccgggtccccggttaccgttttcggtacccgtttccggggtaacccggggg

SEQ ID NO: 206727 - DNA, 772 bp, Homo sapiens
  misc_feature: GYAE6OF01DV2Q2.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagaagccgtggggcctcagtgaggtctccgtgcgaaggtcttcgtggtacttctaccgtttacctccttatagtactcaacgtgggtcgccgccgacggccgcgtcggaaccaaccgaccgtggaggtggagtgggagtcggggaccgaaaccctaacgacgtggtacgtcgacgtagtcgtcttacccaacccgtacgtcccgtacggggactacggtaacctttaccgacgttaccgaacccgtaccgtaaccccttaccctaacccgaaaataaacccgaacgtaacccgtaacccttaacgtaacggttacggggttaacggtttacgggaacgggtaaccgtcccggtaaacggtaaccgtacgttaccccggtaagggaaaccccgtaacccgggtacccggggttaccctttaccgttaaacgtttaccgtggttaccgggacgtaacggtacccgtacccgtaaccggtccggttacccggggtagtacccggacccggtaccggacgtaccgggtcccgggtttaccgtttcggtacccggttccgggtacccgggggg

SEQ ID NO: 206728 - DNA, 641 bp, Homo sapiens
  misc_feature: GYAE6OF01E4RJ5.17.25.C03.1.454.CMB.1.raw
  modified_base (242)..(242): a, c, t, g, unknown or other
  misc_feature (242)..(242): n is a, c, g, or t
  modified_base (256)..(256): a, c, t, g, unknown or other
  misc_feature (256)..(256): n is a, c, g, or t
  modified_base (276)..(276): a, c, t, g, unknown or other
  misc_feature (276)..(276): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagagcctggggcctcagtgaggtctcctgcaggcttcngattcacgtttccnctatagtatcaacgtgggtncgctaggccgcgtaggacaacgacctgaggtggagtgggatcgggaccaaccctacgacgtggtgtcacgagtcgtcttacaccctatcccgtcggacacgtacttaccgatcgaaccacgaacctcctacaactaaacacacgtacctactagtacggtagttcgaaggacgccgtagaactagtcgtacggaaccgacgacccgggtccttaccgttaagtttacgtggttacggaccgggtaccggggttaccccgaacgggttaacccggttcccgggtagacccggcccggttaaccgggccgtaaccggggtcccggttacccgttttaccggtctttcccgggtgggggtaccccggg

SEQ ID NO: 206729 - DNA, 853 bp, Homo sapiens
  misc_feature: GYAE6OF01B8Y9F.17.25.C03.1.454.CMB.1.raw
  modified_base (175)..(175): a, c, t, g, unknown or other
  misc_feature (175)..(175): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactccaggtncagctggtgcagtcgtggggctggaggtgaaggacgccgtggggcctgagtggtaacggttcctccgtggacgtaagggtctttcgtaggtactttcgtaccgttttacctaccttaatacgttataccgtaacggttcgggtcgccggacccggagggtccccgtacggtacggaaaccgtaaccggaccgttagggacggttagggtaacggtggggtaacgttaccggggaacccgttaaaccccgtaacgtaaccggtttcgggtacgtaccgtaacgtacggtttcggttacccttaacccgaaccccgtaccggttaccccggtaccggggtaaaccgtacggttaaaccctttaaccgtaacggtaccggtaaaccccctaaaccggtaaccccctttaccctaaaccctaaaacgttaaaacccaacccgtaaaccgttaccctaaacgttaaggtccgggtaaggtttacggaacgggttaccgtaccgtaacgtaacctaccgttacgtacggaacccgtaaccggtacccggtaccgttacttacgttaaccggtgtacggtaccgaacggtaccgtacccggacgttaccggtacgggacgtaccgtacccggacggaccgtcgggtacccggtttacgttacggtccggtttcgggacccggggg

SEQ ID NO: 206730 - DNA, 711 bp, Homo sapiens
  misc_feature: GYAE6OF01CWBNB.17.25.C03.1.454.CMB.1.raw
  modified_base (559)..(559): a, c, t, g, unknown or other
  misc_feature (559)..(559): n is a, c, g, or t
  modified_base (613)..(613): a, c, t, g, unknown or other
  misc_feature (613)..(613): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggactcctcttcgttggtggcagcagctacagtcgcccactcccgaggtgcagcgtggtgcagtcgtgggctggaggtgaagacgccgtggggcctacgagtagaaggtcctccgtgacgaaggtcttcgtaggtacttccgtaaccgttttacctaccttaattagttactacgtaacgttggggtcgccgaccgacgggtacccgtacggtacggaaccgtaaccggtaccgtaggacggtagggacgttaggggaacgttccggggaacccgtaaacccgtaacgtacggtggttacgacgtacgtaagttcgttccttacccgaccgtacgttcccggtaccggactacgtacctacgactacgaccacgtactacctaccaaactaccacgacgtacctaagtagtagggtacgtcggaagtaccncgtaacatcgtacgtaacggaaccgacgtaccggttacctacgtatttaccggngacggtaccgagtacccgttaccgacgttaccggtcgtacggccgtaccggaccggcgtacccgggtcgttacgttccggtacggtcggtaaccgggg

SEQ ID NO: 206731 - DNA, 723 bp, Homo sapiens
  misc_feature: GYAE6OF01B5AUF.17.25.C03.1.454.CMB.1.raw
  modified_base (532)..(532): a, c, t, g, unknown or other
  misc_feature (532)..(532): n is a, c, g, or t
tcagcgtagactagcacgaccggtgctcgatttagtagtgtagatttgggtttggggactcaaacgaaccaacatcctgtcctctagacgaaaaccctgtgagcacagcctccctcaccatggactggacctggaggtatccgtcttcttggtgcagcagctacagtcgcccactcccaggtgcagcgtggtgcgagtcgtggggctggaggtagaagacggtccgtggggcctcgaaggtgtaacggtcctccgtgacgaggtcttcgtggtactttcgttacgttttaccctaccgtaattaggttactacgtaacgtgggtcgccggccgtagggccgtacgtcggaactaacggaccgtggacgtgggtagtcgggtaacgtcgggaacccgtaaacccgtaagaccgttgggtacgtacgaacgtaggtcgtcttaccgaccctacgttacccgtacggtactacggtaacttccgagtaccgtaccgaacttacctaccctacgaaactaaccagaccgaccttanacggtaggtacgttaggacggtatccgtagacttagtaccgtaggaacccgtacgaccggttctacgttagtcccgaggtcgtaccggtaacggtacctacccggaaggtccgttcccgggtaagtcccgggtaccgtaccggcgtaacccggtccgttaacgttccggttaaccggttcgggtaccgggg

SEQ ID NO: 206732 - DNA, 754 bp, Homo sapiens
  misc_feature: GYAE6OF01E3Y3H.17.25.C03.1.454.CMB.1.raw
  modified_base (304)..(304): a, c, t, g, unknown or other
  misc_feature (304)..(304): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagaagccgtggggcctcagtgaaggtctccgtgcgaggcttcgtggtacttcacgtttacctccttatagtatacaagtgggtcgccgccgacggcccgngtcggaaccaacgtaccgtggaggtaggagtaggggagtcgggacctaaacccgtaacgtacgttgggtcgtacacgtaggttcgttccttacccaacccgtacgttcccggtacccggggtaccaaccggttaacccttaaccgacgtaccgaacccctaaccggtaacccttccccgtaaccgtaaaactaaaccaaccaccggtacccttaaacgtacgttacggggtagttacgggaagggtaccgtaccgtagaacctagtccgtacgggaaccgaccgtacccgggtacttacgttactttaaccgtgggtacgaccggtacggtacccgtaccccgtaaccggtcggttacccggtgggacccgttacccggtaaccgggacccggtacgggttcccccggtttaccggtttttcggtccccggttcggggtacccggggggg

SEQ ID NO: 206733 - DNA, 617 bp, Homo sapiens
  misc_feature: GYAE6OF01AZBSN.17.25.C03.1.454.CMB.1.raw
  modified_base (241)..(241): a, c, t, g, unknown or other
  misc_feature (241)..(241): n is a, c, g, or t
  modified_base (341)..(341): a, c, t, g, unknown or other
  misc_feature (341)..(341): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctgggcctcagtgaagtctcctgcaggcttcnggattctacgtttacctcctatagtatcaacgtgggtcgcgccacggccgctgggaaccaacggacctggacgtggagtcgggatcgggacaaccctaanacgtggtcgtacacagttgtccttccacccagtccgcgggacacgacttaccatcgaaccacgtaacctccctacaactaaacacacgacctagacgtggtaagtgacggtacgcctagactacgttcgacggtaacccgaccgtaccggtccgttactaacgttacgtaggtcggacgtacggaccgtacccgaacggtacgtacccgggtgaacccggtccgtacggaccgtacgggtcccgttacgtttacggtaccgttcggtacccggggg

SEQ ID NO: 206734 - DNA, 933 bp, Homo sapiens
  misc_feature: GYAE6OF01CYHVA.17.25.C03.1.454.CMB.1.raw
  modified_base (164)..(164): a, c, t, g, unknown or other
  misc_feature (164)..(164): n is a, c, g, or t
  modified_base (171)..(171): a, c, t, g, unknown or other
  misc_feature (171)..(171): n is a, c, g, or t
  modified_base (174)..(174): a, c, t, g, unknown or other
  misc_feature (174)..(174): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtaccncctaccncgnggcgacgcgtcggtggtcgacgtcgttcggggtcgggtgtagggtagggaacggaaacggaccggtccggggtccgggtacctaggtaggtaagggtaccgttccgttcgacgaacgggtacgttccgttggtacgttacttaacccgtttaacctttacccttaacttaagtttaacgtacctaaccgtacgggtggtaccgaccgaccgggacccggccgttagggaacccgaaaccgtacccggtaggtaggtagggtaggttaagggcgggttagggacccgggtaaacccctaaaaccaggttacggtgggtacctaccgtaaggttgttacccgttcccctaacccgaccgttacccggtaccccggggtaaccggaacgttaacctttaacccgtacctacggaaccccgtaaacccgtaacccgttaacccccttccccaaaacgttaaaaccctaaaccccgaaccggttacctaacccgttaaagtcgggtaagggtttaacggtaacggggaaccggtaccctaccggtaactaacccgtttacgtacggtaaccggaaacccgtacccggttcccgggttaccttacgtttaacgttacggttgggaaccggaccgtaaccggtaccccgtaccggtaccggttaccgggtaccggtaccgggtaccccggtaaccgggtaccgaccgggttacccggttacccggttttccggtttacggttcccgggtttccgggggaacccggg

SEQ ID NO: 206735 - DNA, 782 bp, Homo sapiens
  misc_feature: GYAE6OF01BWRID.17.25.C03.1.454.CMB.1.raw
  modified_base (228)..(228): a, c, t, g, unknown or other
  misc_feature (228)..(228): n is a, c, g, or t
tcagcgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatcgacccagtctccatccctccctgtctgcctcgtggtgggggtcagacgtcaccatcacgttcgccggaanaacgtcaacggtactttaaaactatttaaattggtatacagacaaagaaaccgtaggaaaccgcccaagaccctccgtagactcgtacgtggtcgactacgtcctacgtctacggacgtaaacggtcggtacccgtacctaaggttcggtaacggtttacgaggttccgggagtaacggttcggtaacgttcggtaaggggaacctaaaggttacctttaacgtaaacttccgtaaccctaaccggtaactcccgtaacctaccgttccgtaacgtaccgtaaccgttaggtaaccggtttaattcgttaacgtaaccttacgtttacgtaacccttaacgttacgaacccgtaaagtacggttaacgtttacccgtaacccgtttcccccgttaggttaacccttttacggtttaccggaaccggttaacggggtaaaccgttaaacggtttagaaacgttaacccggtaaacgtaaacccggttacggtaccgggttacggtaaccttacgggacccctaaaccgttacctttccggttaccggtttacccc

SEQ ID NO: 206736 - DNA, 617 bp, Homo sapiens
  misc_feature: GYAE6OF01A73GS.17.25.C03.1.454.CMB.1.raw
  modified_base (180)..(180): a, c, t, g, unknown or other
  misc_feature (180)..(180): n is a, c, g, or t
  modified_base (282)..(282): a, c, t, g, unknown or other
  misc_feature (282)..(282): n is a, c, g, or t
  modified_base (481)..(481): a, c, t, g, unknown or other
  misc_feature (481)..(481): n is a, c, g, or t
tcagcgtagactagcacgaccggtgctcgatttagtagtgtagatttgggtttggggactcaacaaccacatctgtcctctagagaaaacctgtgagcacagctcctcaccatggactggacctggaggatctcttcttggtggcagcagctacaagtgcccactccaggtgcagctggngcagtctggggctgaggtgaagagccgtggggcctcgaggtagaaggtctcctgcaaggtcttctggattcacgtttacctctatagtattcgaatggtgcnccaggccgctggactaaccgctagacgtggagtgggagtcgggaccaaccgtaacgagttcgggtcgtacaacgtacgtcgttaccttaccacccctagtcccgtaccgggatacggtaccttacacgttacgacccacgaaccttcctaacaactaaactacaacgtacctactagtacggtaggttacgacggtacnccgtacacgaacttcgacgaccgtaccgaccggtacgtacttacgtaccgttgtacgacgtaacgtcgtacctacgacgttacgtcggacgtccgacgtacgacggtacggttactcggttcgtccggttaccggg

SEQ ID NO: 206737 - DNA, 832 bp, Homo sapiens
  misc_feature: GYAE6OF01EBYIU.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgccccactcccgaggtgcagcgtggtgcagtcgtgggctggaggtagaagacgccgtggggcctcgaggtgaacggtctaccgtgacaaggtctttcgtggtactttccgtaccgttttacccctaccgttaagtacgttaacttacgtaacggtcggggtcgccggacccgtacgggcccgacgttacggaacccgaaccggtacccgtaggtagggtagggaggttcgggggtaacggtaccgggaaacccggttaaaccccgtaaacggttaccggttacgggacgttaaccgaacggttaggtttccttacccgttaccccgacccctacggttccccggtacccgggtaactaaccggttaacctaccggtaacgtaccgaacccgtaaccgtaaccctaccctaaccgaaactaaacccaacgtaccgtaaccctaagtacggttacggtaacggtcggaacggccgtaccgtacgacctactaccggacgaacccgtaccggaccgttaccgttacttacgttaccggttagtcggtaacgaccggttaccccgtaccgaccgggttccggtaccggtcggtaccggtacccgtaccggacccggttaccggttacccgggttaccgttttacgggtacccggtttccggggtaaacccggggg

SEQ ID NO: 206738 - DNA, 774 bp, Homo sapiens
  misc_feature: GYAE6OF01C6JLY.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagttcgcccacctcccaggtgcagctggtgcagtcgtggggctgaggtgaagagccgtggggcctcgagtgaacggtctcctgacgaaggtcttcgtggtactttctaccgtttaccctcctaattacgtatcaacgttgggtgccgccaggccgcgtcggaacgaccgaccgtgaggtggagtggggatcggggaccgtaaccccgtaacgacgtggtactcgaaccgtagttcggttcctttaccaaccccgtactaccccggtaccgggacctaaacggtaccctttaaccgactaccggaaccaacccggtaaccctaccccttaaccaaaccgtaaaacccaaccgtacgtaaccccttaaacgtaggttacgggtaacggtttacggaacgggtaccgtacccgtagaacccttagtacccgttaggaaaccccggtacgtaacccgggttcccgttaccttaagtttaacccgtggtaccggtacggtaaccggtacccggtacccaaccggtcggttacccgggtaggtaccccggacccggttaaccgggaccgtaccgggtcccggttacctttttaccgggaccgttttcccggggacccgggggg

SEQ ID NO: 206739 - DNA, 658 bp, Homo sapiens
  misc_feature: GYAE6OF01EGL3S.17.25.C03.1.454.CMB.1.raw
  modified_base (132)..(132): a, c, t, g, unknown or other
  misc_feature (132)..(132): n is a, c, g, or t
  modified_base (156)..(156): a, c, t, g, unknown or other
  misc_feature (156)..(156): n is a, c, g, or t
  modified_base (161)..(161): a, c, t, g, unknown or other
  misc_feature (161)..(161): n is a, c, g, or t
  modified_base (170)..(170): a, c, t, g, unknown or other
  misc_feature (170)..(170): n is a, c, g, or t
  modified_base (174)..(174): a, c, t, g, unknown or other
  misc_feature (174)..(174): n is a, c, g, or t
  modified_base (177)..(177): a, c, t, g, unknown or other
  misc_feature (177)..(177): n is a, c, g, or t
  modified_base (185)..(185): a, c, t, g, unknown or other
  misc_feature (185)..(185): n is a, c, g, or t
  modified_base (194)..(194): a, c, t, g, unknown or other
  misc_feature (194)..(194): n is a, c, g, or t
  modified_base (228)..(228): a, c, t, g, unknown or other
  misc_feature (228)..(228): n is a, c, g, or t
tcagcgtagactagcacgaccggtgctcgatttagtagtgtagatttgggtttggggactcaacaaccacatctgtcctctagagaaaccctgtgagcacagctccctcaccagtggacctggacctggagntcctcttctggtgcagcagcctanagtcnccactccgnggtncgngtcgtgtncgtgtcggnggctaggaggtacgagtacggtcgtcggacgtgnggtcgacgttcacgtcgacgtagtcgtagtgtacttccgtaccgttctcggttattagacctagaaccggtggcaccgtacggacgtcgacgtacggtaacgcgtaccgtggtacggtgtaaccgggcggtacggtacggtaaccgtacgtacgtacgtacgtacgtacgtacgttcgtcgttactacgtaccgtacgtacgtacggtacgtaccgtaccgtaccgtaccgtaccgtaccgtaccgtaccgtaccctacctaactaacgtacgtaacgtacgtacgtacgtacgtacgtacgtacgcgtacgacgtacgtacgtacgtacgtacgtaccgtcgtacgtactcgtacgtcgtacgacggtacgtacgtacgtccgtcgtagtcgtcgtaccgtacgacgtcgacgtacgtcgtcgtggtcg

SEQ ID NO: 206740 - DNA, 606 bp, Homo sapiens
  misc_feature: GYAE6OF01C068Y.17.25.C03.1.454.CMB.1.raw
  modified_base (342)..(342): a, c, t, g, unknown or other
  misc_feature (342)..(342): n is a, c, g, or t
  modified_base (455)..(455): a, c, t, g, unknown or other
  misc_feature (455)..(455): n is a, c, g, or t
tcagcgtagactagcacgaccggtgctcgatttagtagtgtagatttgggtttgggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagaagcctgggggcctcagtgaaggtctcctgcaaggcttctggattctacgtttacctcctatagtatcaacgtgggtcgcgccaggccgcgtggacacgacctggagtggagtgggatgggaccgaaccctaacncgtggtgtcacgagtgtcttcacccactcccgtccgggacagtaccttacagtcgaccaacgtaacctcctacctaataaaccacacgacctaacagtggtacgttgacgganccgtacgactatctagaccgaccgaccgggtcctacttagtttaccgtgtcgacggacgtacgtccccgacggtaccgttccgggtacggacggtacccgtacgggactacggcccggttccttttacggccgtttcgggtacccgggggg

SEQ ID NO: 206741 - DNA, 659 bp, Homo sapiens
  misc_feature: GYAE6OF01CARN1.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagagcctggggcctcgagtgaaggtctcctgcaggtctctggattcacgtttacctctatagtataccaacgtgggtgccgccgacgggccgtcgtcggaaccaaccggtacctaggaggtaggagtcggggagttcgggaaccgaaacccctaatacgtggtacgtcaacgtagttcgttccttccaaccctgtcccgtaccgggaactacgtaccttaaccgattaccgaacccgaaccgtacctccctaccaactaaaccacgacgtacctaactagtacggagttacggagtacgccgtagtacatacgtcgaccgaccgacggtccgttacttagttaccgtcgtggaccggtacgtaccgtaccccgtaaccgtacggttacccgggtagaccggcccgttaacggcgtaacggcccgttccgtttacgtccggttcggtcccggggg

SEQ ID NO: 206742 - DNA, 711 bp, Homo sapiens
  misc_feature: GYAE6OF01A82UB.17.25.C03.1.454.CMB.1.raw
  modified_base (303)..(303): a, c, t, g, unknown or other
  misc_feature (303)..(303): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctgggctgaggtgaagagccgtgggcctcagtgaacggtctccgtgcaaggtcttcgtggtattcctaccgttttacctccttagtatactcaacgtgggtgccgccgaggccgngtcggaaccaacggcctgagtggagtgggagtacgggaccgtaaccctaacgcgttagggtctacgacgtaggttcgttaccgtaccaccctacgttcccgtaccgggactaacgtaccttaaccgagtaccgaaccctaaccgtaacccgttccctaaccaacgttaaaacccgacccgtaacgtacccttaacgacggtttacgggtaagttacgggtacgggaaccgtacctaaggacctacgttacccgtaggaacccggacccggtaaccggtcccgttaagtttaaccgttacgtccggttacgacggtacgtaccggtacccacggtacgttcccgggacgtccgacctaccgggaccgtacggtcccgggttactttcgtaccgtttccgggaaccgggg

SEQ ID NO: 206743 - DNA, 637 bp, Homo sapiens
  misc_feature: GYAE6OF01B4PA4.17.25.C03.1.454.CMB.1.raw
  modified_base (249)..(249): a, c, t, g, unknown or other
  misc_feature (249)..(249): n is a, c, g, or t
  modified_base (286)..(286): a, c, t, g, unknown or other
  misc_feature (286)..(286): n is a, c, g, or t
  modified_base (346)..(346): a, c, t, g, unknown or other
  misc_feature (346)..(346): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagccgtggggcctcgagtgaaggtctcctgcaaggcttcgnggattcacgtttacctctatagtatcaacgtgggtcncgccaggccgcgtggaacacgacctgagtggagtgggagtcgggaccgtaaacccgtaanacgtggtgtacacgaggttcgtcttaccaccccgagttcccgtaccggggacaacgtaccttaccagtcgaaccaaccgtaacctccctaccaactaaacacacgacctacgagtaggtagttagaggacgtcccgtagactacgtcgtacggaaccgaacccgtaccgggtacccgttacttaacgttaccgtagtcggacgtaggaccgtaccccgagtacgtcccggtaggaccgtacccgtacggcgtaacggtccggtacctttcggtccggttcggtaccggggg

SEQ ID NO: 206744 - DNA, 754 bp, Homo sapiens
  misc_feature: GYAE6OF01DHQ15.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttctggtggcagcagctacaagtcgcccactcccaggtgcagctggtgcagtcgtggggctggaggtgaagacgccgtgggctgagtgaggtctcgtgacgtagtcttcgtaggtactttccgtaaccgttttaccaccgtaattacggttaactaccgaacggttggggtcgacccggccgtaacggggccccgtacgtacggaacctaaccggtaccttgggaacggtagggaacttgggggaacgtacggggacctaaaaccccgtagtacggtggtcgtaacgacgtacgggtttctaacccgttccaaacccgtccggtacccggtaccgggactacggtaacccttaacgagtaccccggaaccaccgttaactaccccgtaccgtaaaactaaacccggcctaaacggtccctaaagaggttacggtaggtacgggacgtaaccgtctaggaactcgtacgtacgaaccgtacggtccgggtcttactacgttagcggacggtacgtaccggacggtaccctaagggtccgtaaccgggtcgtccgacccgtagggaccggaaccgggttcccggtttaacggttcgtacccgggtttccgggaccggggg

SEQ ID NO: 206745 - DNA, 579 bp, Homo sapiens
  misc_feature: GYAE6OF01CWPYK.17.25.C03.1.454.CMB.1.raw
  modified_base (285)..(285): a, c, t, g, unknown or other
  misc_feature (285)..(285): n is a, c, g, or t
  modified_base (295)..(295): a, c, t, g, unknown or other
  misc_feature (295)..(295): n is a, c, g, or t
  modified_base (477)..(477): a, c, t, g, unknown or other
  misc_feature (477)..(477): n is a, c, g, or t
  modified_base (530)..(530): a, c, t, g, unknown or other
  misc_feature (530)..(530): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctggaggtgaagaagcctggggccttcgagtgaaggtctacctgcaaggcttcgtggattcacgtttacctcctatagtatcaacgtggtncgcaggccgntggacaacgacctgagtggatggggatcggggaccgaaaccctaacgcgtggtatcgaaccgtagtcgtccttaccaccctagtcccgtcccgggacaacggtaccttaccatacgacctaacgaacctccgtaccaataaaccacacgacctacatggagttgaggtagccgtgacatcgngacgacacggcctctacgttactgtcgacgacgtacgtcccacgacgtccggngtacgcccgtacggcgtacggcggttcctttacgcgtttggtaccgggg

SEQ ID NO: 206746 - DNA, 723 bp, Homo sapiens
  misc_feature: GYAE6OF01DY2E2.17.25.C03.1.454.CMB.1.raw
  modified_base (246)..(246): a, c, t, g, unknown or other
  misc_feature (246)..(246): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagaagccgtggggcctcgagtgaaggtctcctgcaaggcttnggattcacgtttacctcctatagtatcaacgtgggtgcgccagggccgctggacaacggacctggaggtggagtgggagtcgggaccgaaccctaacacgtggtgtcacgtagttcgttccttaccaccctacgtcccgtaccggggaacctaacggtaccctttaacccgaagttaccgaacccgtaaccgtaaacccttaccccctaaccctaaacgttaaaacccaaccctaacggtaccccttaaacgaacgttacggggaacggtttaggaacgggtacgcccgttacgaacgtacgtaccgtacgggaaccgaaccggtacccgggtacccgtttaccttaacgtttaccgtgggtaccgacggtaacgtaccgttaccccgaaccggtacgttcccgggtaggtacccggcccgtaaccggccgtaccgggcccgggttcccgttttacgccgtttccgggtaccggggg

SEQ ID NO: 206747 - DNA, 615 bp, Homo sapiens
  misc_feature: GYAE6OF01BEAB1.17.25.C03.1.454.CMB.1.raw
  modified_base (431)..(431): a, c, t, g, unknown or other
  misc_feature (431)..(431): n is a, c, g, or t
  modified_base (438)..(438): a, c, t, g, unknown or other
  misc_feature (438)..(438): n is a, c, g, or t
  modified_base (458)..(458): a, c, t, g, unknown or other
  misc_feature (458)..(458): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggtcttctggattcacgttttacctcctatagtatcaacgtggtgcgccaggccgctaggaccacgacctggagtggatgggatcgggaccaacccgtaacacgtggtgtccacgtagtgtccttccaccctactccgtccgggacagtacctaccagtcgaacccacgtacctcctaccaactaaaccacacnccctaanacgtggtagttcggaggtanccgtgactactcgtgaccgacgaccgggtccgttactacgtttacgtcggtcgacggacgtaccgtaccccaacggtcgttaccgggtacgtacccggacccgtaccgggcgtacgggtaccggttccgtttacggtacgtttccgggacccggggg

SEQ ID NO: 206748 - DNA, 572 bp, Homo sapiens
  misc_feature: GYAE6OF01BCL23.17.25.C03.1.454.CMB.1.raw
  modified_base (277)..(277): a, c, t, g, unknown or other
  misc_feature (277)..(277): n is a, c, g, or t
  modified_base (417)..(417): a, c, t, g, unknown or other
  misc_feature (417)..(417): n is a, c, g, or t
tcagcgtagactagcacgaccggtgctcgatttagtagtgtagatttgggtttgggggagtcagtctcagtcaggacacagcatggacatgagggtccccgctcagctcctggggctcctgctactctggctccgagctgccagatgtgacatccagatgacccagtctccatcctccctgtctgcctctggtgggggtcagagtcaccatcacttgccggacaagtcacggacttaaaacctatttaaattggtatcagcagaaacctggaaaacncccagacctctgatctctggtgcatccactctgcgagtcggccgtcccatcgaggttcaggtcggcgaggtggactcgtgggaactagtactttcaattctacaccatccacctactctcgaccaacgtgagtattgtanactaactctactactgtacaactacgtaagttaccacgttcccctcgtacttacgtttcggacccgtaagggtaaccctaaaggttacgaacgtaactaaccgaaacggtacgttcggtacggtacctacgaccctacctacttccgttgttacc

SEQ ID NO: 206749 - DNA, 599 bp, Homo sapiens
  misc_feature: GYAE6OF01E37N4.17.25.C03.1.454.CMB.1.raw
  modified_base (260)..(260): a, c, t, g, unknown or other
  misc_feature (260)..(260): n is a, c, g, or t
  modified_base (281)..(281): a, c, t, g, unknown or other
  misc_feature (281)..(281): n is a, c, g, or t
  modified_base (345)..(345): a, c, t, g, unknown or other
  misc_feature (345)..(345): n is a, c, g, or t
  modified_base (413)..(413): a, c, t, g, unknown or other
  misc_feature (413)..(413): n is a, c, g, or t
  modified_base (423)..(423): a, c, t, g, unknown or other
  misc_feature (423)..(423): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagagcctggggcctcagtgaaggtctcctgcaaggcttctggtattcacgtttaccncctatagtatcaacgtgggtncgccaggccgcgtggacaacgcctgagtggagtgggatcgggcaacctacacgtggtgtcacgngtcgtctcaccctagtccgtcgggactacgtacttaccatcgaccacgacctcctaccgaataaaccncaagccctanagtggtagttgacggtacgcctaggacctgtctaggaacccgtaccgaccggggtccttacgttaattacgttgtcgcggtaacgtacccgtacccacggtacgtccccggtagacccggacccgttacgggcctacgggtcccggttcctttcggtccggttcgggtaccggggg

SEQ ID NO: 206750 - DNA, 680 bp, Homo sapiens
  misc_feature: GYAE6OF01CLCLQ.17.25.C03.1.454.CMB.1.raw
  modified_base (236)..(236): a, c, t, g, unknown or other
  misc_feature (236)..(236): n is a, c, g, or t
  modified_base (244)..(244): a, c, t, g, unknown or other
  misc_feature (244)..(244): n is a, c, g, or t
  modified_base (247)..(247): a, c, t, g, unknown or other
  misc_feature (247)..(247): n is a, c, g, or t
  modified_base (259)..(259): a, c, t, g, unknown or other
  misc_feature (259)..(259): n is a, c, g, or t
  modified_base (314)..(314): a, c, t, g, unknown or other
  misc_feature (314)..(314): n is a, c, g, or t
tcagcgtagactagcacgaccggtgctcgatttagtagtgtagatttgggtttggggactcaacaaccacatctgtcctctagagaaaaccctgtgagcacagctccctcaccatggactggacctggaggatcctcttcgttggtggcagcagctacgaagtcgcccactcccaggtgcagcgtggtgcagtcgtggggctggaggtgaagagccgtgggcctgagtgagtctcngcaggctngtntctacgtttacnctatagtactcaacgtggtgccgcgacggcgacgtggaccacgccgtgaggtggngtgggagtcgggaaccgtaacccgtaagtcgtggtcgtacgacgtagttcgtccttaccacccgtacgtcccgtaccgggtacctagtaacccttacacgtcgaacccaccgtaacctcccgtaaccaaacctaaacacctaacgtacccttaacgaacggttagggtaacggttaggaaccggtacgtccctagacgtaccgtacgttcggaaccgaccggtacccggtaccgtttagttaccttagtcggtacgcgtaaccgtccgtacccgacggacggttacccggacggtaccggtccccggtaccggacggtcgggttacccgggtaccttttacgggcccggtttcggggacccggggg

SEQ ID NO: 206751 - DNA, 877 bp, Homo sapiens
  misc_feature: GYAE6OF01ETIW2.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatccctcttcgttggtggcagcagctacagtcgcccactccaggtgcagctggtgcaggtcgtggggctggaggtagaagacgccgtggggcctcgaggtgaaggtcctccgtgcgaaggtcttcgtggtacttctaccgtttaccctctaatagttactacgtaacgtggggtcgccggccgacgggcccgtcgtacgggaaccaacggtacccgtaggtagggtagggacgttagggggtacgtacgggggaaccccgtaaaaccccgttaaaccgaccggttacgggttaccggttaccgtaccggtaggtttaccgttcccgtttacccgtaacccccgtacgttcccccggtaacccggggaacccgtaacgggttaaaccccctttaacccgaacgttaacccggtaacccctaacccggttaaaccccttaccccgtaacccaaaaccgttaaaacccgacccgtaaaccggtacccttaaccgtaacggtacgggtaacggtttacgggaacgggtaccgtacccgtaaggaaccttacgttaccggtacgaaccggtaacccggacccgggttaccgtttacctttaaacgtttcgtacggtaccggtacgggtaacccggtacccggtaccccgtacggtaccgggttacccggcggtacccggaccccggttacggacccgtaccgggttacccgttcccggttttaccggtccgggtttccggggtacccggggg

SEQ ID NO: 206752 - DNA, 585 bp, Homo sapiens
  misc_feature: GYAE6OF01CIQ3D.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagcgcccactcccaggtgcagctggtgcagtctggggctggaggtgaagaagcctggggcctcagtgaaggtctcctgcaaggcttctggattcacgtttacctcctatagtatcaacgtgggtgcgccaggccgctggacaacgacctgagtggatgggatgggacaaccctaacactggtgtcacagtcgtcttcacccatccgtccgggacacgtacttaccatcgaccacgaacctcctaccaataaacacacgtacctaacagtggtagttggagtacgccgtagactactctacgaacgaccgaccgggtccgttacttaacttacgttggtacgaccggagtaccgtccccgaacgtcgttcccggaggaccgacccgtacgggccgacggtccggtcctttcggaccttcgggtccgggg

SEQ ID NO: 206753 - DNA, 575 bp, Homo sapiens
  misc_feature: GYAE6OF01BL0XY.17.25.C03.1.454.CMB.1.raw
  modified_base (281)..(281): a, c, t, g, unknown or other
  misc_feature (281)..(281): n is a, c, g, or t
  modified_base (563)..(563): a, c, t, g, unknown or other
  misc_feature (563)..(563): n is a, c, g, or t
tcagcgtagactagcacgaccggtgctcgatttagtagtgtagatttgggtttgggggaggtcagtctcagtcaggacacagcatggacagtgagggtccccgctcagctcctggggctcctgctactctggctccgagctgccagatgtgacatccagatgacccagtctccatcctccctgtctgcctctggtgggggtcagatcaccatcacttgccggacaagtcacggtacgttaaaacctatttaaattggtatcagcaagaaacctggaaaacnccccagacctctgactctcgtggtgctatcccatcgtgacgaaggttcggccgtcccagtcggaggttcaggtgctaggtgatcgtggactagtatttacaatcctacacctatccacctactctacgcctaaccgtggaaggtattgtacgtactaacttactactactgtaacaacgtagtagttacctacgtttccccgtcgtaccttaccgtttcggaccgtacgggtaacctaaaggttcgaagtactaacaaacgtacgtggtcgctcgactaccnttccgtgttacc

SEQ ID NO: 206754 - DNA, 821 bp, Homo sapiens
  misc_feature: GYAE6OF01B2R1L.17.25.C03.1.454.CMB.1.raw
  modified_base (262)..(262): a, c, t, g, unknown or other
  misc_feature (262)..(262): n is a, c, g, or t
tcagcgtagactagcacgaccggtgctcgatttagtagtgtagatttgggtttggggacgtcaacaaccacatctgtcctctagagaaaaccctgtgagcacagctcctcaccatcggactggacctggaggatcctcttcgttgggtggcagcagctacaagtgcccactcccaggtgcagctggtgcagtcgtggggctggaggtagaagaacgccgtggggccctcgaggtggaacggtctccgtgcgaaggtcttcgnggtattctacgttttacctcctatagtatctaacgtggggtcgccgccgaggcccgctcgggaacaacgaccgtggacggtgggagtgggggagttcgggggacctaaaaccccgtaaacgtacgttgggttcgtaccgaacgtaacggttcgttacctttacccgaaccccctaacgtttcccccggtacccggggggaaacctaaccgggttaaccccttttaaacccgtagtttacccggaaacccccgtaacccggtaaaaccccttccccttaacccaaaaccgtttaaaaacccaacccgtaaaccggtacccttaaacgtaacgttacgggtaacgggtttacggaagggtaccgacccgttagaacctacttacgtacggaacccgtaacggtacccgggtccgtttaaccgtttacttaaccgttggtacggacggtaacggtaccgttaccccgaaggtacccgttacccggggtacggtaccggtccccggtaggacccgtacgggccggtttaccctttcgggtaaccgtttcggggaacccggggg

SEQ ID NO: 206755 - DNA, 684 bp, Homo sapiens
  misc_feature: GYAE6OF01C0TXL.17.25.C03.1.454.CMB.1.raw
  modified_base (356)..(356): a, c, t, g, unknown or other
  misc_feature (356)..(356): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctggtgcagtcgtggggctggaggtgaagagccgtggggcctcagtgaaggtctcctgacaggtcttctggattctacgtttacctcctatagtatacaacgtgggtcgccggaccaggccgcgtggaaccaacgacctggagtggagtgggatcgggacaaccctacacgtggtcncacagttgtccttacaccctacgtcccgtaccgggacacgtaccttaccatacggaccaaccgtaacctccctaaccaataaacccacacgtacctaacgcgttagggtacgttggacgtacgcctagaacctgtacgtacgaaccggtaacgtaccgggtcccttaagttaacgttacgtcgtacggtaccggtaaacggaccggttaccccgaacgggtaccgttaccggggttacggaaacccggttaccccggttaccgggacgttacccgggtaccgggtttacccttttaccgggaccgttttcccgggaacccgggggggg

SEQ ID NO: 206756 - DNA, 565 bp, Homo sapiens
  misc_feature: GYAE6OF01EHRZA.17.25.C03.1.454.CMB.1.raw
  modified_base (244)..(244): a, c, t, g, unknown or other
  misc_feature (244)..(244): n is a, c, g, or t
  modified_base (281)..(281): a, c, t, g, unknown or other
  misc_feature (281)..(281): n is a, c, g, or t
  modified_base (292)..(292): a, c, t, g, unknown or other
  misc_feature (292)..(292): n is a, c, g, or t
  modified_base (424)..(424): a, c, t, g, unknown or other
  misc_feature (424)..(424): n is a, c, g, or t
  modified_base (444)..(444): a, c, t, g, unknown or other
  misc_feature (444)..(444): n is a, c, g, or t
  modified_base (447)..(447): a, c, t, g, unknown or other
  misc_feature (447)..(447): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcgagtgaaggtctcctgcaggcttcnggattcacgtttacctcctatagtatcaacgtgggtncgccaggccgntggacaacgcctgagtggatgggatgggcaacccgtaacacgtggtgtcacgtagtgtccttcaaccctagtcccgtacgggacacgacttacgatcgaccaacgaactcccaccactaaacacagacctanagtgagtgagagcctagacntcngacgacgacggtcctatactactggtacgcgagtaccgtacccacggtacgtccggtaggaccggcccgtaacgggccgtacggcggttacccttttggacccgttcggtaccggggg

SEQ ID NO: 206757 - DNA, 741 bp, Homo sapiens
  misc_feature: GYAE6OF01D1OJC.17.25.C03.1.454.CMB.1.raw
  modified_base (301)..(301): a, c, t, g, unknown or other
  misc_feature (301)..(301): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccgaggtgcagcgtggtgcagtcgtggggctggaggtgaagacgcgtgggcctcgagtgaacggtcctccgtgacaggtcttcgtggtacttctaccgtttaccctcctaattagtatcaacggttgggtcnccgccgaggtccgcgtacggaaccaacggtctaggacggtggaggtgggagtcgggaaccgtaaccccgtagcggttggtacgtacacgtaggttcttaccgtacctaaccccgtacgtcccggtacccgggactacgtaaccttaccgacgtaccgtaacccaacgttaaccctcccgtaacctaaactaaacccgactaaccgtacccttaacgaaggttagggtaacgttacggaacggactccgttaagacgttacctcggtaaccggaccgaaccggtccggttaccgttaacttaccgttacggtcggtaccgacggtaaccgacccgttaccccggaacggttaccggtccgggtaacggacccgtacccgggttaaccggccggtaaccgggttcccgttacggttttccgcggttcccggggaaccggggg

SEQ ID NO: 206758 - DNA, 664 bp, Homo sapiens
  misc_feature: GYAE6OF01C8S13.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctgaggtgaagagccgtggggcctgagtgaaggtcctccgtgacgaggcttcgtggtattccgtacgttttacctcctattagtactacaacgtgggtcgccgccgacgggcccgcgtacggaaccgaacgacctggacggtgggtagtgggagtcgggaaccgaaaccccgtaagtacgtggtgtacgacgtagttcgtctaccaccctacgtccgtcgggactacgtaaccttacacgtcgaccaccgtacctccgtactaactaaacacacgacctaagtagtgggtagttacggacggtacgcctagaactacgtcgtaacgaccggtaccgaaccgggtccttacttaacgttacgtgtacgaccggtaggtacccgtacccgacggtacgtaccgggtacgacggtacccgtaacgggaccgtacgggtacccgttaccgtttcggtccgttcgggtaccggg

SEQ ID NO: 206759 - DNA, 664 bp, Homo sapiens
  misc_feature: GYAE6OF01CMOMU.17.25.C03.1.454.CMB.1.raw
  modified_base (225)..(225): a, c, t, g, unknown or other
  misc_feature (225)..(225): n is a, c, g, or t
  modified_base (302)..(302): a, c, t, g, unknown or other
  misc_feature (302)..(302): n is a, c, g, or t
  modified_base (490)..(490): a, c, t, g, unknown or other
  misc_feature (490)..(490): n is a, c, g, or t
tcagcgtagactagcacgaccggtgctcgatttagtagtgtagatttgggtttgggggactcaacaaccacatctgtcctctagagaaaaccctgtgagcacagctcctcaccatggactggacctggagatcctcttcgttggtggcagcagctacaagtcgcccactcccaggtgcagctggtgcagtcgtggggctggaggtcgaagacgccgtggggcctnagttgaacggtctccgtgacaaggtcttcgtggatttcctaccgtttacctcttattacgtatcaacgttgggtacnccgccgagggccctgtacggaacacgtaccgtaggacggttggagtgggaacgttcgggaacctaacccgtaagacggttggtcgacaacgtagtcgttcctaccacctagtcccgtacggactaacgtacttaccagtacgaccctaacgtaacctccgttaaccaataaacactacgacctaacgngttaggagttcggaacggtactcccgtagactattcgaacggaccgaaccgtaccggtccgttacttaacgttacgtcggtacgaccggaaggtacccgttaccgaacggtaccgtcggacgacgtcccgtaggacgtaccggtaccgttaccttagtccgttcgggaccgggg

SEQ ID NO: 206760 - DNA, 704 bp, Homo sapiens
  misc_feature: GYAE6OF01C719A.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggagggtgaagaacgccgagggggcctcgagtgacggtctctgacgaaggcttcgtggattcgtaccgtttacctcctaatagtactacaacgtgggtcgccgccgaggccgtcgtacggaacaaccgtacgtggaacggtggaggtgggagtcggggaaccctaaacccgtaacgtacgtggtacgtacaacgtagttcgttaccttaccaacccgtacgtccccgtacgggactacgtaccttaacagtaccgaaccaaccgtaacccttacccaaccctaaactaaaccaaccgtacgacccttaacgtacggttacgggtagtttacgggaacggtaccgtaccgttacggaaccttaagtccgtaacggaacccggtaccgtacccgggtcccttacttaacgtttacgtcggtacggacggtacgaccgtacccgacgtacgtccggacgtccgccgtacggacgtacggtccggttctttacggcgttccgggaccgggg

SEQ ID NO: 206761 - DNA, 750 bp, Homo sapiens
  misc_feature: GYAE6OF01BRX8D.17.25.C03.1.454.CMB.1.raw
  modified_base (289)..(289): a, c, t, g, unknown or other
  misc_feature (289)..(289): n is a, c, g, or t
  modified_base (302)..(302): a, c, t, g, unknown or other
  misc_feature (302)..(302): n is a, c, g, or t
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtcgcccactcccaggtgcagctggtgcagtcgtggggctggaggtgaagagccgtggggcctcgagtgaaggtctccgtgcaaggtcttcgtggattctacgtttacctctatagtatcaacgtgggtcncgccgaggcccgntggaccaacgccgtgacggtagagtgggatcgggacctaaccctaacgacgtggtcgtacgacgtagtcgtccttacgaccccgtagtcccgtaccggggaacacggtaacctttaaccgagttaccggaacccgtaaccgtaaacccttcccgtaaccgtaaaacttaaaaacccgacccgaaaccggtacccccttaaagaacggtttacggggtaacgtttacgggaaacgggtaccgtacccgtaacgggtaaacctacgtttaccggaaccggtaacccgggtaacccgacccggggttcccttaacgtttacgttaaccgtgggtaccgaccggtacgtacccgtaccccgtacgggtaaccgttcccgggtacgacccggtccccgtaagggcccgtacgggtcccgttacccgtttaggacccgtttcggggacccgggg

SEQ ID NO: 206762 - DNA, 822 bp, Homo sapiens
  misc_feature: GYAE6OF01D1D4S.17.25.C03.1.454.CMB.1.raw
  modified_base (179)..(179): a, c, t, g, unknown or other
  misc_feature (179)..(179): n is a, c, g, or t
tcagcgtagactagcacgaccggtgctcgatttagtagtgtagatttgggtttggggactcgaacaaccacatctgtcctctagagaaaaccctgtgagctacagctcctcaccatggactggacctggaggatcctcttctggtggcacgcagctacacgtcgcccactcccaggttncgagctggtgcagtcgtgggctaggaggtgaacgacgtccgtggggccttgaagtggacggttacctccgtaggacgtaacggttcctttcgtggtaacctttaccgaccgttttaaccctaccgttaagtacgttactccgtaacggtcggtacggtcccgaccgacggttccgtcgacggaacctaaccggtccggtagtacggggtaccgagggtacggtaacgtcgggaacccgaaccgtttaacgacggtacgggtcgtaccgtaacgtacggtacttccgttaccacccctagtcccgtaccggaactacggtaaccttacgaactaccgaacctccgtaaacctccgtaacaacgtaaaccgccgtaacgtacctaaggttacgtacgggtacgttaggaacgtccgtaccgtaagtaccgtacgtacgtaccggaaccggtaccgttaaccgggttaccgtaaccgttaacggttaccgtacgggtacgtacccgggtaaccgtacccggtaaacccgtacgggttacccgtaccgggtacggtcccggtaaccccggttaacgggtaacccgtcccggttttaaacccgggtaccctttttcgggtaaacccgggttcccggtaaaccgggggg

SEQ ID NO: 206763 - DNA, 659 bp, Homo sapiens
  misc_feature: GYAE6OF01D6M81.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagaagcctggggcctcagtgaaggtctcctgcaggcttctggattctacgtttacctcctatagtatcaacgtgggtgcgccgaggcccgctggacaacgcctggagtggagtgggactgggaccaaaccctaacacgtggtgtacacgaggttgtccttacgacccgactccgtcccggggaacacgtaaccttaccagtacgacccaacgtaacctccctaccgaactaaaaccacgacgtacctaacacgttagggacgttacggaaggtcgtaccgtaggaactactcgtacgaaccggtaacgacccgggtaccggttacttaagttacgttgtacggacggtaacggtacccggtcccgaacggttaccgtcccggggtaggtaaccgcccgtacggaccgtaacggcccgggttaccgttttacgggtcccttacggggtcccgggg

SEQ ID NO: 206764 - DNA, 626 bp, Homo sapiens
  misc_feature: GYAE6OF01AXARF.17.25.C03.1.454.CMB.1.raw
  modified_base (204)..(204): a, c, t, g, unknown or other
  misc_feature (204)..(204): n is a, c, g, or t
  modified_base (288)..(288): a, c, t, g, unknown or other
  misc_feature (288)..(288): n is a, c, g, or t
  modified_base (513)..(513): a, c, t, g, unknown or other
  misc_feature (513)..(513): n is a, c, g, or t
tcagcgtagactagcacgaccggtgctcgatttagtagtgtagatttgggtttggggtacgtcaacaaccacatctgtcctctagagaaaaccctagtgagcacagctcctcaccatggactggacctggaggatctcttcttggtggaagcagctacaagtgccccactcccagtgcagctggtgcagtcgtgggctgaggtnaagagcgtggggcctcgagtggagtctcctgcaaggcttcgtggacttctacgtttacctcctattagtactctaactggggtntcggccacggccgtctcggaccgtaaccggaaccttcggaaggtggagtagggggtactacggggaccgaaccccgtaacgtacgtcggtcggttacacgtagtcgtacttcacccgtactccggtcccggacacgtacctactagtaccgtacctaaccgaccttccgtaaccacctaaacacacgacctatacgtaggtcgtacgaggcgtacctgaaccctntcgtacgacgaccgtacggcccttagtacgttacttgggacctgaacgcgtcccgtaacgtgtcgggtaccggtccgacgtcgcgaccggttacttgtcgtggtccgggaccg

SEQ ID NO: 206765 - DNA, 806 bp, Homo sapiens
  misc_feature: GYAE6OF01CRRVW.17.25.C03.1.454.CMB.1.raw
tcagcgtagactagcacgaccggtgctcgatttagtagtgtagatttgggtttggggactcaacaaccacatctgtcctctagagaaaaccctgtgagcacagctcctcaccatggactggacctggaggatcctcttcttggtggcagcagctacaagtgcccactcccaggtgcagctggtgcagtcgtggggctggaggtgaagagccgtggggcctcgaggtgaacggtcctccgtgacgaacggtcttcgtggtactttcgtaaccgttttacctcctaataggtatccgtaacgtgggtcgccgtccgacgggcccgtacgtacggaaccaaccggtaccgtggaacggtgggagtcggggaagttacggggaacctaaacccgtaacgaacgtgggtactacgaacgtacggttcgtaccgttaccaacccgtacgttcccggtacccggggaactaacggtaaccctttaaccgaacgtttaaccggaaccctaaaccggtaaaccccttaccctaaccctaaacgtaaaacctaacccgtaaccgtacccttaaaccgaggttaacggggtaacggtttacggaaccgggtacgtacccgttaagaacctaaggttcccgtaaacggacccggtaaccggtaaccgggtcccgttaactttaacgttaccgtggttaccggaacggtaaaccggtacccgtacccgaacggttaccggtaccggtacggtaacgcccgttaaccggacgtccgggtacccgtttccgtttacggtaccgttcgggtaacccgggggg
